United States Patent 7,892,730 (COMPOSITIONS AND METHODS FOR CANCER) - sequence listing, part 5

SEQ ID NO: 379 - DNA, 58215 bp, Mus musculus
  misc_feature (1)...(58215): n = A,T,C or G
ttggagaccaagacaatccacggagtgcactgatagccatcctctctttgcttatttgtgatacttaccccatgcacggctcttaaaagcttgttccagaaaaaagaaagaaagaaagaaagaaagaaagaaagaaagaaagaaagaaacttgggccttagcaactagtgtctctgaatgtttttttatttcacgttcattttttttttccttattaaaatcacatttatctactcatctatttatgtgggcaccccagtgctccagtggagatcagagaataggttgcaggaagtggttcctctggctggagagatggctcagccgttaagagcactggctgctcttccagaggacgcaggttcaattcccagcatgcacctcaggcagttcacaggaaaggtactgtctctgaagacacctgcactggcatgcacatatccacacacaccatatatgtgtaaaataaaataaaaaggaatttggttttctcccactatgtgggttggatctaagagatcaagtttagctgcaatccctccccttctttacctgctgagctatcttgctggccccaaaggctcttttcttgctccaatttttgtaatctctttgatcaaaatggctgttgaagggtaacacctgtcatcttgatgacctccgtgcctctgggtagaagtctgaggagccccagttcaaggtcatcctgcatgctgagtttgaagctggcttggacctcctgacgaccttgtttccttcctggaaagtctgggcctgagctacaggaggaagagcagtttggatggactgtgatgtcttgtgaaaaggccacactcctgtcacttgggaggagtttcatttcctcttgggaaatttgtattgcaagtctccccttctccagggttctggaaagggtctgaatgcaccgggaggaggccaggtgtggaactttagaaaaggtgctggtgtttccagagggagggattaagtgcctcatatgacttaggatattgccccccacccctaattcacacacacacacaccccaccccaagtttgcattggccttaaatagaaattcttagcttactaccattcctccaagaagaagccccagtcccccagcccccaagcctggaaatttaaataatgttcacccgagtaaggaattccaagattacactggtaacactggacacctgtgttatgtcctgtcttcagcagctaagccgttgtttcactcgctgtgttcttgttactgtttgtttgttttttagatttaggtctacatgtatgtatgcggatcacacgcatttctgacccctgatgcatttagaagggggtggtgttaggtcccctgaaactagagttacaaatggtttcgagacacctggtgctgctagggactagacccagttagtctctttaagagcagcaggtacttctatctgctgagccatctctccagtccctgtttgtttgtttgtttgtttggttttttttttttttttgagtctggttttcatagccctcaaggccagcagcttgagatactcctgctggagcctcctgagtgtgaggtggtagacaggcttcatgcccccatacaattactaattttttaatataaaagacatttagataatttttacatatgcaaacacgtctctctctctctctctctctctctctctctctctctcctttgttttgttttgtttcagtagtgttggggctcacccagggtatattgcacttgctaggcaaatagttttactgctaggcaaaaagtttactactaaacttttttctatgtggatactttgtaacagagatgcaaaatcagctaggccactctctatagagaaaccctcgtcctcactcttgggtgtgtctttctttcagaaagcccatttccttcttttaaccctcgttgcttaaaatatttttaataaaccgaacttcttcataaaacatgcaagcattgcatttctttttattttattttattatttttatctatatgtatatgtctgtgtgcgagtgtgaacttgtgccaccaaactcagaactgaactcactagacccagtgatggtcttcagccagcgagggtgagagagctgcagctccacaatttagcatttcttttgttccagtgtcaattttgtgagcaaagcttcccctagtgtttaaaaatgtttattaaaagcgctgtgagtggaaagttccctctattgtttagtaccttttatttttacctaaagggagtcatacttctgtaccatagtcctcaaatctgggccctcagtatgtttagaacattcctctttggtattgtgggtagttagcatggggaactgcctgtggctcccctgctcaaagtctctcctttttccttggatatatgcgggttgagagccttgactccagaagcacatgtcctgttggcagtcaaagaagactccaagatatttgggatctcacacttgggggcttactggcaaagcctatccaaatgttccgaaatccaaacaacttctaaatctgatccgtggaaggttccagacatttcccaaagagggtcctgggtctgggtttgtttcttctaggctcgcttgccttttatcccactctaacatggatgctccatctcctgtgtatatccccacctcccattctgagggtaggatgaaaggcaggtaggcaccaatcctgcttcatggaagcccatagatttttccagtgttttccagtgtcttagagttcctattgcttctgttgctgaggtgaagcaccatgaccaaaagcaacttggggaagaatgggttgatttcatcttacccttccaggttactgcccattgctgagggaaccagggactgatggagccacagaggggtgcagctaactggcttgctccccatggcctgctttgcctgctttcttctagctcccaggaccacccacccaggggtggcactgtacacagtgagctgggcctgcccacatcaatcaccaatgaagcaaatcctctgtaggcttgcagacaggccacgctggtggggcatttttctcagttgaggttccctcttccaaaatgactaggttgtgtcaagttgacataaaactagccaggctgcctggggagagaagaaagggggacatgaggaacatgagcagtaagctgatgacctaggcaccctgggacaggggctggtgatttatacggaaatcagaggactgggctgaagagctagaaggcctctggaagcagagctttgtgacctaattgtggggatctagttgcaagagggacactgactcagacccccaaatacaatgggagcctccttaagtctatgagaagaaacaggtgaaatccactttaaatgtatttgtttagatttttaagaatacattgtatttatagcaggtctatttatatgatattattgctatttctaaaatatccttttacatggaatcaatatgaaaattcggaagtgctggcagttcagttgaaccaacagcttcaagcatgacagagtacacactgtatctggtcccaatatttaaaaaaaaaatggttaagatattttacgttttttttttccctgtgttgatggccgaattctgtttttcactctcattcaccccagttggcaaggaccatatttcaatagctcaacagctgcagtgtggcctggagccaccagatttgccaactaggtctagagtgttagggctgtgaggctggagggtgggaagtacctgtgcgaagcgaggaagctcgtgttctgtaggggagtgtggtccaggagagactcagaatacaaggagtttggggtctggagagacggctcagtggttaagagcattggctgctctttccgagaatctgggcttggttcccagcacccccacatggtgaggctcacaatctgtaattccagtttcagcaggatcggatgctctcttctgttctctaaaggcacacacgggggatacacagacgtacaagcaggcaaaacagctatatacataaaagaaaataagtttaaaagtaatttttttaaaatacaagcttacgattctttcttctgttagcctagtattatagagagaaggcacttcactgtgcttgccatgcgtacatacgtgaacatgtatacatgtaaccacctgtgatgtgggaagacaaatgttcaggtctccttcagctgggaaccaatgcccaggttaaggaactgtcccgtgggtcagtgtcctggataaaagtgtttgttgactgccttctagagaacagggagatggagaactaggggctgaagcaatggctcagctgttaagagcacacactgtccctcaggaagaccagggttcatttcccaggaccaacatcaagtagctcataccactttataccaggggctatgatgccctctctccttgactccttgggtacccatatacacagtcgcaacacacatgcacacacacatacacacacacacacacatacacgtgcacacgcgcatgcacaaagaaaatgtttaggaggaagatgagaaggcgggtgtggaccctagcacttaggaggcagaggcaggcaagtgtggaccctagcacttgggaggcagaggcagttgcttctcttgagttcgagagcagccagatctacagagtgagttaccggatagcccggactacacagagaaaccctgtctcaagaaaaccaaaagaaaaagagaggaagatgagggagaagaagagaccatgaccaatacttggccctgaaagcaccagccagtaggtttcgtgcatcattttagacaaagagatccgatgttaatagactctctagtcctttagagttgaggtacaaggccgggtgctccaggctgacttcccgctagatatactgaagctcctgttgtgtaagttatttaaaagagaccctctccgtctctttcacactgtccatttggtccttataaccacccagatgtcatcaggacagatattttagccttgccacaagtatgaaaactgaggtaatatgatctcaatgcccttccttgaagatctcttcatctaagcgttggaatctgggagcctgggctgagagtggaagaactaactgatggggtgtcagacgtagcaccgtgaggaaacctctgtgtacacctggctgtgggtcacacctgtcaagcagtggaggacagaggcgattcctaagggctacggggcccgtctttaggattccccatcgagtctggattcgtggtttacgccaccgcacgctctgcagatgtgtgagccgtgcactgagtgcacccgacaaccttttcattcctggagttggtaccaggagactgagtgtctatagcatctttgttgtgcaatttgaggcccagagggtagaagagggggaggcaggagggactcttgtacctgttttggacatgagtcagggggaaggtgccagactactctcagaatagtctcaggtgtctgaagagcattcatcaccggggatgaaagaaggtgtgtacagccagcccacacctagggagaggtaggtgggcagatgtctcaggggacagagtgacaggtggaagctgcggtctgctggagtataatcagtcatctcagggtgacacctgctcctcctacccatcctttgttgttactaaggacttagtattcagggttactgtgggattcagggttttgttgtccagtgtacttcttggataacggctatctacactgattaggacggctttgggagcatcttcaggcccgagactgtgcctgaccctgggtcctgaatggccctgagtggacagagaatgagggacttgtcgtcgtttcccagcattaacttggattcctctttatcctcttagtttctctagcgcatgggaatccgcctgtgtctgcccacatcggatggagggctggtttttatttttgaatttcctgtgttggggatgaactcagggcctcttgtatgctgggcagtgatttctcccctgagctgtatcccatttaggtgtggtgaagttatttgcgttctcccaccttgaattaatgtctcccaaacctgggcgatcaagttctagtgttaccaacagctccatttccttgggcaaagttcttaagctcttgggttcccgatctccccacttccccatcccagtttccttctcttagcagagaccagaactctccttagaggcagagtaggaagaataaaggaagctttagagttataaatgtattttacttgtgtaggctccacagaacattcagcaaatattccttccatttctaacccttttcctaaattcaggaggaggaggaggaagaaaaggaaaaagaagctagaagggaaatatttacttcatttttagtttaaaattattaatttttttaagtaagcctttggaggaagctaatggtagtgtgcatatattcttctggccaagaatttggggtttttttggttgttattttttatttttttgccagccaggacggacttgactggctagagaggggcccttcttggttccaggacaggcaaggctgaaacaccacattagggcatgttccggaagcagagtctctgactagcttggacagttccctggagcaccgaggacagaaaacacctgggagataggagatggtcaccccagtccgcagtggccagccagttctcaccacttgtcatcttatccttaggaccctttaaattttaccatcacagagccagtgagacggctcagtccccataacccatgcaaaggtctctagaggggaagagctgactctgtggagttgtcctctgacctttgcatgtgtgctgtggcacagtcaccctgcccaccccccacccccagcagtaatccataaaagaaaaacatttacaataccaaaacatgaccatcacaaactcgaaacggctccagggctgcagaacccacggctttaaccaggtccgtgtgagctactttgcctcaatcagcctctgcaccggcccttgactgcgcttgtccgtagagccttcctctcccactcaccctgacatggccattcctggctgtcagatgttagcgtcaccacccaacgtcgcacagtgtcctgctctgccttcaagggtgaagcatgtgttccctgggagggaggctggtgggactggaggtcctatgagtcttctccttttaggggcaaaaaagaaaaaaaaaaagaccctggggacctggggatggatctctgctgtagcacacttgcttagcctgtgaaaggccctagattccatccctggtcaaacctatccccccaccccccacaaaagtggtttatcaagtctccatattccatgtgacatgaagctatgaactagtacttaacctcctatttcttacgccctctttcccttcctttctctctttcttccctcttcttttccctccctctctccctctttctgtctgtctgtcccgggactcactgtgtagaccaggctagccttactcacagagatctgcctgctctcagaatgcagggattaacaatatgcatcatctttcctttagtagtcacctgcccatgaaagacggtctggagcgccttcggtgtcttgacttgtgaccccactcttcgcctctctatttactctttatcagagggattggtttgtcccggatggaatgaagtcgcgtgttgggaagttagcagattcctgtcccttacaatggttgcataatacttaaacaaggctccctctttctctctctttttctcttctcttctcttctcttctcttctcttctcttctcttctcttctcttctcttctcttctcttctcttctcttctctccttccttccttccttccttccttccttccttccttccttccttcctttctctcttgttattgttttgttttttatttttaatttgcacattaccacaaccatctacaaatagtgtgtgtgtgtgtgtgtgtgtgtgtgtggcaggggttgaggaggaggtgggtcacactggtctatctggggcctagacaccaatgggaccctgagcagcagcagcagtcttggccttgcttggaccatagcctttagttggtacagtctgcaacccttgggccgtgcagccatgaatccaatccccgaacttgggtgggtgataaaagcaagtctgcctatccccgtggatagggctttttgtcattcaacctccttaggctttagaaggggtttaatggcctcagtgtgtgcacttgttgcttctgtattgcttgcctgcatcttaagagattcatatctttgtgattctggtttctttggaggtgggggtgggggggttgagacagtttctcagtgtagccctggctgtcctggacttttctatgtagactaggtgggcctcaaactcagagatccccatgcctctgcctcccaaatgctgggactataggaatgcccctccacacccaactttcttacctgcgttttttgatgccattttcgtgccattgggggcggggggctgcttgaatgtggtggttttggccttgtctacttaacccgcatcggaagtgcttgggacttgaaactgcacaatgtctttcttaagctcttgatcacaatatggctctttggggcttccatgaggtcctttcctttccttccatagatgagcgaggcttttatttcgaagaacatcatggtggcagtcctagccaacttggcccttagtctgtactgagaacgttgttgtagaactgcagggtagaacccagcttcccaacgctctcacaaaatagctgaagcaatcaagttaaagagaggaaaggtttctgtaactctccgttttgtgggtttcagtctggggttgactgttgcttttgagcatgcctcgtggtgggatgaaggcaagtccttggagctcttcgtagtagagaaatcctgctcacccatggccaggaacagaaagggtggagaggggtgtaagactggatcgctgtaatcctcttcaagggcatgtccccagatgacttaaaccctccctggagggctgtctctcaaagggctcttcacctctcaaaggtacccattggggaacaagccatattatggatttaagcccagttgagacctgttacctctgattcatgtcaggataggctcagttctctttgtaccctaagaagcatccttctggggttgtaggagccagagaggtcaagaacctcacagcatcaaccagggctcatagggactcagagtctgagctgacaatgagggagcctgcatggtctaacgtaagccctctgcgaatgttacagttgtgtaactgtgtttctgtgggattcctaacagagggaatggaggctgtttctgatgcttttgcctgctttgggaacccttgtcttcctaactgggttgccccgtccagccttaatatgaggggaggtgcctagttgctgttgttgtctttaagatttatttatttattttgtgtgttatgagtgcacagtagctgtcttcagacacaccagaagaggacatcggagcttattacagatggttgtgagccatgtggttgctgggaattgaactcaggacctatggaagagcggtcagactgctgagtcatctttccgccccgaggtgcctagtcgaattgcatcgagtgatatgtcatgtctggttgatatccctgggaagcctgcccatttcggaagagaaacagaggagtggatggggaggggaaaccggggtcaggatgtaatatataaagaataaattaatttaaagaagcagaagcagcagcagcagcagccgccaccgccttccaggcaggttgaccagggatgcgatgcgctctttttccccatcacccctctcctctccaacgtctatttcagccgttgtttctttccccagagtcagcttgcgaaggcagaccacgctcacggtggaatatccatggaggtacggagccttgttaccaacctctaaccgcagaactgggatgtggggctggaagtgcctcctcttctgggctgtgctggtcacagccactctctgcactgccaggccagccccaaccttgcccgaacaaggtaagacgacaggcggagggtcagctggacccctgagctgaggagacagggtgggctaactgtcgtggaggtgatgtagtcagctggacagacttcctctttggaggagcaagggccccttccctatacctgggctgatttgggcttccttccatatccggaaccagcttcatcagaggcagggctcaatggggaccgctagccagaagtgaggttctaggggagtactttctttctgggtctttaactcagatgatgaaagatgaaagagtgacgtgaatatagatttggagaaagcattccagagtaagaagagcttggcagtgtggcctctggcttccagaaagccgttccagtgacagatcttctacaagggcctgagcagtcagtcacgagcacgtgcctttttggactctgtcctccaggtcttacctgggggcctgatggatagtttgctttggagatggcctgtttaagggacttggaaaggaacaggaggcaggatggggatcgggggtcttacgaggccccactggcctgtggtgtgtttccccgaaagttgttcctgctcctaagattcctggtggcttctgaggaacttggagattaatgttgagacctttctgttgtcaaaaggctcgagagttagtggctggtcacagaaggctggcatagaatgggtcaaaggcttgagatgtccatggcaaccatggccatgtatacagggctgtcctctaagctgtcagggacctgttagctgatcagtgagtgaatctgtgcatacgaatgtatatacaaatggcagtgagagaggagcagggtgcggtggctgaaattgacatattcatggtgcattcagtagtagaaccaaagagagatatgagcaagaacatgcttaaggctcaaggcaagagaggacctctgtacctatagggctataggtatatataggtatatagttaccgtcaaacaatggagagacaataaatatgaagcagactgtttacttattaaaacttatttattatatgtgtctgagtgtcttgcctgagagtatgtgtatatgcttggtgcctgcagagatcggaagagggttcgtggatcctttggaaatgggagttaagaatgatcatgcgttagccgggcgggcgtggtggagcacgcctttaatcccagcacttgggaggcagaggcaggcagatttctgagttcgaggccagcctggtctacaaagtgagttccaggacatccagggctatacagagaaaccctgtctcagaaaaaaaaaaaaaaaaacaaaacaaaaaaccaaaataaagcaaagcaaacaaagtatgattgtgagttgccttgtgggtgctgggaccccacttccctgcacaagaacagcaaatgctcttaacttccaagccatctctttggccactagtagaccatagttaaactgtacagtaaggttttatcagaatgcagggggatgtcatacctagagctgaactgcatctgtcctgctgtccgcggtgccacctgcctttaatctcaatactcggaggcatatctctgagtccgaggccattttggtctgtgccagtgccacatagagagagtctgtctcaaaaggaaaaacagagaaaagagaggaggggtgttttatctttttagttttgacataggatcttgctgtgtcgcacgatcttctaccacagccttttgagtgctggattacaggtgtttatctgtaatcttacctgagggtactaaggtctctgagggggataagaacgggcattcttagtcgagaggcttaagatgtgtggacagtggtattgctcactgagtacaaagctgtggagagtaacacctgggaaaactggattcagccggcacatggaaggctttcttacatcttgctaaggaactcagtatatttaaatggttcttgccgagaaatttgaagtgtacagacacgacccagttttcggtaacttggtttgctttgtgcgacaaaccactaaaatgggaacaacaataaaggctcagatgtcacaacacagacacaatacctccacgtgaaagtgtgcgtagctgttcttgcatctgctgtcaggaagggctggagaagggcacgttgagtgtcaagtcagggagtgggactgaggccccgggagagtgatggccgtattctaggagagaatccatgggtttcgctaaatagtcggacgccagctcctcttccttcctggtccttttctctcctcctcttcctcctttccattctcatcctccaccttttctcctctaacaaactctttacagcccaaggaaggaaagcagacagacagttcagatctcatgccaggcccttgcaggcaggcagtttccaaatggtcctcttataagaaattttaaatgactttttacttatttttttaaataattttttacgtgcattggtgtcttgttcgtgtgtgcatctgtgtgaaggtgtcagatcccctgaaactggagttctagacagttgtgagctgccatgtgcgtgctcagaattgaacctgggtcttcttgacggatatagccagccctcttaaccctgagccctctctccctgcccccacgtgaggaattttaagtggagggggagggtcgttgaagctgctgagctgccaaggtggagaccgaagcaggggacctatgacctttttacctgttttctttttgtttatttgagacacggtctctgtgtgtagtactgcctgttctggaactcgctttgtagaccaggctggcctcgaactcagagatctgcctgggatgaaaggtttgtgccacgaaacctaggcacagtagtggttctgggaatagaaggggaggggaggggtggaagagtctgtgtagtagtcatagctggagtcagttggttgaaggataatttatgtagtatgaaatgtgcagctcagtgagttttcataaggcctacaccttatgttgctaccatcctagtcgagagatcagtgtgtcaccccaaaagcctttcccatgcttcttgctgtctccaacctctgtcctgtcacttcctgtctccgtacactagcgatgtttgttcgaggatttcctgtcaaggacgaagtctcatgatgacgtatgaatctaatcacctgtgatacccacgtgggtcactgtattatttcatttccttccctatttttttgtgacaaagtctcactctgtagccctgaatgccccggctcttattatatagaccaggctggcctcgaactcagagatccacctgcctctgcctctgcctctgcctctgcctctgaatgctggtattaaagacttatgccaccacaccctgttgtgggggggggcagttttgaaagaacacagacccactattaactgtgatgtcagaggaatatgccctgtccatgccctgtaaactttggaacctcacagacatgccgtgtactgtagtcttggccatgctgatgattaagtaatgctgctattgtctttaaaaacaaaacaatacaaaacaactgtactttatgtgacaaagattggtccacaagttaaaaacaaatcatcccagactttgcttgcacttgggaaggctttaggggaggcggcgaggagatggcagcccctcccctgactgagcacaatcctggcagtcctctgcaaacgcccctgccctgaagggacccaggaggcctgcagtttctggctgtccttacaaagttgatttaataaggattccaggaaaaccagcctcctctcccaccccaccccaccccgtccttctcccgtttgccatattaccgagtcttaagctttgtttcttcagattgggttttggggtttgtgtgtaaaatgaaactgggacacaggcccaggggcagaataccggcttccaaaagtttaggagtctgaggaagactgcttgcatgtatttgtctccgagagcaggacttgaggcatcagtgagtgggtacgtccaaaactttgcagggccacttgtagttgggaatggcggcctctgcttccctgttccctgagcaccctaaaggagcaagccagtgtgagacttccagccttgaaatactttcctccgtccacagaaacctgcatctcataagagatttaatggctgaggttttacagctcctcccacccacccagatttgaaggagtctggtggcaggatgagggaggagaggttacgttaaatggaaaagctgcaggctgtaggcccgcctgtgtaccacaaagcccggctttgtccttgttctgccgaaaaaacctgtgcctatggggaaaggctgggggtgctgccaaaatctggccctggcctcagctgtagctccctggtagccctcccacgcccaccccactaggggtcctgagctgccactggtccaagagggtgtggatttcaacctagctgcctgggagtctagctaggtatgcagtgtgtatcactgacaggcaggctgtagtccaggcagcttttgcttgttggtgtgacctaaggagtaaggttacatagctggcttggaacactttgggggacacaccgtggccaccctccacccccagtaaaatttcttgtgaaaagaccttgtttgtttctaacccactggacagtagaggattccagaatgaaaggtgttaaatgatgccccccccctttgttgttgttcaagcgagggttggggggttaggtccatgaagtctgttgccaggtttccctacgtcattgtgcatcccctccctggaggtagaaccagcgcttctgaaaggtgcttgctagcggaggggggtggggtggggaaaggggaaggccccttcctcaacctgtgagagaatgtgagggtactcacgtgtccggatcagcgaggcccggggcagccgagccgctcaaggctgtgttcttggctcgggcctccgcattgctacaccattagcctcactcatttttccactctgccgttgccagccgctccccaaagtaaggggggaggaggaggaatttctcagggaagaaagaacaaatggttgtccagaggacttgctgtcggtgggggagtaggggtgggggggcagggagggaggccatacaaagaatccagccaggattctgtcaccccgagtctgggactacctgtggggagggcagaaccggagggagctggcttctgtgagagcgtgcttctgctgcgtcccgagtgggtgggcagggcctaagcaatgggtcctttctgtcaaggagcagggtgtctctgggatgtcattgatggccttggggaagtgacttctggggatcattatccaggaggtgagagccaggtcagagagtctgaccagcagctctgccctgtttttataaggcctcattcctcgaggctattgggaagtctctttgctcatcccccccatccccatcccccatcccccacatccttacttccctcttccctggaaaccagacaactgtttctcccctaaccgggagtgacccggctgctctctctcctcagcttcgtaacagtgctcataacagattctcagatgcataacagtgtcacaattacagttaggaagtagcaacaaaataatcttatggtgatggtggggtcaccacaacacgaggaactgtatttaatggtcgcagtgttaggaggttgagacccatggccttaagagaagccttttggagtctgggctgcctctgacttttagtttgctctgtcagcctgtagtgtgaccggtaggaacccagtcacctgggccctctaaatggctgtaagtagagagccctgggcttgagccactgcctccctcaccccatcgggtctttggctaacaccactgtccacttaccccataccacacatggttcctgctgtcttcattcgggaatcatgtcctgcatacggagcaaggctagggtgagagttgaaacccagtacaccggtggtcctatctgctgagttgctgtgctcctgagcctcctgggatagctcgtgtaagagaggtgatttgggggcagcggtactcttggttagcctgaaagcagccgttccccagaccctgaatgtgtaggcaaagtgggtaagagggcccgggaattcagcaaaatgtagacttgctgcctgtgagtctggatagaaaacgtcaggactgaaatttcaaatggttaattagcaaagaaaattgagtccaggactcagcctttcctcccccatggtccccacagagactgctaggctcaggctggttaccggcctcttccttcactgattctcccccatctagccaagtatattcctattttttccttgaccgtagcatgcaccatatatatgaccattgcttgtccctctccttttacatgaaatgcccacccgtccccgcccaactttttataattctttaatcatatgtacttaattcttacccttaagatttagtctgggtccccactaagattttatttaaaaggccacccctttcttggggtttcttttgtttccacgttattttatgtgtgttgtgtgcatgcagtgcttgcagttccggacaagaccagaagaggccgtcagctccccccctacacacacaccccggaactaaagttacatacagatggttgtgagccaccatgtggttgctgggaattgaactcaggacctctgggagagcagtcagtgctcttaaccactgagccatctctccagcccagacactgtcagtctttaagaacattgatttgatggatgtagaacctttaattctagtactctgaaagtagaggcaggtgaatttctgtaaattagaggccagcctggtctacagagaccctgtttcaagaagcaaaacagaacaatcaatcaataaaacaacaaaaataaaaacaaacaagaaaacctccaaaacactattttgatatgtgtttataacaagaaatcagaaactacaggcttgtacagacagataaataatgtcttagattctcatcatccatcaataatcacagttggcctgaatctttttttttttttttttagattttcttcttgtgtttatatctgagaaatggaatttatactgtatatattggcttatatcttaaatctgttcctatatagatttttttttggtagtaactatataatattgcattgtgtgggttacagaatttttacccttctgctatcaggaaatgatttaggctgtgtgtagtggattgctctgtggcattttctcttctttctttcttttttgtttttaattatgattttaaagacaggatttctctgtgtagccctgggtgtcctgtgacacactctgtagaccaggctggcctcaaactcatagagattcccctgcctccatcactggaatgctgagattaaagtggtacactcccatatgttttcatagacttgcagatataataaataacccaattagggagtgatacttgaagcccacatcaaataaagacaagatatataagaacatctcacactgcataagagggccaaagggctcaaagtaaaggggcaaactgcttatctgcaggcagtaccagctcattaatttcattatggttggatatacagagacgtatttatattgattatattgatttgttgccttaacggtgtctggaggcttgtactatgaaaaggttttgtcatcatgcaagcaaaataaagtgttcttacaaacttacaaagtgtagcccagcacacctaggctatatagtgcgtacctctgtgtatatggtatttgaccttggtcttaggccacaataagccaacacaagtttaaaccaagtacaagagattcaggatacagccaaagttggaggaacattgaatgtgtgaggctgctcttggcatagtgtgaaacattgttttatagtgaacttttttctttttaaagatgggctctcatctacaccaggctagcctcaaactcccaatcctcctgcctccgtctcccaagtgctgaggcttttatatcactgcacctaattttatggtgaaattttttaaaaaaggaagaagtgcatgtgtgtgcttgtagatcagaggataactggctggagtcagttttcttcttccactatgtgagtcccagggattaaacttaagccaaaacctttcctatgtaatgggtgacattctaaagtaataattaaaagtatagcatagggctggagagatgtctcagtggttaagggcactgactgctcttccgaaggttctgagttcaaattccagcagctacatggtggctcacaacccacctcgtaatgagatctgatgccctcttctggtgcgtctgaagacaggtacagtgtacttacatataataaataaatagataaataaataaataaatctttaaaaaaaagtatcgcatactcacagctgacaagatggtgtagcaggaaaaacacttgctacacgtaaagcctgggtgatcacttgctgctgaattcaatccccagaacttctgtaatgggagaaggggtgactccgctccacaaagttgtcctttggcttccacgggtgtagggggtggggtgggtgtgcacatacagaatgacaataaagaatttttaaaaatgctttagtacatccaacctactctatatcatagtttggcccactttaaatgtgtttgccggacttccttttacctgaagcttggccaaagcaggaaacatagagcctaatcttagccaatggaggaacatgcctgtaatctgtttgggtggctgaggcagggggattgggagtttgagactatttaggtagaggttgtaacttagtgtttggctggatgcttgtttgacatgtgtgagggtctgggttcagttttcaaaacgcctcatctcaaaatggtttatgaagaatcagttactttgcagccaaggctgcatggcttgcgagtagcctagaatatggtatagtttctactttccttatattatagttggaaggtttttttttaagatttatttttaattacatgtatgtatgtatgtatgtatgtatgtgcacaggactgcagcccacagaagttagaagagagtgtcagatcccccaaagctggaattacaagtggttatgaacctgtcttacgatgtagatcaggctggttgcaaacttgcagagaactacctgcctctacctcccgagctcggggattagagagctgtgcaccactatactatgttggctccattttcatttttttaaaaaaggtacctctttgttttcaattttattttcatcttttaaattttacctgctttgtgtttgggctgcaatgcatttacatgcactgagtgtgtacagcaccctgctagggtcctctgtaactggacctacagatggttgtgagcctccatgtgggtgctggggagttgaaccccaggtccctgtcactactcaaccactcagtcatctctccacaccctaacaactctaatcttaaaaatgaaaagttggccgggcacagtgactctagaatcttggcgttcgggtgaaatgtggacgctaagccagaaggcacctaaggctgggggttagcccacatggannnnnnnnnnnnnnnnnnnntgagggaagcttgtatgtaccccaagagtcccatggttctggattaccaggtaaaaaaggtatagagagcccctcaaaagtcagaccccccccccatgctcttttgagcattcaagcaaagactgcttgcttgtttttgatactgtgtgtgcaagagatagaggccgaagagtgaattcattctgtggacaagcaggggctataaatgaggctccattttggacatgtatgctcccagatcttcgtggtcttgtagtttgtgtgagcgagttaggtccagatatatgtaacctaaagctctccactttaacctttgtatggtttttttgagacagggtctctctgggtagccttgtctgttctggaacttgctatgtagcccaggctagccttgttagtactattgcgtcagtgtcataagtgccaggcttataaggcaagagccaccatggctatgttcacattgctgtccagcaatctcgggatcttccgccttccctaattgatagcctattaccaagtaaccagcttttgctgtattattttatcttaaggcattttattttgtgtattttcataatgcaaaataagggacttttttatttttttaaaggcaaggtctcagatcttgttgcatagtctgaatggcctggaaattgctctgtataccaggtttagttaatctgcctgcctctgtctctggatgcactaccccatacacatacacagtgctgggatttaaggtgtgagtgctactaaagagtcactccaccccaccccacccttttttttttttaaacctatgagtgaacgtgatagtggagattgaaacagaacctctagaattccaattaagccctccacccctaaggtgtctccccagctgggggcatttcttcacggcagggaataacatgacgctttgtgagaaggctatttgtccaccctggattgggtggtctaatgctgggctctctgacctaaacacccccagactcattggcacggtgcggacagaccgcaggccacacgtaaccaaaccgtttaactcgggcaccatctgtggtttttgggggggggggggacagaaggcacattccgaaacagctgacactcctactggatgaatggatcagcaagttttttggggactgcaacttttcctgcccagctgccggccttttccttctccaaactggagcttcggagcctggggggaggggcggccctaaaaggctcctccccgggcgggcgcttgggggcagggcagtgcattcctttctttaaggaacctgaccagactttaaggtcagggcctagagtagagcggacttcgggagttacctcttccctgtagagtcctcttattcccccctccccctcccccatacttaatgatcttcccattacagaacccagaccaggaagtgtatgacaggtcgcagctgcagacacatggctgggaggcctgggctccctgccagtagtgggagggtccaagctaccgccctagcaacaggaccaccaccctctctcctccccgccccaccccccttcctggcccacaacttagcagagcaggccttaggcttttctctatcattcggtggccaattgtagtttccgattcgaattgaggaagtgactttgggtgatgggggctatgacaagactcacctgcttacagcttacggcgctaggctcttccaagaagtctgcagcgactttaacccaaaattgaagccacctagtacaatcacagaagcttcataatgtgtgtgtgtgtgtgtgtgtgtgtgtgtgtgtgtgtgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccccactatggggatggatcttctgactttaagttgctcaggaaatgtcagtggaccctaaactgccctaggaggcagttgtcacacagttttcttctgctgccagctgtgtggttggcctccttccccgaatctgccatggctgcattcttctggtgccaagtgagacatggtgactccaactcctgggagccctgagcacagacagcccttcctggagctgcagggcatcctctttttgggttctttctggccagtaaactaggaggaagaggagcaatggattaaagacccagttggggagaagggtacaggaagagatttgggtttttttttcgtgcttggtccaggtttttaccagcagagccagaacctttgctggagaagaaggggggatttgattcctttcttaatcatgtaattacaatccttccagctggaccgggctacggtgggagtcgggggggggggcaccagggcctgggcaccataacgccagtgggaaaactacaggcatgaagtttgtgtcccgactgaacacagtcctggtgcacacctttgttgaaaggtttgtaaggacgaaacaaaactcccaagtaagggtttcccttgttacctccttgagcccagctggggaggtgggggtgtcatgtggtggacgcaaggaccctagctagctgcggctttggcagctccgtactaaattacagtgatgaggtggggcgcacaaaagactgaaatctttttttttttttaataaaaacaaaacaaaacttcagccccaagcccctgggctcctgaatggccgtggcttcctgtcaggattagctcggctgcctgggcatgtgtgtgctgcctttctcctcaggaaatacctttagtaagcccgggtggagtccccatggcaacgagagaggggacctgctgacagaggccattcagctctcgttgttccctggcctctttgttgtgtgcttcatcacggcccctgtggcaagcactgcgctttgcaccattttgtcagcccaatgtggagttttacattttaatgggctgttctggcaacggcccatttgcatgcaaaatgttccttcttgctcctctccctttttcctatttaaaaaaaaaaaaaaaaacctgtccaaacccccgtcaggtccccaaatgctgctgaccaggagaaaggcccctggtaattgactggtgcttcggttttcgttaccacaacacacctttgctcccccagttttgcagccctccttgtattgaggagatctctgtgtccccttctcggtgccgggtccctcggagagtgatgattatcacctgggatcttactgtgatcgcttgttctgtcttggtcttgctagatgaaagttaagttttcggttccatttcaaagtcagaataaggtaataaaaacctctgctgagggcccctggagcccccgccgtgttccttcttagtttctttcaatgccaccccaaattcctcccacatccacaattgctccccacttatcactgggagcttgtgccaagactgtaaacattcccagaccaccatctccctcctgttgctgagacgaccccctctcccttcattttctttaaccccaaaaaaaatcccaaccacaggcatttcacggggcgggggggggggggggagctgaccctgagaccactcgaagcacccctgtctggatttagcgaagggagtctttgggtacctaagatgtctttatcgttcctgacctttgaggggtgctacactagtgtagactgttctgtcaggaaaacagggctaaatgtacagatgaagctttcgagtctcggggtgagagtacatctaaaaatgggatgaaggccacacttggtgatacacacctgagatttcaactcaaaaggctgaggcaggaggatcttgactctggatcaccccgtgctacatggcggtgggggatgggctgtccctaaaccgaaccaacaaaaaaggggctagttaccaagtttggtggcacacacctttaataccagcatttgggaggcagaggcaggtgaatctctgttagtttgaagccagcctggtttcaagccatgaaaccatgcatgagtttcaagccagctaggatatatataatgagaccctttctcagaccaaaaaatcccagcagccactgccggggctcagttgagagagtgcttgcctggattcttcgaagccttgtgttccatcctcagcgccacatgatgtggtgtggtcataaacacctgtggtgccagcatccctcttgggtgttcactgatagcttggtagtccctgcctcacagggaaagaaggagggagcaaggaatgtcgcttttctactgtaagcttcagaagtaatttgatctatttgtgttgttgttgttgttgttagaaaaagtcatttaagagatgcaaagtctctaaagtggcaaaaagcttcatgtgagggataatgaagaaatgggtggggggtgggggtgggggacgggatcactgaggcaggggagaggagacagctaaaagactggattttgtttttcaagacagggtttctctgtgtagctctggctatcctggaactcgctctgtagatgaggctggcctcaaactcacagagctctgcctgcatctgcctcctgagtgctggggctgatgtgcgccaccgctacccacagctctggatccttgaggagggaataagctggggctggggaatctcagagtgtgagggagacggcagacagcgtgtcatctctgctgttgagccggacttctctcaggacctctgatctatggatctcggccaaggagaagattgtccgggccccattgactaatgtggatggcgctagaggttatcagctgtaagctgtaaatgacgggtaagaagacagctctcagctgtcctgactgctaagagctgagctgcagggatggaggtgggtgtggtgggaggatagcagggagggctgtgaggacagtgctgtgtctgcaagccatccatgggtcatccctaactgtttagaacacgcttcgggtgagaagcagcggggaggagcccaggacacagctagagccttcttgttttgtgactttgcaggaagtctcacaacctctcttaaatgggaggcaaagacaaggagctcgagcacaaatgaccacgttttgtaagtgtcacatgcagtgccaatgattagttaggggcatgccactgaggagggtacacccaattcccaaacctgctcaattggagaagttccttcaagttaaaaacactggttttgggctggcgagatggctcagtggttaagagcaccgactgctcttccaaaggtcctgagttcaaatcccagcaaccacatggtggctcacaaccatccgtaacgaaatctgatgcccttttatggagtatctgaggacagctacagtgtacttacatataataaataaattaaaaaaaaaaaacactggttttttggttttgctttgtttgcttgtattgagacagggtttcactatatagccctggctgcccttgaactcacggagatctccccgactctgcctccagagtgctgggattcaagttgtgtgcctctacacatagcaaggtaaatgaattcttcaggtattgttgagattaagctgtgaggttgggggtgggatgggcaggataagcccagagcagccagttttagaatcccatgcaagaagatgggaggcaactgggctctattagatgagattaaagggttgaaccaaaagcgctttgcagatctcggggagaaaaaaaaaaaatcaatgactttaaagacatggtgaagctaagttgtgcacacacagtagctcatttatcccagcactccagaggcaggaggcttgtcactatgagcttcataataaatggaagaccagcctaggccattctgtcttgatgggcaggggtgggggtgagggagcaaaacaaaagacacagtgatgtaaatgaaagggtgaaagagtgagctgtgcccgggcttgtgttctgaagagccatggcactcaggtttggctcccacctctttgtaacgcttactacacaggtggattgccctgtaccttgtatccctccggctgcctccatttcccccgcctctgaaataagggtactgatgggaccctattttatcagccgtggggatccaattaggtaacacaagacgagctgtacatggcgcaagccccgcagccacaggatagtgagaacacgatgaactaactcacagcctggagaaaccctcggcctgctgtgtgtgggtatctggtttgcatggttgtgaatgggaagctggggggcgggggggggggggcagtgaatggtaaagtgctgtgtagtactgctgcctcttctctttgaagtcacaggaaaatgtgggggttgggcatgctctgtcctcagtccatgttttatagaagcagggctggggtatgttttaataaatttaataagtttttaaaattgcatttattttatattagtggtgtgtgtgtgcgcgtgcgtgtgcacacacatacactcgagcacacgtgcacgtgttcagggacatgtgtatatgccatagtgcacatgtggtggtcagaggatagtttgtaagagtcagttctctctaccactctctaccacgggagtcctggaggcagaactcaagtcaggcttttcaggaagttttcttgccaagtgagccatcttacaaccccaggaagtgatcttataccatacggtgctgttccagctctgctgattcctgtgtcacgagtgggctgcattggcggtctccacagacaggtgtgcccccgaggatttctttaatggctgtctcctattgactgctgtacaagcggaagcataataagatttatatggatttgggcctccaggctccgctctcccgctgatacagggctcatgtcagagaccagatttcgagtggggagatggatctgatcgacatcctcagaccagaattaacctgctaaaccactggatcacttccggcctgctctggtgtaagcaaaatgcggcccctcttggcttgttgagaagttatcccaatagctgaagtatttgggggtacaaataggaaaggggacaaaaaggtttcattcacatttatcatgttctttaacataaaagtactatgaaaaagatctccttccctgccctttatggctgatttcttgaagaggataaggttgacatgtagttttccctccttctagagcagtggttacttcgtgactgtaattttgctactgttattatagctgcatgctttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtgtatatatatatatatatatatatatatataatctttttaaagatttattttacgtatatgagtgctcttctacatgtactcctgtatgccagaagagggcatcatattccattatagatggttatggatgggaattgaactcaggacctctggaagagcaaccagtgctcttaaccactgagccatctctccagccccaaagatttatttatttttgtttttatgtgtatgggtattctgcctgcatctatgtcagtgcatcacatgtatacctggcattcaaagaggccagaagagggcattggatatcctgggactggcattagagatggttatgagctgccatgtgggtgctaggaaccaaacctgggtcctctagaagagcagccagtgcccttaacctctgagccatccctccagcccacttaaaatgtttttcagtcagcttggagggatgcacttttaatctcaatacaagggaagcagagacaggcagatctcttgtaaattggaagccagctacctagtgagttccaggccagataggactacatagtgaggtcctgtccaaaaaaccaacccagcagttttagaagacattgatgtttgtttagtgtgtgtgtgtagtgaggccggggggagctcattctctcccaccacatggttctaaggcttggcagcaagggccttgcccctgcaccattgatctgactggttagctctgtgctttagttcaacaagttcctatcctatcctacctatcctgtgctaccccatgctatcccatgctatctcatgctactccttgctatcccatgctaccccatgctatcccatgctaccccatgctatcctatccagtcttctatcaagactggaatgtggatttcagcattggccgagtatgacccccttttgcatccttcacaaccagtttaatgaaagtagcagttagctgttctctcatcggctgataaacctgccacactgtagctccaggccattggtcttgactgagaaagtcaagctcagaagaggctatgaatgacaagtacgtcttgtcaaaggaatatgtgagtaagttccacacaattcttaaccaaggcagtgagttgctagtgagcgttacctagtaacagggtcaatgtcaggaccactctaacatacaggtaatagtccaacttgttacctttccatgccttccacaacaaagtagctttctttatagctgctttgtaaatggggaacccatatatctaaggcctctgctatcaatgaagaaagccactaatactttaccgccccttggctgattaatgagtcctctaaaagacccatttctgtgttcctggtgttaattgtaagagtcagttctggtctgggttgctttctaggtcttaggagaagcaaggtatgggtacttgtcatcactgagggacagtgctccctgatgttgtcatcactgagggacagtactccctgatgttgtcatcactgagagacagtactccctgatgtcatcactgagggacagcactccctgatgtcatcactgagggacagtgctccctgatgttgtcatcactgagggacagtactccctgatgccatcactgagggacagtgctccctggtgttgtcatcactgagggacagtactccctggtgttgtcatcactgagggacagtactccctgatgccctctggttactggctatgcacccaaacactgttcagccattaaaaagaaagaagtgtggagaacaactctgacatagaagggccttgcttcttcttgacacggtcacaaaataccatacagagtgtgatcccattgactgaaatacatggaacagtgatagctagtatgtggtaagggtgctgggtgtagcggcaggcacctataatcccaggacctagaaagcagaggcaggcagtctctgggagttcaaggtgcaggcttgtctagaatgaattctaggatatccagggctattgagaaaccgtgtgtgtgtgtgtgtgtgtgtgtgtgtgtgtgtgtgtgtctgacgtctgtccgtctgtctgtttgtctatctatagggtgtgtaggggatgaggattcagttctatgactatggatttttttgaggcagggaggtaaaatagtctgaaattagattttttggaatggttttctaactcggaatatacagctattctcccatgtctgtgggatcaatcaaccacagatggagaatctatgggcagaattttttttttttgtctgtcctgaatatggatggcaaccactatgtagactggtatgtctgctgctgggatttttctggcctgtagactctaactgattgaggcaggagaactcgggaggttatgactggtgtcatcagaagtccgttttctgtgcagggggatggtgcagttgtgcaggggcatagccaggtttgggtggagtaggaagacagggttgtcaggagcctttggaggccaagagggatttgggccaagcaatggttgcacctgcctttaatcccagcaggtcagcctagtcttcagagtgagttcccagacatcctgggttagacagagaaaccctgcctcaaaaaattaaaggggggaaagggggggaaaaaaaagaaagagggacttgggtcttactttatatctagggtaagattttttgatgaagacagcgactatgtaaactagagggtgggtcttggagtagtgctgtcccaggatagctgcagcagtgggggttggggggggggggggagagaaacaatgtagaaacaaggatgctggtacccgaggctttcttagctcagagatgagtttctttcccacattggtcagcaccagctagaagttacgaccatgggaaagggcaggctgctggctccttcccttgggagcagtgccggtccgttctcttcgctgagttctttgggagctactgttttgtctctgtgacctgtgtgagtagactgcgcgatgcctgactctgagaatttgacttcgctgttgttgaccagtggctagtggctggtggggatcgagagcagcaaaatatttaatcagtgagatcacttgaggggaaatgaaatcggatcaataggcggaagggacgcttgctgttttccttcagggtcaaatccaggctgtttttctccttttggcgaaaccataaaccactaagaatggaaggaatagtccgcagcagctatttttaatcagccgtgcgttctgttcccctctggtgctctccttgaccagaacacaaaaataaacatgtattagcttactggtattcagatgctaacttgagatggcactgtgtttagaagagagagcccttaggttgataaactgcagtgtgagctccttggaagaaaagccatggtcaacccccatggacctaaggcttctagtgcaaaaccaatggaccacttcagagagaggctcattaaaatgagaagttagaggctagagtggtagctcctaagaggatcagagtagggagggtcccagtctggttcctactccccatgtcacgtggctcacaactgtgtgtaacacctgctttagttgatgggacactgctcgcctccatagggacccacaccccacatgcacacgcccacagacagacacaagcagatacacacagtcaaaaataagaccaatctaaaagagagaggagccacaaggcgctcagtggcccagccttttcccagccctggcttccaccccaagcactgctaaagaagggatgggggtgtcagatgctgtggggccatctgtgctatacagtgagttcaaggcactctgggctatgtagtaagactttgtctcagaaaaacaaaagtcccggtgtaagtaaaggttggttacataccttgaaccccagcatggaggatgaagaagctggtggacctctgtgagttctgggctagccagggctgcaaagtgagaccctgacacaagaaggaggccagatggtggttagacctgagatccctgccagttctaggactagatggtaaactcctagagagaagcaaagggtggagtcagagcaggattgggggagctgcttcagagtttcaggcacacgtgacttccggcacctagaacattcttcagaggaggaggccaggccagccattcatttaaatgtgcagaaaaaaacccagaaagttctttgcttcctccttagcaaagggattaatttatttggtcagtatggctgactactggtagtgccaagaatatgggtctttctgatcacatgactaaagcagctcatccacaggaggggtgggtgcaggggctggccagatggcttagcgggtaagagcactgactgctctaccggaaggtccctagttcaaatcccagcaaccacatggtggctcacaaccacccatgatgagatctgacgccctcttctggtgcgtctgaagacagctacagtgtatttacatataataataaataaatctttgggccagagtgagcagggactgagcgactggagttgaccagagtaagcagaggtcctaaattcaatgctcaacaaccacatgaaggctcacaaccatttgtacagctacagtgtactctcatatacataaaatgaataaataaataaatcttttttaaaaatttatttaaaaaaaaggcaggatgggtgctttccatagttggatgttggggggggggtaggtcttgttctggttgagatacagaaggggatgtgtaagggtgtgtgtaccttagccacttttctgtctctgtgaagagacaccaggactaaggcaaattaaagaaagcacttaattgggggcttgcttacagtttcagaggggtgagtccgcgaccatcctggtggcaaccatggcagcacacgggcaggcaaggcactggaactgcagctgagagcttacctgctgtctacaagttagagggaaggaaaaaagagagatagacagacagacagacttggtctggcatggacttttgaaaccttactcatagcaataacacctcccccaacaaagacacctcctctcactctgtcccagaacagttctgccaacccaggatcaaacatccaaaagccattctcagtcacaccacccacagtgcgacactgtgtctcaaggagaaagatggggtgcaggagagggtgagcccaggcaagcgatggatgaggagggctttatgtgtgccatgtctgttgccagagcaaatgtgccgtggtggcagctgcaggccttgggcctaacacctgttagctggaggctcccctgagctgacctcttccttggctgtccttcccacaaacgcatctgtgttgctggagggccaggcccccacccacgctgagtcatgtgtaccaagagcccctgttgaccaaatgcctgctctcatcttgggcattggggttgctgggttcgtgaggggttggttggcttgattcgctagggagaggggtgaggccgactggggtgtgttctggtgggaagtggcaaagaactgagcagcatatggggaagggggcattctagagacggggagacccttccccttagaacagtggaagttgaaacactgcttaatgctgctgctgcggctgcttcctaactttgcctctttcttctttgactcatggagaagcggggtggagaagagctggggacctcggtttgcccatcatttccgactgatacacgttccggtccccagctctcttgccttagctaaggcctggacagtgcagtgacctacgactcggctcgccctatggctcacctaactccctttctcctcctcctttctccacttggctcttcctcctggcccttgtgggtggctgctgcagctcagccctggggagtccctgtggaagtggagtctctcctggtccaccctggcgacctgctacagcttcgctgtcggcttcgcgatgatgtgcagagcatcaactggctgcgggatggggtgcagctggtggagagcaaccgtacccgcatcacaggggaggaggtggaggtgcgggactccatccccgctgactctggcctctacgcttgcgtgaccagcagcccctctggcagcgataccacctacttctccgtcaatgtctcaggttggtagcaatgccctctgccctatcccactcctccaactttgctagtttgaaagggaggcgggcttcccctccatgatcccgcccctactctgcttcagaactgccgcccactaacattgctccctgcccgctgcgtggcttggcgctctcgggttgaccgggtagggcagacgccaagctaagacctacctcagaggtgattatgaatgctcgggggtgttaagaccctgtcatttctccagcacagcagtccagagcacgctaagtggggctcgccagcttcatcttgtcaaggcctaggcttagtgattgggacctgagaacatatagtaaagttcctgctgtggttggaaggactcagtacggtttgctgccgagttcgggctttgtggggaaaacctgttgcctagcaaccagggagcgagcctagaactctccttgctgggaatatgcttcctgtagaatgtcagtttcccaaaaccagcgtctgaggaagaggcaggaacttttccttgtgccatgatgggggcttggtacctcattccagtcaccatttagaacttgtccccagataagaaacatgtttctctagttcccaagagtggcagtctctccactagagagacctctagtagatatcaagacttttttaaaaaaaaaatagggtgcatcccacctgggctggtgagatggctcagcggttgagagcactgactgctctttcagaggtcctgagttcaaatcccagcaaccacatggtggctcacaaccatctgtaatgagatcagatgccctcttctggtgtatctgaagtcagctacagtgtacttatgtataataataaataaatcttttttaaaaaatgaggtgcatcccattttcagagtgaagtatctctctacacagccctggctatcctgcaactcactgtgtagaccaggctggtttcagagtctccaagatctgcctgcttctccctcccgggtgctgggattaaagaagctactgaacatagcctgtatttacacaaagtgcatcccatttggggagtgaggctagctatagccggcatagtagtgtacacctttagtccctgcactctacaggatgtatgtttttgagttttgtttttgaagccagccttgtctacatctctacatcatgagacaccctgtcttaaaacatccaccaaaaaggcagctctggggcaggagagattgcccagctgttaagagagcctgacactcttgtagagtggaattggttgccagcattcacatagcttgtttacagttgcctgtaacttcaggtcctggggatctggcaccccgttctggcccacccgccttgggctcctgcatacacatgggacatactcacacaggctcatatagatacatataagttttaaaaacaataagacatctttgggggaaagagagagagagagaaaggaaagcaggcagctccagccctcaggaaactcattccagaagattctgattgcaggctggtcagccggaggctttagaagtagcctcaaggcccaggtgtctagatctgcctgggtttctcaaaggctgatgtccagagaatactgattcctcagctgctgttatggatacccaagtggtactgttagctgagtggccttggtgtataggctggaattaaataaatttgggggaaaaaaaggagctggccctgatagagccatctgaacttttaggcagaaggcagtgcgctggggccgggatgagcactggagcacacagctcttaaacacaaactgtcactgaggcaaaattcaggaaaattgggagtccttatgggacggctgttgcgttatccatgtcaccgcgttgaccgcagtgaggtggtctgtctagacagggcgaatgctgtttggatggaggtctagacgctcctcagtccccctccttcctctcacagatgcactcccatcctcggaagatgatgacgacgacgatgactcctcctcggaggagaaagagacggacaacaccaaaccaaaccgtaggcgtgagacactgttttctatcttactgccttcgagactgggagctgggacttagaggaaggcctggctaaagtgggaggagagaggctcagagggcctgggggccatggtgcctggttgctgcctctctagaagacctagggtacttactgaacaggtagacgggaggcatggggtcctgcctgggccctggcttctgagcctggccgcccctgctgccctcattcgtctcctttggcttttcctgtacagctgtagctccctactggacatccccagagaaaatggagaagaaactgcatgcggtgcccgctgccaagacggtgaagttcaagtgcccgtcgagtgggacacccaaccccactctgcgctggttgaaaaatggcaaagagtttaagcctgaccaccgaattggaggctacaaggtacgcgtgtgtacataccaaagaaaagttagagtaaggcgctagagcggggactgggatagcaagtctctattatctgctatgattactttgggttttgttgttgttttggttgcctttgtaaaggtgagattttgttgttgttgttttagtttaaagtttattttataatggtttcacgtgtatgtatgtgtgtgtgtatgtatgtgtgtgtgtgtgtatatatgtatgtatgtgccacatgtgtgcctaatgcctacagaggtctgaagagggtgtcagattcctgggaattgcagtgttttgatttttactactttagaatttttttatttgcgggaggatatgcatatgtggagatcagaggaaaactgggaggactcagttctccttcacctaggtgggtcctgaatatcgctctcaggtcagcaggcttggtcacaagtccctttctttaccagttgagtcaccttacaggccaccattcaccctcccctccctccctcttctcttcctttctctctctccctccctccctttggtttttgagacagggtctcactctctccttagctctgcctggcctagaactcactatgcagaccaggctgccctcaggctcacagagatccacctgcctctgcaatccgggccctaggataaaagaggggcgtgtgccaccacgactggtcctcttgtgcacttttaaaggacctttctcaggaccgattcctggaagtggaattgtcagatccgacggggtagatctgttttaagctcttagtgcccataatccatttccctctctcccatgcctttccccagtgcttccgcttccctgttgggtgttagaagcctgcactgttgagtttcatcttcagcccccaagtcctaaaaggaaaaaccagtcaccttccgtaacagaatattcgaatgacagactcactagacatttgccaagaagtacagctgggtgaacacgtttgtgttgctttttgataccattaggcacttcctatgctgataagctgcttcctctccctccggggggtcaagtcctttgtatttgtaggaagaacattttgatgagaatctcttccttagagatctgatgagtctccaaggtccccaaatatgtctcttttctcatacctttttaactttttttttactgtgttccttctctatgtgccccagactggcctgaacttccattgctgctcctgtcttagccttccatgtgctgagatcacagaagatgtgccaccatgcatgggctgttcattnnnnnnnnnnnnnnnnnnnntgccaccatgcatggctgttcattgctcctgtataagaaaagtgagaggggatggctggagaggcagcttagtgattaagcagatagcactctactctggtccagaggaccagagtctggtttccagcactcacctcgggcaactcaccaccacctataactccagcttcagggtttctgtggacacctacactcacatgtgcgcgcacacacacccacacacacccacacacacacacacacacacacacacacaatctttttctttctctattcattattaattatttgttctccccgctcccacccccaatcagggtttctctgtgtagctctggctggcctagaactagctctatagatccggctggcctggaattcagagatctgcctgtctctgcctcttgagtactgggattaaaagtgttcaccaccaccagttctttttctccttccttccttccttccttccttccttccttccttccttccttccttccttccttccttccttttttaaagaaagaatatggggaaagctttacctggccttacttaccaagtccttttgtttgcaagttaggattttgtaaccacatctgaaggcgactgtcaaagggcagctgtggtaagcagcctgcagggggagctcctccatgcaagagcacgggaaggaggaggacgggtctgaccagagtcaactagaagcaacgggggtttctgtgtgatatttatgtgcattcattttgtgtgcacatgcgcaagcaatggcgtgcacatggaggtcagatgacaactttcaggaactgcttgtctcctcccaccacgtggggcacgtgcctttatccacggagccatcttgccaaccctgaggagatagcttgtgaaacttgccgcgtcaggcataggtgtgaaattcacgagcacggagaggattcccagcttaggagaattggccaaaggcgcgttggtccagctccccgctgctcctgaacgctgctgtgaagatggccagcgtcttcatggaccttgtcagttttagtttgcaggaaggattctgagtgtgactagaccaggatctagtcctgtgctttgtgtggctaacagtgcagcactggccgtatgtgcggctctcgtctgccctccccctgcccccaggtcctcagcaaagccccttgtctgtgccccacaggttcgctatgccacctggagcatcataatggattctgtggtgccttctgacaagggcaactacacctgcatcgtggagaatgagtatgggagcatcaaccacacctaccagcttgacgtcgtgggtaagaaggctaagtgggcaagaggcaggcagaggcaagggtggggcaggaaagggcagcggaggaggctgaggtcctaggatgggctctggacatttggtactaaacgtcccgctttgaactttactttctgtcccccctcccccttcttccttctttccagtttgagatatggtctcagactttagcccagacagctgtggaactcactgtataactcagcctgactctgaactcatggccatcctcctgctccaacctctcaagtgctaagattaaaggcttgggcctaccttaagccttacttttttcttcctccctccctcctttcctttcttacttcccttccttcctctttctctctctctctctccccccctctgtccttccttccttccttccttccttccttccttccttccttccttccttcctctcacaggtttgccttaagcctcacttttctccctcccttccttccatttatttatttttgagacaaagtatctctatgtatccctggctacctggaatttactatgtagatcagtcttcccttgaactcactggagatctgcctgagtgctggaattaaaggcatgcacaactgttcctggctcacttaaaaaaaaatcattcattaagcaacagctactttacactacatgtctaggaagacacagcttgatatagcaaggagaaatgcagcccaacagtagctgttgcttaaagaacaccactaacgccgggcatggtggcgcaagtccgtgccccctgaactttgacctttgtgtctttgcagcacaggtaccattagagtatctgtataagccaagtgcacattctggggtgcagaggccaagtgccttgaaatgtagaatcgccattctgtccacttggtgtagtatcctggaagacaggggaacaccatgttgctcatctcagggctctgattggaaaggttctgggtcttctgctccagagacggtgtggtccagcacctcacagtgaatacctgccttggcattgatgtagcccaggcagaagattctgatctcagagatctgggaagggtctaagatgctggaatctggggtcgtgtctctatttagacaagagacttggttgtgtccagaaatgtgagtgcaggactagaagaaatggtaccccttctctcaaatcaggttcaaagggcaggagtttagcagaagcagtgggaaggatactgtaggtcagtgtaggcctcaccactggccagtgaagagtctgacatgcctgtcctctctgtgcccccacagaacgatctccgcaccgacccatccttcaggcagggctgcctgccaacaagacagtggccctgggcagcaatgtggagttcatgtgtaaggtgtacagcgatccgcagcctcacattcagtggctgaagcacatcgaggtgaacgggagtaagatcgggccagacaacttgccgtatgtccagatcctgaaggtactcttaacctcctttcttggctagtttgctgggaaggtgaccaggtgtgccctggggctcagtgcctgggatttgagttcaactttacccataagtcacatactatctcctagtagggatctggccacaggctggtgacagcagggggctggggtggggtgaactgggaacagagggtggagtgggtgacgctggtggctggttcctgaagagctttgaagtggcccaggatcttgggtcagttgttcaaggaagacattgaaactcttgcttgctcgtggacccgggaccacaaccttccaacagcaaatgtttcccggtgtcttcctgcttgtttttcctaagttcacaatgcttttggagaatggaggcccacgataagggtgctgcttaaacagatggaaaagcaaatggcaccctataaatcctaagccgctccgggagtaatggcattctcttccttttccctctcgctcccagactcgagtgccccattaatccagggagctaactggccaagtctccagtgagtcttgcagcaggagtaaccagaagttagacctcatcctcccctgccttggctggcctagagatttactggctgtccctttctctctgccactggagctgaaaacgttctggaggagagggggccagctctagctttgggcctttttgaagctcgttcttcaattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccccttcctgttttactattttagctcttcatctctatccactctcattagcagttttgtttttatttttttgtcccactcagaagagaagactatgtaggtctcagcgtctcccttgccttgactcctcgggctggaagttaccgcccaggggcatagtgtggtcacatctcagtgtctgcccaactgactggtgtgtcgttggtttattccagcattcgggaattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggacgggaccctgtaccgggtacttgatttaggctccacactactggggcaggttgggaagtcagtaccaactctacctttctccttctgtgttcctaatgtgcccagagccatggaaaaatccctggcttgggaggctggtttggtttggtactatgttggttatctgtggctccctttgtgccttatgtatatatgtgtttctctctctctctcctcacccttttttcttctatgtgtgtgcgtttctgtgtataagtacttgtgcctgtctgcggacttgtgagatgttaggaatgatgtttctgactgaagtttttgatagtgacaaaaagaaggggccagatattctctctcagaccagtatctgcacgttgtgcgtgcatgtgtgcgttttcgggatgctctgggggctgcttttctttccttgctgtcccgtctgtacccactgattctctttacctaaaaccaaacagccccctacctgccaggcctcatttctccatgctgcccaccgcccgcatgcttggctgggccagtggctgccagcgtctggtgaagggtcgtaaccaagccgtcgtctcctcaggtctgccggagagcctcccctccagagcctcgctgttttcctctaacaggtctcgctggctggtggtgtggtttttttgccttgttgcaaaggagatgctggggagcgtttcttcttctggttttggtcccctcctctgtcccctccgtttctccgcctctcggaggtctcatgtcccgggcttgtccattttgcttccgtcgtctcttctagactgctggagttaataccaccgacaaggaaatggaggtgcttcatctacggaatgtctcctttgaggatgcgggggagtatacgtgcttggcgggtaactctatcggactctcccatcactctgcatggttgaccgttctggaaggtatacagtgcactggtcctttccgggtcctgccttttgccatgggagcagcgcatccgttacagggctggggagaggcagaaagggacggctcccgtctgctgcgtacccttttctgctctggctttgagggccatgcagggggagttcctgggttttcaggaagtgacgcgtcagcctccccttgcacatgtacatctggctttctccctggtcaatgtaatgcatgcgtgagccctgggtttaccttgcagcagggctttctagcacaggctccttccatccttgggtacagcatcttccctcatccatttggtacagaggctttgaatgatggggtcttctttagccagtcccacggaaagccatgggcctctcctccatgaatacatgccaataggagcttactacggcttccctggagtattgctggcccactcttcattctgctctgcactttgattgacgtgccaggatagcaaacctgaggcctgtcttagccattcaggacatctggaagtgcccattggtcctcttaggatatccctcctggcctgccctcccatgtgagaagatctgtgtcagtgtgctacccaggaaggaaggaccctgtggccttgccgggtggtgggctggtgaccacaggctcagtatggtcttacttgcatgtggcctgagagctgctctttctgtggccgctaagtgcataccttctctactcttcccttccaccttgcttgcccagcagtctcccacactgccgctagcaaagaagcatcctatctctaccatcgtctctgtctgtttagtcagtgctccctgtgagtcttcatttcctgacagttgatgggcggggcggggctgggaggggaggtggatgatggacagacaccaacagaatacttccctgtggtcatcagctctgttgtttccttgttgggctgggaggactcccaagggtatcacttcggctggctgaggttttaaagggaggactgttggaggaaggctgcatgcatgcaggacaaggaggttccagtaggcagacaatgtttcttacgctgaagggaaagatagactgactagcaagtggggatgagtgtgtgtcttagctgggatcactatggcagcagtgaaaccccgagatcagcttgggaaggaaagagtgccggctgcaacttggcttgctcagcctgcttgcttatagcacccagggcacctggatggcaccacccacaatgcactgggccctccccctatcaatcactaattaagaaaatgacctacaggcctgcctacagcctgctcttatggaggcattttctccagtgaggttccctcctcttggatgactttagcgtgtgtcaagttgacaaaaaactagccagcactgtatgaattctaaatagaggtaaaagaacatagaaaaatgattgcctggcccccatcccatttccttaccttttaagaatcctgtgggaccatgaatagatttcttttcttcttcttcttccttttttttttttttaagatttatttatttattatatataagtacactgtagctgttttcagacacaccagaagagggcatcagatctcattatgggtggttgtgagccaccatgtggttgctggtatttgaactcaggacctctggaagagcagtgagtgctcttaacagctgagccaactctccagccccatgaataggtttcttaaaaacatgttttttcacctagagacatatttagacactatatttactcagcctgtgttttagctatttactgacctgatctaacagaggtgacgggtgtttagtaatacatgagatgagcattcattagagtcccactctgtcatgtgctttgaggactatctggtctctagggcatagcagcctgtttccatatgatatgtgtgtgcaacatatatgcagggtctttggtgcccttccagtccagtgatcaactatgcaagttggctctggagttagtgagtgagtgttgggcttgttttgcaggatagtctaggttgtatgtaccctctatggggtttgagtttaaggatgtttaaggatacttcagaggtcccaaggtcctttgatgccaggatcccaggggagaggggcaggtgctgggtttctcatggggcacacctctcgtgagtgaagcttccccccagcccccatgacctgctgacacactgtccacactgacccagccctggaagagagaccagctgtgatgacctcaccgctctacctggagatcattatctactgcaccggggccttcctgatctcctgcatgttgggctctgtcatcatctataagatgaagagcggcaccaagaagagcgacttccatagccagatggctgtgcacaagctggccaagagcatccctctgcgcagacaggtaacagaaagtagatgggggatttgcaggctcaccactgtcttgccgcctcctcttcctgggcctctggggcccgctccctttcctaccctcctggttggctcctcatctcccactttggacttcgctccaacttctggaccagacacattggaatgttataaaccaactctggctctatgcctgtccaccctgtaccccagccacaaagacctccctctgtcacctgagacatggtgggaggaaacgggttggaaggtgcaggcgtgtgaaagattaatccttcctcagaagagggctgacccagaaaggtgcctttagggactaggaatccgtaaacccgaggtggagcgttttttgcagagtggtggggacaagaaaagagccgttagttctgttagaaaacaggaagctcaccgaggtctgtttggtgtgctcagtgatcaggtgagtaagatggaacccagaaagactttttgtttgtttgtcttttaattttttttaggacaaggtttctctgtgtagccctggttgtcctggaactgactttatagaccaggctggccttgaactcagagattgcctgcctcaaggccctgttgcttcaaagccctccattctccctcccagctatttcctgcatatgtggtggaaccaagctctaccagctgctaacagctgctaacaagctcattgggtacagttttaagctctaacatgcgcctgtagcgacattagacacagcacacattctacacagaattgtaatagttgttgctgctacttaatagtatggccctgcacttgtgnnnnnnnnnnnnnnnnnnnngaaggactttttttttttttttaaaaaaaaaaaacttttatttatttttaaagatttatttatttattttatgtatatgagtacactgcagctgtacagatagttgtgagcctttgtgtggttgttgggaattgaatttaggacctctgcttcctccggtcagccccacttgctctggtcagccccgctcattcaggcccaaagatttattttttattattatacataagtacactgtagctgtatttagacacactagaagagggtgtcagatctcattatgggtggttgtgagccaccatgtggttgctgggaattgaactcagtacctctggcagagcagtcagtgctcttacccactgagccatcatcttgccagccctggaaggacgttttgatggtagaaattcctcagtcagagcttctgcccttatggggttggttggttggtttgtttgtttgtttttttttttttccgccacactgttaggtatggaaataagtctgtccagtggttaaaaaaccaagctgggggtttgggaggagttggctaccacttcaccctctccttgctagaagggtgaccccactcttccttacaggtgtcagctgactccagtgcatccatgaactctggggttctcctggttcggccctcacggctctcctccagcgggacccccatgctggctggagtctccgaatatgagctccctgaggatccccgctgggagctgccacgagacaggtaatattgctgtagttttccattgcggatcccagtttcgagaaatattaaaatgaaccgccaagttcctgcgccagcaactcttcgcccccacctccgctgcctccatagctaagctccatgtagcgtccgatcgcagtcttcccttcccagctctggttcactgcctcagtgcctgccacccgtgccctctcagccataatcccgctgtggtcggtggtcccatctttcagtaacccagtaaagcaaaactctagaattaacaaggcagatttatatatcaataaattttcagttcacaagatgcccacacaatcatttcagaaccaactggtaagtgatacaagctgcccacctagatcagacaagttatcccaattattctgtccctatatgatatttataactacctgttgctatttgaaaccacgcgggatcaggatcttcttcctgtctgcccgcctccatcttggcttctcctccccctcttctgagtggctctctgtctctgcaactcttcgctctgccccccttttttctgtccagcaggcttcctgctgcactaatattttaatgtaattgggcagagaaaatcctgccacagtcaccctacaccgcccccccaggcttttgttctggccgttctgtaattttccaccgcagacccctcttgcaagaaatattaaaatgaactgccaagttcccatgttgttgtgtatgctaaggccttctaggcagtgaaagtacatgagatgtctttagaaatagcttcgctatttcctgctcttggctgagtggtgtaccaggagaaacagggttgagctgtcctataaaagcttgctctggggggctggagagatggctcagcaggttaagagcactgactgctcttcccaagaggtcctgagttcaattcccagcaaccacatggtggctcacaaccgatgccctcccctggtgcatctgaagacagctatagtgtacttatatacataaaaaaaaatattaaaaaaaaaaaatcttccgggtgatggtaccacacacctttgatcccagcactcaggaggcagaagcaggcatgtctgtctaccctgcattcaggagcagaggcagaggtaggcagatcagatctcttaagttcaaggccagtctgatctacagagcaagttccgggacagccagggctacccagagtaaccctgtcttaataaatggagtttggggatgttgatctttaccagccctgactgtcatcgcacgtttgtcctgtcctaactgtcactcactgtttatcccccactcaagactggtcttaggcaaaccacttggcgagggctgcttcgggcaggtggtgttggctgaggccatcgggctggataaggacaaacccaaccgtgtgaccaaagtggccgtgaagatgttgaagtgtgagtggaactcctgtgtcctgtagagtcgtctctttcctttctaagcaaagtggggtctgggcctagtcgaaaacatcctatgatgcagtcacggctcacactgtcactaccggagccgaggaggatgtagcaatatacgtgtttaaatctcaccttgcttcttaatgttgtcctgggcccaggtggtcctcttagtcccacaaacgggctgatttttcttgcagtgtctccagctaccctcagtactacatggtagtagtggctcctgggagggaagtgggaggaaagaagggagtcctggagaaaagggggctcctccgggatccgcttcccccaccccacctcacctcaccccgctctctggtttgcatgggaagccgacgcaacggagaaggacctgtcggatctgatctcggagatggagatgatgaaaatgattgggaagcacaagaatatcatcaaccttctgggagcgtgcacacaggatggtaggcggctcctggggcagctctggcctctgggcatcggctgagaaactgccttgccaggggggttgatgcgttgctcaggagctgggccagcctgattggcattcatttaaggttacttaccaacacccagattcacagtgtgaaagggacagtaatgttaatagagtctacattagggcacctaccctcagcttcgcttgggaactttctggcctatactgggagggagtcttcttttggatacttcgggaagaatggttttacctgttcccttctggaggcggcagggaaacatttacaccgggcatgggagacagtggactatggcatcaggaggaggggcctccattaggcgcagctcccctccctgacctattgcctgacctgtggtgtctctctctctctctctctctctctctctctctctctctctctctctctctctnnnnnnnnnnnnnnnnnnnnnnnnnnnnnnnnnnnnnnnnnnnnnnnnnnnnnnnnnnnnnnnnnnnnnnnnnnnnnnnnnnnnnnnnncttccaaagatctggtatcctgtgcctatcaggtggctcggggcatggagtatcttgcctctaagaaggtgtggagactgaatgcatccttccccgcaagaggcagggtgggactttatccagttagcactccaacttgtggctatatcgtccacaccggccttgattcatggtccttctgcctcagtctctctggtgctgggatgttaacacgggctactatatctgtccccagcttacacctgttaatctttagagctgtgggtgcatggagcttggccccttgtgttgtgttaggttttcagagttaggagagccttgtggtcttgggatcagattgaattaggtttgagtctatgtaaccattttctgcgtagactcgggcagataggcctgaaatttataattattctgctttggtctctcaagggctgggattatagattataggcatgtgccactgaacccagccttgtatttcttttttcttttttttttttttttttggttttttgagacagggtttctctgtagccctggctgtcctggaactcactctgtggaccaggctggcctcgaactcagaaattcgcctgcctctgcctcccaagtactgggattaaaggcgtgcaccaccacgcctggctcagccttgtatttctttttcttcaattttaattttaattttttaaaagatgcatttatttgctcagtggcggtggtgcagcctttaatcctagcactcaaggggcagaggccaatctcttcagtttgaggccaagctggtctacagagcaaattctaggacagtcaaaactaacagagaaaccttgtctcgaaaagctgaaaaaaatatttattgatgtattttatgtatataagtgctctactttcatgtacatctacatgacgagaggcctcagatcctgttatagatggttgtgagccaccacatgggtgccgggaattgaactcaggacctctggaagagcctccagaccactctcttctctccagcccccatatttcttcagatacaaaataagagtacttatttctacatagtagaattattgtgacgataaaattaactatgtctgtgaaaattctgagcacggcttcagtgcttgagcaggcgtgcccggccagggagggcgacgctcaacccacacacctcacagacctatcatgggcccaggtggtctgctttggaggtacgaatctaaaagctagaggttaggatcaagaaaaaaaggcataaaggcaggcttgttacagtgactgagaaggctacagttggaggtgtctggaattaaagaatatttgggaggggtcgtcgagaggatctgggaaaatctagagggtatagaggtgtgaaggcagaagaccctcaaggtaacacggtcccgctgcccgctgtggcagtaagtactggagtagaggggactggatgggtaagtgacagttcagggctgtcatctcctctggtctccacctctctgcagtgtatacaccgagacctggctgctaggaacgtcctggtgaccgaggataacgtaatgaagatcgcagactttggcttagctcgagacattcatcatatcgactactacaagaaaaccaccaacgtaagtttcttgcttggcgcggcgtggggctccacaccactagactcgtgcccacttcgatcctgcttcgatgtctttgctgtattcgtgtggggttgagtggtctaacataaaagggcttgtaggatgggctgtggactcgtgtcccatgccctggctcccacctccttgtcaactcactgcctgcgccgtcatcttccgttcaccccgtgagtcctctgtgtcatcccgcctatacacatctgctgctgcttgcagggccggctgcctgtgaagtggatggcccctgaggcgttgtttgaccggatctacacacaccagagcgatgtgtgagtttgaaatacacagttgcctgggatatgcaggagaaagaattctaagggccctgcatgctaaactggtgggaatcttattccatcactggggcaggggtagcattgtcttgtcccatgaacagtgtgcttccggcttccttgcatagtatagtctcttgctgccctcttgtctcctgtgctctgcccccctgaacttaaggtccctgaagaggtgagaaaggttcaagatgcacacctactactcttaacttcttgaggacttgggaaggaactcctagggcagcctgactctgtgctaagccaccgtggaaccgtgttcccctgtaggtggtcttttggagtgctcttgtgggagatcttcactctgggtggctccccataccccggtgtgcctgtggaggaacttttcaagctgctgaaggagggtcatcgaatggacaagcccagtaactgtaccaatgagctgtaagcataggctagaggggaaggatggggggttagtagtcggcactgtttggatccaccactggcaagctgggttggatgttgggacagcttcctcaggtgatggtggcttattcgaggttcctgaggtctcaagcctggctctgaaggaagcaggagcatggtgggcaggggttgaaaggtctctttgggagaagtggcctccctgtccatccctccccaagccctctggtccagctctgccctggtccttcctctctctctaacctcaccatcctgcttcaggtacatgatgatgcgggactgctggcatgcagtgccctctcagagacctacgttcaagcagttggtggaagacctggaccgcattgtggccttgacctccaaccaggtagggctgtcccccggggttggaacttgggcctctgtcacataggctcctgggaaggtttgggtgccacccaccgatccctttctgtcacaggagtatctggacctgtccataccgctggaccagtactcacccagctttcccgacacacggagctccacctgctcctcaggggaggactctgtcttctctcatgagccgttacctgaggagccctgtctgcctcgacaccccacccagcttgccaacagtggactcaaacggcgctgactaccaaccctgtccccagttttctcccattccgtcgtcacccgtgcccctcacccacaatccccttgttggacacactgcctttctcctcctcctttgccgctggcaagagccagtgcctgactgaggccttcctgtgttgtggccttccccctccatcacccccaagacccctcttctccctcttcttagcctgctgtgtgagagaggagccaagaggcaggtgcttgccgacggccgcatcctccttcccaggtgttggaccaagacccgccccgctgcctggcactgcttggaggtgtgcagagcggaagcaagtggagcatccggggcattcctgttgacccatcagccccttctgttctggcggcaggggccttggggctcctggaagccgtgaggtttctgtttaggccttaaccgaaggcaacctctgctccagatggatggtaccagtagcttcttaattccaatactaatttgctttgctgaccaaatacctgcctggtaccagaagacagggaggcagagactgggagccgtgatgtgcccttgggctgagccctagacttggggctctgtacatagctatgaagaaaaacacaaagtgtataaatcttgagtatatatttacatgtctttttaaaaagggtcgttactagagatttacccatgggggagacgcccagggtagcatccgttgctatatattaaaaacaaacgaacagaaagaaaaaaaaaaggaaaatgttttttaaaaggtcatatatttttttgctacttttgctgttttatttttttaaattatgttttaaacctattttcagtttaggtttccctcaataaaaaattgctgctgcttcatttttatcctgggcgtgtgaaaagagagcaggtgtccagcgcagaggagggagacagggggtaaagggccatgagctggtcttccccctgccccccatgacctctgtctcctggattgtgccccagacctcccagccaagccttctatctcccgatgcattgggaacagcaggagaagactgaggtcctgagggcagagagccaagctcgcacacttgattgtttcctcggaggagagagtgagaggatgaggttagccagagggtagaactggacagaaacccaaaccctagaccctgtacattcagatgtcttgtctatcttccccaacctactcctcatattcctctcctgtaaatatcctccccttccctgttggtctctgttacccagttgggtctgtccctgagcttggcttcctatagtttttccttcacaaactccacccatccctcaggaaacagaaaacgatctctttggttggggtcaacttggcaactcaattctgccacctgctggttgctttggtaccttggtctcttattcaaacccacaccactcaagccttagagggtttgtttttgttttttgtttgtttgtttggttggttggttggtcttttttttctgggtctgctgaatacaaacctgttcagtatgatttcatctgtaggggttagggctgcttctttaaatgcagttttggcagctgtggtttgggtcattgtcataagagttcttatcgttgtttctctctgtacacatgtaactgtcaaaatattatgaatggtttttatgctgaaagaagacatcatttggcaaagagggctagggaatgaatttagcacaaactcattttcttggagaccgtgtatcatagtggtttttttttttttttctttctcttgttaaaactgaacattatttctgcctcaggtctacttgactcactgctgtgtggatggaaggagaacacagaaagggcttagtgtgactcaaggagaggagctaggaactggaaggaactgaagtcccctctgttactattcagattgcccgcagacggcccctgggacaggggtggctatcaaatagaaagtagtgacattgacatgaagggaaatgaaatggctatttcacttagaggaccagattaggtctcgtgggagggggaacccagcttacagaatgaagatgttactgtcagagcacagcatctgtctggtttcctgggggttaaaatatggcccaggcatcaatcaatactgcttccccatcttttctaattgccataggctaaaggccatcagtcccctggctctgttaatgtaatgtatcgatttcaggtaagtaagattgaacatagatgaagtaagaaatcggccttaatggtaatgaactctgtttatcaactgccactgggtggagccagcaagctaaaatatcctcctacacacagacagtgttaggttatactgtcagagccactgtcctctgaagtaacagacctacctgcaagcgggaacttttggcctggatatagcattgtcagactctggacatgaccaatatgtcttgtacagaattggacatggcacaagtgcagggccatactattaagtagcagcaacaactattacaattctgtgtagaatgtgtgctgtgtctaatgtcgctacaggcgcatgttagagcttaaaactgtacccaatgagcttgttagcagctgttagcagctggtagagcttggttccaccacatatgcaggaaatagctgggagggagaatggagggctttgaagcaacatggcatgtagaaaccaagaagggagtagaccagcaagaaccctgaagttggctggtcctggtagtgaatgcctgtaatcccagactcagaaggcagagaccggtagatcttgagttcagggacaacttggtctacatcgtgagttcagggcctgctgaagatgcacagtgagactcttgtctaaaaggaaattaaacgaaccagaacacactgaagttatgaaggactctggaactggttccctcttgtttgacacacagcagcattcagaatctttactgcctgctgggtacgtgcatgtcctggtgcacagaagcaatgcattcaattgccgtgctgtcggaggttccagtggtgtgctgaaactggctctctaaaggaaagtatgtgtgtcagcctggggttatggcctagtaacccaaattttgaaaacaaaaggtgatggtctttaatcctgaactcagggggcagaagccagtggatctcttaaattcaaggccagcctggtctatatattgagttctaggtcaaccaagattgcatggtgataccctgtctccaaaaaagtaaaatgggggatgggagtggggtgggtcggggcacaggtggagtcctcaatggccagactccatgacttaactacttccatttgctcattgagaaggccagaaggaatccacgtgcatcagggagatgagaggattaagccagttaagtagctaatccctttcccatattacacatctatagtatgcactaagtttaaaaacccaccacttccagacggaagttgtattgtgagataccttagattagagcaatggcagcttcccagagtggtgtatgaacacagcctacagaagtcagttgattagcacactgggtgggactggtcctccatgactagggagcattttgaggaggtacatgctctgggctggggtgtagtccagttgcttgaatgatgattaaggagttcattggctatgtggtagtggcacacacctataatcccagcactcctgagttcaaggcctgggaagtgggtggagatgtctgtgtcttgtttgtttcgagatagggtctcactgtgtagctctggctgtcctggaactcactctgtagaccagcctggactcccaactcacaaagagccaccggcctctccttccagagtgcttgaattaaaggtacgtgccaccacggtctggcatataagtgttttgtttatatatgtgtgtgtgtgtgtgtgcaccatgaatggtacctgtgaagttcagaagaggttgctggattctgtagaactggagttagaaattggtcgtggcgaccatgtgggtgctgggaaccagacactgaccctctgcaggatttagtggtcttctgacgggacagtccctccagcatcactatctgtttaacttctctaagaagttgtgctttcctgggaagcacgtccgtcctggtcctcgggcacggtactgttctactgaggagtccctctacaaaggccggccaggtgctcttaaaggtggtttggggagtctccatgttctggctaacaattccaagccacaggaggcagagagaggtatttaaggtgccaagctgactccattgtgaaatatatttcctcttaaaaggtccacatccaattgggcctggtaacataaagtctacataatcctagctacttgggagatgcggtgagggaggctgaaaattcaaggctagcctgggcaattccgatcttaccttgccatttacaaaagtgaaagaaagggcaggggaatacatacagctcaatgccagtgcttgcctagaaaccacagccccacccccacccctgctcagtcccctccccaagttcacacaaacaggaagccattcgaacacaacttggtgggagtgtctttatgcaacgtttagtaagatgacaaaattatacagtagagatggactgtaattaagcttctctaaatggcctgaacttggtgtcactgcttgcatctctgggatggtcacaaggcctccaacgacttaatggctgatcctttatctcaagccagacagtcttagctggaattcctttgtggacgccactgctgagcggagtgactgaagagagggagcgccaccttcaagggatccttaggctcctttggaatcagccttgctgttctgtgaggtctcctgggacttggcctggaggatctggatataaaacaacactttaggctttggtcacaaacagtttaaattctgcaagcatctactttgagcttcttaatcaaactaatggccacaagccaggctcagtgtgtgtgtgtgtgtgtgcacgtgtgtgtgtgcacgtgtgtgtgtgtgcatgtgtgtgtgtgcgtgcatgtgtgttgagcctgtaatccctgtcgaggctggtgaggaagtagaactggcctgagttccaggaaagcttgaactacattcagagtgaacgtgctccaccttccccaaaggaaagcaacgagacaggggccacagactcagacctgtacgactgctttggtaataaagatggagatacaaacaagcatggaatccctttctgagtgccagcccagccacaggatcacagatgagcctacggtggacctgtcacacacagttcatctgtccccagccacccacccccccccccagtgaccttcctactgtttgcttgtgctttctcacctcccccaaattacttggcccaaatgggagaagtgggcacagaaatgtcctatttacgtgtctttttctgaaactttaattgctttcctgcttgtatttcctgacatcagaagcccatgtaaactagataacatgtgggaactatttgcatttaacacataaaactaaggatctgcctatagtgtaattagctctagacttccatgcttgggttgctccagcagggtgcggactttccccctctacttcgggacagttgaggggaagaggtagcggccataagatcgctcgagtccagcctgcattcctgtctggatagcagcaagactcttgtagtgttctgtggtatgcatgatgctgtggccccagtgcccttccagatacctggggagaggttcctctagactacttactgcttctttggaaatagttgctgctggtgctatgagtgatgacggtactgggggcagttgtataaattcttcatccttaaacattagaactgagaaattagtgatttaagccagtgcataccaggatctaccacggataccaggaacttgtaacaactatattatgtagggtttgaaaggtaaaaatctgaaaattacatgtaatcaaatgttgacttaaaacatttctggcagtaactggagatggaagctgtggtttcacattttccacaagcccattaccagtgagctacacacccagtccaatatgctgagctttttacgaatcagattaagcagtgctattgatgttctttattaccaggtggtactgcattggatacaatgagttctgttccactgggaggataagacatgcagagaaatggctgggggtgtgctcctgtcatctcaatccttgagaggctgaggcaaggggtcctggagcctgaaaccagcctgagctacaccatcatctcgtttggaggaaaagaaaattaagtctgatcattttttttttcagtttaatcatgtagaaa

SEQ ID NO: 380 - DNA, 1726 bp, Mus musculus
gtggaatatccatggaggtacggagccttgttaccaacctctaaccgcagaactgggatgtggggctggaagtgcctcctcttctgggctgtgctggtcacagccactctctgcactgccaggccagccccaaccttgcccgaacaagctcagccctggggagtccctgtggaagtggagtctctcctggtccaccctggcgacctgctacagcttcgctgtcggcttcgcgatgatgtgcagagcatcaactggctgcgggatggggtgcagctggtggagagcaaccgtacccgcatcacaggggaggaggtggaggtgcgggactccatccccgctgactctggcctctacgcttgcgtgaccagcagcccctctggcagcgataccacctacttctccgtcaatgtctcagatgcactcccatcctcggaagatgatgacgacgacgatgactcctcctcggaggagaaagagacggacaacaccaaaccaaaccgtaggcctgtagctccctactggacatccccagagaaaatggagaagaaactgcatgcggtgcccgctgccaagacggtgaagttcaagtgcccgtcgagtgggacacccaaccccactctgcgctggttgaaaaatggcaaagagtttaagcctgaccaccgaattggaggctacaaggttcgctatgccacctggagcatcataatggattctgtggtgccttctgacaagggcaactacacctgcatcgtggagaatgagtatgggagcatcaaccacacctaccagcttgacgtcgtggaacgatctccgcaccgacccatccttcaggcagggctgcctgccaacaagacagtggccctgggcagcaatgtggagttcatgtgtaaggtgtacagcgatccgcagcctcacattcagtggctgaagcacatcgaggtgaacgggagtaagatcgggccagacaacttgccgtatgtccagatcctgaagactgctggagttaataccaccgacaaggaaatggaggtgcttcatctacggaatgtctcctttgaggatgcgggggagtatacgtgcttggcgggtaactctatcggactctcccatcactctgcatggttgaccgttctggaagccctggaagagagaccagctgtgatgacctcaccgctctacctggagatcattatctactgcaccggggccttcctgatctcctgcatgttgggctctgtcatcatctataagatgaagagcggcaccaagaagagcgacttccatagccagatggctgtgcacaagctggccaagagcatccctctgcgcagacaggtaacagaaagtgtcagctgactccagtgcatccatgaactctggggttctcctggttcggccctcacggctctcctccagcgggacccccatgctggctggagtctccgaatatgagctccctgaggatccccgctgggagctgccacgagacagactggtcttaggcaaaccacttggcgagggctgcttcgggcaggtggtgttggctgaggccatcgggctggataaggacaaacccaaccgtgtgaccaaagtggccgtgaagatgttgaagtccgacgcaacggagaaggacctgtcggatctgatctcggagatggagatgatgaaaatgattgggaagcacaagaatatcatcaaccttctgggagcgtgcacacaggatggt

SEQ ID NO: 381 - protein, 451 aa, Mus musculus
VEYPWRYGALLPTSNRRTGMWGWKCLLFWAVLVTATLCTARPAPTLPEQAQPWGVPVEVESLLVHPGDLLQLRCRLRDDVQSINWLRDGVQLVESNRTRITGEEVEVRDSIPADSGLYACVTSSPSGSDTTYFSVNVSDALPSSEDDDDDDDSSSEEKETDNTKPNRRPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMLGSVIIYKMKSGTKKSDFHSQMAVHKLAKSIPLRRQVTESVS

SEQ ID NO: 382 - DNA, 75853 bp, Homo sapiens
  misc_feature (1)...(75853): n = A,T,C or G
agcctggcgacagagcaagactccttgtcaaaaaaaaaaaaaaattcagtaaaccatactgtaaacagatgtgctgtcattcaggcttagttatgccatttactgaacacaagcagagtagatttagcataatttctaacagcaataggatttttgaaatggtaaatgaacactggcttcgacttaaactcaccagctgcattacctcctaacaagagagagtcagcctgtcctttgaagctctgaagccagacattgacttatctgtagctagaaaagtcctagattacatcttcttccaatagaaggctgttttatttacattaaaaaatctatgatcttagctagatcttctggatgacttgctgcagcttctacatcagcacttgctgcttcaccttgcacctttattatatggagatggcttgtttccttaagttgaagcagcctctgctaacttccaacttttcttttgctgcttcctcatcaccctcagccttcacagaattgaagagagttagggcattgctatggattaggctttggcttaagggaatgttatggctggtttgatcttctatccagatcacccaaactttcctccatatcagcaataatgctgttttgcttttttgtcattcatatgttcactggagtagcacttttaatttttttttttttccttgatacagagtctcgctctgtcacccaggctggagtgcaatggcgtggtctcggctcactgcaacctcagcctcctgggttcaagtggttctcccgcctcagcctccagagtagctggggctacaggggcgcgccaccacacccagccagtttttgtatttttagtagacacggggtttcactatgttggccaggctggactcgaactactgacctcgtgatccatctgcctcggcctcccaaagtgctgggattacagatgtgagccactgcacacccagcctcacttttaattttttttaaagaacttttggctgggtgtggtggcttacgcctgttatcccagctctttggaggccaaggcaggcagatcacctgaggtcaggagttcaagaccagcctggccaacatggcaaaaccccatctctactaaaaatacaaaaattagttgggtgtggtgacacatgcctgtaatcccagctactctcaggaggctgaggtgggagaatcacttgaacctgggagatggacattgcagtgagccaagatcacgcagctgcacttcagactggggacagaccgagactccgtctcaaaaaaaaaaaaaaaaaaccttttcctctgcattcacaatttggctaatcatttggcacaagaggcctgcgtctgggcctatctcagtctttaacatgccttcctcactaagctcaatcatttctagctttggatttaaagtgagagacatggaattcttcctttcacttgaacactcagaagccattgtaggattattaattgacctaatttcaatattgtggtatctcaaggaataggcaggcccaaggaaagggaggggtgggggacagccagtcggtagagcagttgcaacacatatttatcgattcggttcactgttttatatgggtatgattcatggtgccccaaaacaatgacaataatgaaaagatcactgatcatagatcaccatgacagatataataataatgagaaggtgtgaaattttgcaaaaattaccaaaacgtgtcccaaagacatgaagtgagcacactcagctggaaaaatggcgccaatggccttgctcaattcagggttgccacaaacattccatgcttaaaaatcgcactatctgggaagtacgataaagcaaagcactggccggacgcggtggctcacacctgtaatcccagcactttgggaggccaaggcgggtggatcacgaggtcaggagtttgagaccagcctggccaatatggcgaaatcccgtctctactaaaaatacaaaaaaaaaaaaaaattagccaggcattgtggcacgcacctgtagtcccagctattcaggaggctgaggcagaagaattgcttgaatctgggaggtggagattgcagagccaagatcgcgccactgcactccagcctgggcgacagagcaagactccatctcaaaaaaaaaaaaagcaaagcaccatcaaacaaggtccatctgtgtatttctcagaaaataagctcacatgctcacatgcttggaaacctatcagaaccagacaaatggtgttaggaacagagcagcaaataattggcctctatctagccttagcaagaaacatcctggaagaactaaggggacttaacacccacgcagattactttctagataggcctgagaaatccaccccagctgactcagcaaagagatacctacaggcccccctcatctgctaaccaaaaccctatattggctgccgggcactgtcagggtatgcctggcttctcctgggctaggcaggcctcaaaaaggtgccctgaaagctctctgcactcagtggcatggaggaaaccaggtttcggtgaagacaggcagtcagaggcatctccagcccttccagaacccaaaccattctttagtcatctgagatatcaggagatcagctttcatgttgtccctctttctctttggatgactaagaaggcttttcttttcttttctttttttttgagaaggagtctcactcttgtcacccaggctggagtgcaatggcgcgaatgtcggcttgctgcaacctccacctcctgggttcaagtgattctcctgcctcatcctcctgagtnnnnnnnnnnnnnnnnnnnncccatactttttacggtagctgctcatggacatttgcctcctatcagactgcaaaatttttatgggcaggaacgctatcttgcagcatttaaagcatggtgtcttgcatgtagtgagtgcatggtgaattaatttaaaatatttctggctgggtgcggtggctcaagcctgtaatcccagctctttgggaggcccaggcggacagatcacttgaggtcatgagttcaagaccagcctggccaacatggggaaacccgtctctactaaaaatacaaaaattagctgggaatggtggctgcacatcccaggtactcgggaggctgaggcaggagaatggcatgaacctgggaggtggaggttgcggtgagctgagacggcgccattgcaccccagattgggcaacaagagcgaaactctgcctcaaaaaaaaatcactattattattattattatcattattattatattttgctgattagaaaactagtacaagatcagggccagggtgccttggagcacattggaggaaggccacttcctctgggcagaggcagccgggcagtagcacacaggattccagcccagggcctataaaaaaaactcctctcaaaaaagtcaaacaatgtaaaggtacataaaaaatgggccaggcacagtggctcatacctgtaatcctagaactttgggaggccaaggtgggaaaatcacttgagcccaggagttcaagactagcctgggcaacatagctagactctgtctctacaaaaaattaaaaatttaaaaattggccagccatagtggcatggacctgtagtcccagttacttgggaggctggggcaggaggatcacttgagcccaggagttcaaggctccagggagctgtgatcacatcacttcactccagcctaggcaacagagagaggtggctcaaaaaaatagagcctggctcaaaaaaacaaaactaaaccgaagtataagcctcttacaatcgcattcccaaagaaaaccactattaaaaatttggttaactattttgttttgttttgacagaataataaaattcagttagggggaaatttaacctgaatgggagaacaccatctatttttaaattatcttcctctctgaccctacccagcccaatatcgccaaaggttcttaacaacccaggagaagtcagctgcaactttattagcatatccttggatggaatccgcatcaaagttgaatcctcaagtatctcagcctaaccctgaaactttgatctttgtacctaggcagggcaaagcctaaggaactaggtccttcactcttgggggtggagggcggtcctcagaaatgcaaatttttcactgttctgccactgcctcctctgtcacctctccagaccccagcccttggatgagtggctttaaccaggagagggtttacaagtctgtgtcagaaagaggagagcctttggagaaccctgaagaaacacagaggacagaagaccagcttgtttgcatttagtgttctgaagggagtcagaatcctagaccagcgaccatagctggaaggattcgctgaggtttaatagggccccttagcttccccatatgtgttcttgttgtttttctcttatttcacagtaaaatctataacaaaaagggctgtttatcttggggtacaccaaggaagagggagatgagggtgaaaaatatatccttttctgcagctggtgttggggaacagagaatccagggtggaagtgggggtagagatggtaaatacataagaaagccacaaagaaggctgggtgcagtggctcacacctgtaatccctgcactttcggaggctgaggcaagtgaatggcttgagcccaggagttcaagaccatcctgagcaacataaggagactatcacctccacaaaaaaatacaaaaaccaactgggcatggtggtgcatgcctgtagtcccagctacttgggaagctgaagtgggaggattgcttaagcccaggaggtcgaggctgcagtaagtcaagatcgtgccactgcactccagcctgggggagtgaggaaccctatctaaaaaaaaaaaaaaaaaaaaaaagccacaaagatatgcaggctccagaaggtgtcttccatcaaaggaaagttcctgggctaaaaaataataataacaacaatgactaccatttattgagcatttacaatgttctgggcgctttgccaagtgcattacacacattttctcatttaatcctttcaacagtcctgggaagaacagttaccattgttatcttcatttcaccattgagcaaatgcagtggagctaactagcttgcccaagatcacacagctagcaataagtggcagaatcaggacccatgctcaaaactgtttgaccccagagactaagttcatcccttcagagcaaaataattcgatgcttcagtgactaccaactgtctaccccccacccccacccctcaacacaaactctccaggcttgctttcctcagctatcccagatgagtttgtggattttcacattgccatctttcaagattcaggcatcgcttcccctgagtcatcttccttcctgatctctccttccacagccccctgcagatgcccccgggtggcactacgtgtcatgtttggtctcccccacaagacaagtgaggtcccccaggctgtgcactcatctctttcatcttcggatccactgtgcccggcacagcgcctgacacacaagaagtgctccctgacacccccaggctccgtgaatagatgtggcattcaggccagacagagctgagctgccacacagctcgctccctttctcactccaaattggcagaagagagtgaatgttatttacaaaaacaccaagccaaataagaccctcccttccctgacatgctgaagctgctctgggaacagacaggggtcaccaaatggtggccagatggtgactgactgctgctccctaactccaggggcctggggcaaaaggcttggctgcccacctgctcccaggacctgtgaaccatccactttgtagggaaaaccccagacagttccctcctcccgaatccccttctgcaaccagctctcggagtggagactctgccagctctcaccacatcctggggactcttgaagcctgggctggaagttctgcaaccttgccccatgtcaatggtgcttactttacctgacttgttccataacaaagaattgttaattctgcagtatcgacccagggtagtggggtgatcattcctggtaggcacagctgagccctaaaataacagaacccagatagagcaggggcagaaggaatgtggggagaggggaagaggagctcccgtctgccagggaaaactctgaggacacaagtagctggaggaacagggaagggatttcctacagtgttcccaaacaaagagagctggccgggctttggggagagctccgtttcccttcgtttcattcagcagtggtctcctcctcccacagatgtgggaggcaacaggcccccaaccagttatcaggccctccagcatgagggcctttgtctccccttagacatgtagctggcagggcgaagggccgacaaatcctccctgaccctcccagctctttgttatctcagagggaaggttacatttctgtatgggaggcaaggtgccaggaggcctcgggcagaacagagacaggcagagctgctgtctgacccctgttgcctggagcagctcagggctgccctagggacactctccctccactggcctggggcccttccagaaatgggagggctacatttcagaaagagggcgagtagaggagtgggacagaaaaggagcgaggtgggctggaaggataaaagcagccaactctcaattattcagaaacctgtctgcagtgtgtggacagcccatgcctttgctgagtttctcaccttctctgttcagctgccatcagctctttccctgagaagtggaggagggaccctggcaagttggccacttgctttcattttggcttcttgataaatctatagaggatttttcagcagcaggcccatgtccctcaaccccaaacaagcatttagatcattatctttctgtttaaatcaagaacgcattatttagccttttatttggggttcaagatactcctacaatggttctaaatcataagaaaaaggggcttgatttaaaaccccttgttttgggccaggaatggtggctcacgcctgtaatcccagcactttgggaggccaaggtgggcagattacctgaggtcaggagttcgagaccagcctggccaacatggtgaaaccctgtctctactaaaaatacaaaaattagctgggcatggtggcaggtgtctgtaatcccagctactcgggaggctgaggcaggagaatcgcttgagcccagaaggcagaggtgagctgagtgagctgagatcgtgccattgcactccagcctgggcaaaaagagcaagactccatctcaggaaaaaaaaaaaaaaagaaaacaaaaaaaacccttttttgagaagaattacggagcaaagtagaaaaatagtagctgggtgttaacattaaatgctggatttttttcatggcttgtcttcccaatcatattccctcaaattgtgtttcctcctctggtaacccaggttggttatgcttagcaagtccatgaacaataaatatacatggaaaacctcctgtgtagaattggtcagacacctagataagatccttgccctaaagcagtttagaaaccagttagaaagaaagcagagtaaggaaaaccactaacaaagcacggtatcaactcagtggatagtcagcaagtgagcagggggtccagggactgacaaagctgggatgggcagggaaggcctcttgggggtagggtgtgagtatggccttcttacaagcgtgtgatgtgtagtaattaaaatgcaggaggcctaatgggtgggcagcttacataggagtataaaccaagcttgaccaggagctgaaaggttaaatggtggctcttaggggaaaaccctataaacagtggctgaagttcatttattcaacaaagatatgagttcttgtttctcattttttgttttgtattattttgttttgagacagggtcttactctgtcgcccaggctggagtgtagtggctggatcatagctcactgcagcctcaaactcctgggctcaagccatcctccttcttcagcctccacctccagctaatttttaaaaatattttgtagagacaagggctcactttgtttcccaggctggtcttgaacttctggcttcaagtgatcctcccgcttcggccacccaaagtgctgggattacaggcgtgagctgtaatttagttgtttatttactcatttgttcaacaaatacttattgaatatttgctctttggccagtcaagggatttcatgagtgtctactatgtgaataacactgtgttggccactagtctgtcacctactggtggattagaaaaatagcgcgaggaccattttttcttttcttttctttttttttttgagacggagtcttgctctgttgccaggctggagtgcagtggcacaatctcggctcactgcaacctccgcctcccgggttcaagcgattcctctgccgcagcctccccagtagctgggattacaggcaagcgccaccatgcctggctaatttttttgtattttagtagagacggggtttcaccttgttggcaaggatagtctcgatctcctgacctcgtgatccacccgcctcggcctcccaaagtgctgggattacaggcataagccaccgcacccggccaactcttttcttaaattagccagggaggcgtgggtgggttgggtgaggagttgggtggggggatctcattcagtattcaaacttctacaagtttcggggttgaggtgggtgatggtaagggaacaggccctgccactacctttcatagtgacttccatttgtgtaatatttttggtccactgagagctattattttatttgattcttatgaccatcttgtgaaggagtatcaacagataccccgttttgattttatcagatgcatgatttgtcctacatcaaacttcataaatgatggacagaatggaggaatccttcagaccaagtgctgcctacttcccaccccaatggtggcctcagcctgggctcacatcacacgccccaaggagccttggaaaaaataaaggctcttggctccttcctgggacagcgtgattcctcatgtctgagcaggcccatgaacttgtatttttcagacgttccctaggacccgtgtccatctggattagggaaccactacattataccacttcgcgggaagactcagggggaagcattttagccactttcctgtgttccacagtactggagggtgttctgagtgggctgtgattaatttccaaaccaaccacacgtctcccctcaactcccactgcttactctttgcttcctagacattcactgcaggctggagacttctggaagccaacagcatcgctgtagaatttacagggtccagttcccggtggaccacaaaacctaaattatgtggctggggaaagctgaaatccaagggaagggtttgaggaggggctgaccttataataaaaccggcttgtatttactaagtgttaactatgcgctaggccctcgttgacgcctcaactctatgtgaaaagcactattatcccccatttacagatgggaaaacagagatttagagcgcgaaaatcatttccccaaggcgcacagactccaaagcccacgctaccaggtacaacctcaaggctgcggcgtctcttcacctgccccctagcccccaaaccgctgctatgtctagggcctgacattccggcgccctctgggacgtgctcagatgcaggggcgcaaacgccaaaggagaccaggctgtaggaagagaagggcagagcgccggacagctcggcccgctccccgtcctttggggccgcggctggggaactacaaggcccagcaggcagctgcagggggcggaggcggaggagggaccagcgcgggtgggagtgagagagcgagccctcgcgcctcgccggcgcatagcgctcggagcgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgaggtaagagccgcggcgcccccggatctggggcgggcttggcgtcccgagcggcccccggcgccggagcctcccggctgcgcgctttgcccgccgcagcccagccggggccggcgcctccctccgctcgccgcccgcccctttcacctcctggctccctcccgggcgatccgcgccccttgggtctcccctcccttccctccgtccgcgtctcctgcgccccctccctgcgctcgtcccgccgctcttcccgccgcccaacttttcctccaactcgcgctcgggagctggcgaggcggcggcggctcctcagtgagtcccgggagggacaggcccggggcgaaggcggcgaggcccgcggtttcctggactggggaggagggcgggagtgggcggcgaggtgggatgcgttgtgtgtgttatgtgtgtgtgttgcattccactccatgtctttttggtccccttttggggattcacccccaattcagcaggtagctttgggctcaacgctaaaaatccggggcattcctaagtccttttccacccccgggaaagcctggggtgcgggttggggtcggatggggtgggagatgaactgcggaggacgtggagggctaggttagcttctcttggaataggttttaaggaggtgtcgtcaccaaatggctgaatctgcttgagctgagagcgaaaaacgactcccctttccagaaggggtgatcttatgacttggacggtctctgaaagggtcggaagtttggggaacgggaggacaacccacggtcgttaagccgaggtgtgggatgggggcggaaggaccgttcggtcccaatctggttcctagaggtgggggaagggatgagggtttttgtccggtgtggttcactcggcagcgatgcgtatgcttctctggcccagacccctctgcacctcgcttcccctaccgttatgtttggggttgggagaaaagtgaggctacgacccatgtttgcggaggaattttatggaccttgtagatgggggttcatatagaacacacaccccctatgaggcagccagacacttttttggtggtggtggggggggggtggggtgtgaagcctgtttcttgttctgagcccagaagctatcaacccttttgaaaaacattaccacggtgcctttctcccccagcactcccccacccccaatttccagatgtagcagccgcatctggttccgtttcaccccacacgggtacaccgcagccgcattattaacttccctcttcctcccctccccctcccccaaattaaaactcagattcttcagcctgtcttgaccacctccctccttaacatttctggagacttggagatgcggcgttgagattcgggggagaaaagaaagttcccttggatcccgagttatttaagatctcaccaagttattcgccgccgctggtgggtggcggcggtccgggtgctttctggattgcgcagtaaagaggcatcttgggagatggggccaaggttttagggggtgccactcgcgaacggttcatccgctagactaggggggctctttggctgtgcgtctggccagaactggccttgacgatggaagtttctggaaccaaagcgttgctttctctcccttgtgttatagctggagctgcgggagcgcctgccctgcccggagcccgcggtcccctctcggctgccccgcggtggcgtcacgcgcccctcccggagcaagcccggtgcgcagggccgggggcgtgggcggctgctgccagaggcgctctctgtgtgtttttaaggactgatttgggccgcatcccccggaaactaaagtggggtgttttaccgtttaaataacggctacaggtttgaaagcggggttggattttcgagttgtgtttggtaatagtctttgaggcaggaaagcgccttgtggtccaaagttgccgggagggtggggagagtcggtgtcttacccgcttctttccagcctctttcaaattgaaaacacttctctggtttccttctttgggcggtagttttggaggctgtaatgaaatcgcactttctctagacgtggtaattaaggtgactgtttcctccgcagatgtgccctaccctttgcacctccggaccagcgctttttttggaatactatctagccttgagactgtttagcagaaagtggccattttcctcccttggcccgggctcccggtttcctccctgaggcttgtttaaaagcgaagtagcagggccccgtgggacgcgccttggtctgggtaatcacccccacgcccgggtcatccaccttcctctcggtgaccgaggttcagcagcctctgctattgccggccgtctttgccgatggcctgcctccctaatgacttgtttacatatcctacccccagtgggttaggagaagctccggggctgccccgaccctccgagtgcagggtgtttggggaccgggaggctgctggggcctgactccagctgggagggttatgaactgcatcagtgacgagctgcttgaaatatctgttgcatttactcttagtcatagctgagtgtcagctttttaatgaggttcatccagattgagagccacttggactgcgtacttcactgcctgcttttccaaacatgcctgcagaaatgctcattttcgaggtatttttcccaatgggaattcaggccagagtgggcaccacttgaacaatcttagggtgcttcttttccttggcctctggccatggagggtgttagacagttccattaggtggccctttgatagcaagggaagcaaaggctcaggaagaaatggagaagcgtcccccactccctaggggcagaggattagatacatcggtgcatccctcaggctgggctagctttattcctggtggactccagagggcaagaaaattgaattgaacactgggtaggcagattcaagccttagagaccaaggaaaatccatgggttttgcttttagtggtgtgctctttgttttcagtattgacctgaaacaagactcctaaaatgagagatttgctggtatgaacttgggggtttagcagccggcttctacaaaggcttttttcttgccttcgtttctaaagtgtctttcgtcaaaatggctgttagttacagaacatcctagcaaagtttgagcctgttgctgctggaggaaaaggagttagaattgattcaaatgtcttattctgaaagggcctcacatcacttgatagtttaatttcctcctgggaaatttgtgtcttacatttgtcttccccagagctttgtaaaaggcctgaacgcaccagggactagtgggagcccagatgcagagctttagagaagattctggtgtttccagagaggatgaaatgtcagacttgggctaggatatttgtttttcctcctaaggttgcatctactttaaacagaaattctctcctcgccaccatttatctctcccctgcaatgaaagaaaccatgtttagggccctctcccccatttaatagccctcacatggatgaactatcccaagaatttggtggggttccactcatagtacatcctgtcttcaagagcaaggttttctagattatgtgcagcagttcgtgtttcacttgttgctttttttttttttttttttttgagatagtctcgctctgtcgcccaggctggagtgctgtggcgctatctcaggtcactgcaacctccgccttccggttgaagcgattctcctgccccagcctccctagtagctgggattgcaagcatgcgccaccatgtccggctaattttttgtgtttttaatagagatggtgtttcaccatgttggccaggctgggcttgaactcctgacctcaagcaatccgctggcctcggcctcccaaaatgctgggattacaggtgtgagccattgtgcctggccacttattgctaattttttatatgtctcttacttccaaggacatttagacactttttttttttaaagagactcaaaaaattagcatttccattggaccaactaaaatttagcaagctgagctgagtaactttctccatatgtttattaagtacttgccccctgccctctcaacatgtgagtagagaatggtcactttggggaagaaataagtcttattctcatctgaagggattaatgttttggtgttacttcctcaattctgaagaaccaagttgtccagaaattttctcagggttctttggactagagtttggctggttaacaaggggtactacctaattgcttttctctgatattctcagcctctttttctggaggagtatctctgtcagtttcttttcatcagcccttttttttccttcattcacttactcattcatccagttaacaaacatgttggcatctcctgtgtacatgctaggtgccgagggtgttagcaaaggttagggaggcacagaccctgttctgaaggagcctgcagtttcgtggggagagaagagaatgaagaacataaataacaatcatataatatgacctaagtgctatgtgagaggggctagtaatgtggtttgcaaatttggaggaatgaaattctccagctagaaggcccaagaaagtcttatggaagaaacagcttcttaaggtggggttcagagaaaagggaagggctggcctgttgcagaacaaggaatggcatgaagaaagtcttgcacagaggcatggatgttgcttcgagctgtggcgccctatagaaatagaacatgagcagctggtcacagtggctcatgcctgtaatcccagcactttgggaggccaaggcaggcggattgcttgagcccatgagatggagatgagcctggacaacatggtgagaccctgtgtctaccaaaaaatacacaaattagatgagtatgctcgtgcttactggtagtcccggctattcaggaggctgaggtgggaggatcacttgagcctaggaggcagaggctgcaataagctgtgattgcaccactgcattccagcctgggggacagaggaagaccctgtttaaaaaaaaaaaaaaaaaaaaagccaggcacagtggctcatgcctgtaatcccagccctttgggaggccaaggcaggtggatcacctgaggtcaggagttcaagaccagcctggccaacatggtgaaaccctatttctactaaaaataaaaaaattagccgggcttggtggctcatgtctgtaatcccagctacttgggaggcaggagaatcgtttgaacccgggaggcggtggttgagccaagattgcgccactgcaactccagcctgagtgacagagcaagactccatctcaaagaaaaaaagaaaggaagaaagaaatataacattataacatgagttatgtatatgttcagattttctagaagccacattggaaattaagttaaaagaaagaaataggtaaaaaaaatttttttttttgagacggagtctcactttgttgccaggctggagtgcagtggcgcaatctcggctcactgcaacctctgcctcccgggttcaagcaattctcctgcctcagcctcctgagtagctgggactacaggcgcgcgccactgcacgcagctaatttttgtacttttagtagagacggggtttcaccatgttggccaggatggtgtcgacctcttgacctcgtgatttgcccacctcagcctcccaaagtgctgggattacaggcgtgagccaccgcgcctggccaatatttgttttttaattaacttgtttgtttagattttatttaatgtaactatatttccaaaatattatcatttgaacatgtaatcaatatagaaattattgatgagatactttacatttttttcataacaagtttttaagatgcggtgtatactttttacttatagcatatccgttagcaccagccacatttcaagtgtgcagtggccactgtgtgggccacaggtctagaatataagacatgaagatggagagtgagaaatgcctttggaaaggttggaagttcctgtccttctgctgccaattaccaaatctcctgagagtgctattaaggagtgactcaaagcactacacaaagagaattataaatatcttaatattatatctgaaatccaaatgcataattctttacatttggttggtactttagagaggagagaatgggcacagtcacccacaccacccatttgagcctcataatcacctgtgatgtggcttcctctaggtgggaaaccgaggcttagaacggttaagtgactatcccagggtggcaagatcataagtggaagggtgtgaattcatactgtctccagcggacaagaataaaaagacccaggctgggtgtggtggctcatgcctgtaatcccagcactttgggaggccactgtaggtggatctcctgagcccaggagttcattaccagcatgggcaacatggtgagaccccatttttattaaatatacagaaaattagcccagcttctcgggaggctgaggtgggaggatcacttgagtctgggggatggaggttgtagtgagttgagatcgtgccactgcactctagcttgggtgacagagcaacactctgtctcagaaagaataaaaagatttggccatgaattcgtcagctagttttccttacataatttttggacaaggagatctgacattcataggtttttctcttagaagtgggagagcttcaaggtcacgtggtccgtccagcccctgctatctcaccagacactgtccaccctgtatgttggatcagtactccagtgagaagacagcaggcactttcacccatgcagcccattcagtcttcataaccacctgtgatggaggcaaggcaagtatttcagccccctctgatgagtgggaaactgagatgtgccccctctctgctccccaccgaggacctctgcatgcaggcatgaatcccaggagcctagctgatattggagagacggggcggggggaaccagctgcagggtcttggaggaagctgctgtgtacacctgcaaggctgcaggttacatctatctgtcaagcagtgaaggaaggaagttgtttctaagggattggaaaaattcattaattagtagaatgagaaactgaggtgaagcaggaggtggcagggtcccagacagcatgttggactagtggcctgtgtcactgtgttttttgcaggcgggtggcatggggtgtatgctgacttcttattccaggagttggtgccaggaggccaggttttcttaacatccttgttttacagatgtcaaacttgagggccagaggggtaggagaggaagagactttttgtaccttttttgggaaagaacaagagggaagctggcagatgaatttgaagtgcattgaccagggagctgagagagggcggtctgcagccagcccacacctgggaggaggcggcaggcttttctggggacagagtggccaagtcgaagcaagcttaaccatctcaacatgacaccactctttcccattggaacctgagaacttgttcagtattctgacacttagcaagggacctgggttttcttggtcaggtgtgcgtttctgggtgacaggcctgcatcaggtgtattttcgggatgtagtaagttgtggaatatgggtttaggggcatcctctggcaagcactgcttctatcccagctctgggaatgtgccccatgcagtgtcctagatggcccatctgtggtctgcttccaagggtctttcttttagttagttagttttgagacagagtctcactccgtcacccaggctggagtgcagtgatgcaatctcggctcactgcaacctccacctcccaaattcaagcaattctcatgcgttagcctcctgagtagctgggattacaggcgtgcaccaccacacccagctaatttttgtatttttagtagacgaggaatttcaccatgttggccagtctggtctcaactccccacctcaggtgatactcccgcctcagcctcccaaagtcccgggattgtaggtatgagccaacatgccctggcacaagggtctatctttgaccaatggaactgcaaatcaagcctcttttgttaccagagttaccttggatttacccttatctacttggtttggataaattgagtttgcatcagatggagtcaggcttgatcaatcccttatttacttcctcccaccctgttctctaatatccaaaaaccttgaggcactattacatgctagctacatttccttgagtaaagtacttaacctctttgagcctcagtttctccattgcataaaaggaataataaaacttatcccccataagtttatagtgaggaatgaattaattcctcactatagttctaaattaattctacttagggcatccttggtacatagtgggtgttcagtattcatttcattttctcttttctgattcctttcgtaaaagtagaaaaatgaaagagaaatgttgacttctcttttgatttgaaatcattaaaacattttagtaagccttgggagggagctagtggtgtggcatgtgtatcccgctggccaagcacatgtgaacgaagccaagaatccaggggcttttctgccagccagcactgactcacttgcgaggggccctgcctggctcgggggaggcagggctgaagtaccacattagggcatgttccggggaagtagattctctgaataacttggatggctccctggagcatttaggacagaagccacctggaaaatagagatggtcacccccacgtagccttgacagtgcccagaaagtcttgtcacttggtaaatgttaacagctatgatccgttctttaagaccctggggagttttaagttttaccccaccagacctgagaagggtaaagggctgcagattctgttcttttaactggggccagtgtgagccatctttgactcagtgcttgcaatagaccttgattctgcagtgggacctcccaggcccccttgccccccgcaacttctggactcatatccgtcagacatcacttgtcaccttccagcatcagggagaactggatccctcctggctccacactcttaggctctttgtaagtagctggtgagggttttcttctctctgcaagggaggctggtagaactatggatgtgattcgtacaattttagagacaaaaagaaagtacccaggaggtcatttatttcagctgcttcattgcataggtcggggagttgagcatggagtccagcagctactaactagttatctctgtacctggcttccatttactggtccttagcttgttccgtgattcttcattgccccttatttctcaccagagggactggttggccctagatggagtggtctttttaaaattttttttttaaattttttgagacagagtctcactctgtcacctaggctgtagtgcagtgctgcgatctcggctcactgcaacctccgcctcctgagttcaagcaattctcctgtctcagcctcctgagtagctgggattacaggtgtgtaccactatgcccagctaatttttgtatttttagtagagatgggatttcaccatattggccaggttggtcttgaactcctgacctcaaatgatctgcccaccttagcctcccgaagtgctgggattgcaggtgtgagccaccgcacctggcctgggcagagtgaagtcttatgctggggagccatcagcatgctcaaacctcctgcaattgtagcacactttgtaaaactgtttcccacaaaagggcagaactatttgggactttcatgagaccattcactttgtagcacatactactttgaagtttataccttggaaaacctcatgatggtattcccaggcttgcacgtaatctgcactcaaaacatagctgtagaattgaactaaagcatccctctgtccaattaagacctataacctctctttttgagacagaatctcgctctgtcacccaggttggagtgcagtggtgcaatctcagctcactgcatccttcgcctcctggattcaagcgattctcttgccttagcctccgaagtaactgggactacaggtgcgcgccaccacgcctgggtaatttttgtatttttagtagagacggggtttcgccatggccaggctggtctcaaactcctggcctcaagtgatcctcccgcctcagcctcccaaagtgctgggattacagggtgcaccaccacacccagccaggacctatgatctaattcattgttggggtagcttcacaattttcttctggacgccttagtaagtccacactttaagcagccaccacatggcatactttaccttctgtttttcctttcccctcccctacctagaccctcctaacttttggggtttttttcctttcctcagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaaggtaaggtgctggctgggggcagcctggactcctgggccttgggaacaggatgggctgggagggaggtgatatggttgcaggtgatgtggtcaacagggaaggctccttcccaagtggagcaaagaactcccttcctgtaggagaaactctcaagatacctgggttggttctggtctggttataaacataactgacttcatcagaggttggggtcatgaaggctggtgacatccatttacctgagatgacatgtttgtggggggtaatttatgcttttctctttctgaggaaagaatatctgatgaggaccctagtgtcacactttaacataggtgatgtataaaatgcagctggtggtgcaatggggagagaatgaccttagaatttgcgtgtagaacttgggtcagactacaggggatgttgtaggaggtgagagcttgctaaagacctctgacttccagaaaattgtttcaaggccacatcttcgccaggcatagtgggtcacacatgtaacctcagcactctgggaggctaaggcaagaggatcacttgaggccaggagttcaagatcagcctaggcaatatagcgagaccccatctctacaaaaaaaaaggaaattaactgggtgtgatggtgcacgctgctagtcccagctacttgctactcaggaggctgagacaggaagattgcatgatcctaagagttgaggctgcagtgaattatgattgcactactgcgctccagcctgggtgaaaaaaaggcacatcttctataagggtcagcagtcatggcttcacgcctgcattttcctatccttaactgtgtctcacaggttctgtttgggggcctgccaagcgatttgctttggataggtactgtttgaggggttttgaagtgattgagacccaggaagcataaaggggcatggagacctatggcgtgttggaaattcagagccatcatcggtaacaggaaggacttaccccaccattcttgggatctgtgtgagctgtggaaaggcctcttgggagattataggtacagaataccggtggctttcgcgggactttgaaaactaatgtatgagcatttctgctgccagaggatagtgtggttcgtgactcagtggctggtcacacagagaaggttgacacacagtgggtgaaaggttggaggtgcgcgtgatggggtggctgtgtgcaaaaggctgccactcagctggtcagggactcgtttgaatgatgagtgatgggtgagaatatgtgtcctctggatggagttggggatgaacagggaaagttgtgtgagactttatagaaggtgcagtggctagagcaggcatattcatgttgctgtcagtaacagaaccgaaggcaaggtctgagctggagcacggtggggacccaaagtgggagagactgtgtctgcccacagggagtttatggtcaggagggatgggcaagtacagggataagtaacacaagacagactgtgtttaaaccacccagtgaagttacaaccagaggtggtgggaatgcagaggaagaggggagcagagagcacctgagatgggcttgagttcagaaggggaaaaatgaagggccctccaggttgaacagcatgagtgttcagagacagcatgtatatggtttatggagaacggtttgcctggtgagtaggtagctctgggaaacaacacttggaaaaattggattgagttagcatatggaaggcttaatgccctgctaagaaaactatacttagggccgggcacggtggctcacgcctgtaatcccagcactttgggaggctgaggcgggtggatcacaaggtcaggagttcgagaccatcctgcctaacacggtgaaaccccatctctattaaaaatacaaaaaaattagccgggcgtagtggcaggcgcctgtagtcccagctactccagctccagtctccagctgaggcaggagaatggcgtgaacccgggaggcagagcatgcagtgagctgagatcgcgccactgcactccagcctgggcaacagagtgagactccgtctcaaaaaagaaaaagaaaactatacttaggccaggcgtggattatgctggtaatctcaacattttgggaagccgaggcaggaggattgcttgagccaagaagtttgagaccagcctgggcaacatgatgagaccctgtgtctacaaaaaatagaaaaattagccaggtgtggtggcacatgcttgtagtcccaactattagggaggctgaggtgggaggatcacttgaacctgggaggtagaggttgcagtgagccatgatcacaccgcttcacttcagcctgggtgacagagtgaaactctgtctaaaaaaaaaaaaaaaaaaaaagcaagaaaagaaaactagacttaaatgggtagatgctgggaaacttgaaaagtttttagcaagtagtgacactatcagctttcagaaagttaatttggcagctcagtgtggatggctgggaggaaagagtgaggtgcacctgtgtttgcatcctgctctgccacttgatagctgcattatttacttcaacaaactactcaaacaccatacgtcacagtttgctcatctgtaaaacagggataaataataaagggttaagtggggtaatccagatgaagcacttccatgtaaggtgttaatagttgctattgctgccactgctgctgccagaaggatgaggtcgcaggttattttgagtgtctggctagaggaagtgcaggtactgaccaggatggggactgggagatgatagaggaaggaaaaagtagtaaagacactacagcaatagcatctgtgggtttaagtaggttgggtgtcaactgtgggcaactggagactgagatgagagtgtaaagggagtgagtcagagtgggaggtttgaggggagtttagatttgaatccgccaattgtagacagcgataaaggagtggaagagtagcaaggagctagttgaggtttgagaatgtgaatttataatggagcctaaagtactttcttttttttgcagcccaagaagggagaagtggatctcgggcctggctgcttgtgagccagcccgacgggatgagtataaggaactttagggccagggtgggggtgctagtagaggagggggcttcacggaagctgctggggcagggtggaggctggaacctgggggctgaagatcttgatgaggacaaagtaccggccctgtgaacagaagaaagggagtaagagaggtggatggggctcttaggagccatgtacccaggaagactgacattaaatgaccattttttaaaaatcaacttaattttcaaaggcacattggctcccacctataatcccagtactgtgggaggcagaggcaggaggatcacttgagcccaggagtttaagatcagctgggtttgtttgtttgtttgttggttggttttaagagacagagtttcactctgttgcccaggctggaatgcagtggcatgatcttggcttactgcaacctctgcctcccaggttcaagcgattctcctgcctcagcctcctaagtagctggaattacaggtgctcaccactatgcctggctaatttttatatttttagtagagatgggtttcaccaggttggccttgaactcctgacctcaagtgatctgcccacctcggcttcccaaagtgctgggactataggtgtgagccaccacacctggccaaaccaacttaatttaggtataacagtttgggctattgtaataagactgctgtgaaccttcatgtgcaagcctgggtgggcacacattttccttggactgccctggttttgattttggctccacaccttactgactattggctcttggggaagttcctctttgtgcccttttataaaatatattgataatgaatgtgtgctcataaggtcattgtgaatatcaaataagcatgtctgcagagctcataggacattgcctggtccgtaggccatgagcagtcaatggccgttgtgggtccctttccctgggcctccaggggagacggcacatggcgaggagcatgttgtttcatgggacacagcaacggaaagcccctgcacttggagaacaagccccaggtctctgtttggtggagtaagcccccgtctcagtgtgagtgtggtgctttcacatagcctgtctctcatgagctttgtgacagaacagagaactgctgtgcccaggacattctaaggggagatctggcttcatgctttgtaagctgtaaggaaccttgtaagtgtaaagtatattgcatagtcttgggcctgctgattattaaataataatgctgatattttttaattaattaattaatttatttgagacggagtctcactctgtcgcgaggctggagtgcagtggcgtgatcttggctcactgcaacctccacctcctgggttcaagcgattcttctgcctcagcctcccaagtagctgggattacaggcgcgtgccaccacgcccagctagtttttttgtatatttagtagagacggggtttcaccatgttggccaggatggtctcggtctcctgacctcatgatctgcccacctcggcctcccaaagtgctgggattacaggtgttagccaccatgcctggccaatgctgctgttgtcctaaaaaaaaaatcatagggcgagcacagtggctcacacctgtaatcccagcactataggaggccgatgcaggaggattgcacgagcccgggagttccagaccagcctgggcaacatagcaagaccccatctctaaaaattttaaaaattagctgggtaacgtggcacacatcggcagtcctagctattcaggaggctgagatgggagaattgcttgagagttgcttgagcccaggagttgaggctacagtgagctataatcaagccactgcactccagcctgggtgtcagaaggagaccctgtctttaaaaaaaagaagaaacacattataatctatgtattaagggctttgtccaaaaggtgagagcaaaccacctaaaaccctgttcacactgagttttccccatttaaaaggccttgctgtgattttaagtgtgtgtgtgtgtgtgtgtgtgtgtgtgtgtgtgtgtgtgtgtgtctgtgtgtctgtgtgtctgtcgggagcccctccccactgagcgcagtaccaacgcccctcagtctgcaagtgctcctgagggattggggagggcctggagtttctggctgtccttggaaagttgatttaataagggttccaggaaaaccagcctccctcccctctccctctccttcccctcctttggtttgggatcttacagagcctcagcttgtttcagatcaggctttgagagtggtgagggagttgtttggaaagactgaagccggtttcagatgataagccccaacattctgagcttgcagagggtgcatttgtctgtcttttgcaataagtcaagtcttggtgggcaaagccagtgagtgagtacaacactgcttgcaaggccactgctggtagttggggtgggggtcctgcccccttttcagcagtactgtgggttaaacaccccagtgctcagaaaacctgcagctcagaagtgatttaatgggctgagttttacagctcctcccacccacccagatttgaaggagtctggtggcttgttagaggggggagaggttgcacttaatggaaaaaccacacatttccattctggcctcaagccccctggatgccctgtgtgcaccacaaagcggggctttgtctctgtgttttgcagaaacctgcacctatgggggagaggctgtgcgtggtgccagagccattgcctagcctcagatcatagggcccttgcaggtcctccatccctgggcgtctccagctgcctttggcccaaaggggtgtgcgtttcagcctggctgcagggagagtctcaaataggtactacaggtttggtagtgggacaccctctgttccactatcagacctgtagtctagcatctacactggactgtggtcctgtgtcccaaggctgccttgggacacaggcaagaccctcccctactcccaccccatctccagcatgatttcttatgatgaaaagaacttgtttgcttctcattcaacctggatggtaagaggagtttcttcatcccctgccagaaggcgaatggaattccatggagcaaaaggtgatgtcagatgaccctcttgagaacaagggtggaggatttaggcctctagaaatctgcaaggtgctaagctcataacaggtttccccagaggatcagctctgtcccacttcccctggagaagtggctccagtgcctggaaggggtgtttgcaagtgttcagagctggacagggaggacccagccctcggcctgtgagagaatgtgaggacgctcacgtggccctcttgaccaagctggggcaagcgcagcaaagccactccgaggctgtgttcttggctccggcttctgcattgctacaccattagcttcactgattttccactctggctctgccaggcccgctccctgaagtcagggaggaggaatttctcagggaagaacaaatggctgtccagagatcttgctgccagtgggggaagggagggatcccaaacaaagactctgtcagggtttccatcacctggttcctgtgactacctggagtcgggtcagcaggaactggagagacagcatcagggattctttgggagcctgtggccccagcacggaggggtgtttgctcctggccaggcagaagcagtgagtgatggcttgtgtctgggcggtgatgaatggccctgggagaagtgagtcctggggagtcattatccgggagggcgaggtctggggtcagagagcccgaccagcagctggccctattttcacaatgcctcgttcctccggggccactgggggctccagctcaccctgtagacaccacctttgcctctttcttccttccctgaggcttggaaatgagacaactgtttccctgttgaccggggaagtccagctgctctcattctcctgggctcctgaacggggcggcccaggccttcctcctgggcctggctctttcaccaacttgcaggcaggcaatcccttctccccacccaccatactccccagccccactgcaccctaaataattaagctgaaagctaactgccctacctggatctgaagggcctgggctaaatcccaaactgtttcctcctaggagaagcctgctggagtctgggccacttctgaccttggggtttgctctgacttacagctggtggcagccaagtagcagggccaattgccctaacccctcctccccggtagtgggcctgttgcctcttagcattgccagtgtggcaccaagagacattgaacttctaccctcagagttccctcccttctcctgtttcttggctcacaacagttcttgcctttccacttgccaaacaggtatctactgccttcatgtaaagcatttgtgccctgcaaactaggggctgtggggtgagggctccgtgtagctggtttcaggcactgagaaagatccaccctggcagagcttgaaactccacgccctctcctcgttcacatgctgtggcgtggctgagcctcccgggatgggttgtgtaaaaggtggggtgggggctgtgccatttgtgttcccaggccctggacatggagacacagggagcctgaagtgggtgagagggtcaaggagttccgcaaagagtagacttagtggttacgaggttgggcagagaaagaggtcagaaacagcaacacggaggtttctaggagttaaccaacagtgaacattgaattcagagcttagcccttcctcacttttctctaggatcaaaaactagcttctggctaatggtccattcattgactgattttttttcactcattcatttattcattcatctagtcaagcaagtctcttcctttttccgtaaatacaatgtatactttatacattgttttatcctagtcccttagctggaaatatctgttcctgtccttttcttccttttcactttttataattcctgctcaaatcttagtttaaggtttagcttgggtttagattaaagcttaacttaagggccacctcccttttgaagccttcccctatctccaaattaattaccccattttttctctttttcttttttctgtgttttttttttctcctgagacctagtctcgctctgttgcccaggctagagtgcagtggagtgatcatggctcactgcagcctcgacctcctgggatcaagcgatcctctggcctcagcctcctaaagtgttaggattacaggcatgagccaccatgcccttttgagatgtagtctcgcttagtcatccaggctggagtgcagtggcgcgatctcggctcactgcaacctctgcctcccaggtgctagcgattcttctgcctcaccctcccgagaagctgggattacaggcacccaccaccatgcccagctaatttttgtattttttgtagagacaggttttcgccatgttggccagtctggtcttgagctcctgacttcaagtgatccacccgcctcagcctcccaaagtgctgggattacaggcgtgagccaccacacctggcctctttttaactttcattctaacacttactttactctgcctcacattatgtggagtttttaatagatgtctgtttactccactagagcaaagttctctatagtcagcaagtatatctttatcactcttttaaaaacattagtgtttaggctgggcgcggtggctcactcctgtaatcccagcactggccagcctggcgaaaccctgtctctactaaaaatacaaaaattggccaggtgtggtggcacgcacctataatcccatctactcaggtggctgaagcaggagaatcacttgaacccgcgaggcggaagttgcagtgagccgagatcgcaccacttcacttcagcctgggcaaaagagcgaaactccgtctcaaaaaaaaaaaaaaaaaaattggtgttttgttagataatctgggttcatctttcaaaattcagaaaatacagacctgtaaagaggaaaaggaagactcctataattccatcattcaaaagcaatcactgttaactgaatttattgttttagacttttttcttgcatttatgtaaacctgacttttcagaattaggatttatactgtatacgatgttttgtgactgatatcagcatttagagccatacagagaatgtttttcattatgcttaagaactacataatgttccattgtgtgggtgtacaaagttgatccagttctctacatttgggcatttaggttattttcaatagtttgcattcaatagaacatattcttacaaataaaatctgtccatgtatccaaggatagttccatttgttttaagttttgattttatcactattacatcactataccaaatatcccccaaaagattataccagtaaatgtcttttaaaatataataataaataccagccgggtgcagttgctcacacctataatcccagcactttgggaggccgaggcaggcagatcacttaaggtcaggagtttgagaccagccttggtaacatggcaaaacccttctctactaaaaatacaaaaattagccggtcatgatggcggccacctgtagtcccagctactcaggaggctgaggcaggagaatagcttgaacccaggaggtggaggttgcagtgagctgagattgcaccactgcactccatcctgggcgacagagcaacgctctgtctcaaaagtaataataataaatatcatctccacactctgcatgcttgacattttcccatttttacaatgattccataggcataggttttatgaccataatcagatgagtaaactgaggtttgaggggttaagtaacctatcttaagtttatatagtgggtgaggggtggaactaggatttaaactcaggtggttctgctatagtatttttttcccattgtattacactatttttctatatcaaattgggtttccccacaaaatctaggtggaccaacttctgaatgtaaacattgctggctcagtcccctttgtctcacaggagtcaggcatcccctccctttgtcaggggtgtgtgtgtgtgtgtgtgtgtgtgtgtgtgtgtgtgtgtgtgtgtgtgtgtgtttgcttgcagtaatatctcctgtggcattctgtagagaggttacacatcagtcacaggtctgtgaactgccttaatgaacaaggttccctagcctagaataatcaatggaacaaaatccccatggacgctgccatttccactgttgccaaagacctacatggagaaggttcccaaggtgtcagatccgacacctgagttttctttataggtcacagttagcctagaatgtgtggtatgggtattgcctggacgcataaactagattgcttctaatatggatgtggtccaacaatctctgatgaatggaagtaaacatatcaaaagcttcagaggctgggacattaacatttttttgaggctactagtgttttttataaataatgaagaagggccaggcgcagtggctcacacctgtaatcccagcactttgggaggccgaggtgggcagatagagtgagctcagaagacccgcttgggcaacatggcataaaccccatctctacaaaaaatacaaaaaattacctgggcgtggtggtgggcgcctgtaatcccagctactcgggaggctaaggtaggaggatcacctaggcctggtgtggtgggtcacacctgtaatcctagcacttttgggggccaaggtgggctgattgcctgagctcaggagttcgagaccagcctgggcaacacggtgaaaccccgtttctactaaaatacaaaaaactagccgggtgtggtggcgggcgcctgtaatcccaagtactcgggaggctgaggcgggagaatcgcttgaaccagggagtcagaggttgcaatgagccgagattgtgccactgcactgcagcctggctacatagcaagacttcctctttaaaaaaaaaaaaaaaaaaaaaaaggtgggagagggctgagtcagtttgccttggaggcatgggggaggagaaggatgtgaacagggaagtgatctaagagcttccctaggaaggaaggacacccttttcctggaatgctctcctgctctgccacagctttcagtcaattatcactgcctttagaatgcttatcagcactccagcccttcagaagtgtccttctcctcctctggtgtcaaactccagagtttacttttggaattaaggtttattttccttaggttttaggaagtagcttttgaaccttagaagagtcagtttcctttactaactactgaatgaagttaggcattcaaaacttgggtagtcatgatttgaagtgtcacttgcggccaggcacagtggctcacctgtaatcccagcattttgggaggttgaggcgggcagatcacctgaagtcaggagttcaagcccagcctggccaacatagtgtctctactaaaaatattaaaaaaaaaaaaaaataaccgggcgtgatggcaggcgcctgtaatcccagctactctggaggctgagacaggagaagcacttgaatccaggaggcggaggttgcagtgagccaagattgcaccattgcactccagcctgggcaacagagtgagactccgttccccaaaaaatgaaatgtcaatttcattgagactgtatgaatgcctgacatgcacttgaaagtgatgtttattttataattttagcccttcttcactaccccaaactcccagtgcatttaaaaaatttattggcctagccattctcatggggtaatatatcatgaccatcaaaagatgacactaaagtgaatcctccatgtatagctgggctttctgccagccttagattctggagaagcaccccaggccagggagaacgggtgaagaggagaagcatttattgaaggtgctggtagccggagccctgagaccaacacagaatcgttttttctgaaggacaactcaaggacagttgagggctcttcacttccctcacatcagagggagctttgtgctcacgatgggcacggaaagggatgccagtaagcgatgcccctctatcatctcacaagacccaggtgaaacaggacattggttagggctgggacagggtcagtcagccttctcattttacagtggaggaagctgaggcttgagaggggaggtgacttgcctgaggtcacacagtaagtgatcagctgtcatctgagtgatttcttcaggtactctctctggctggacccagccagtgacaactacctgtggctcaagctgagtttgggactaaatggttttacaaggacctcaaagtatactctctctcttctagtaggacatggggaatactgactttgctgagagtaagggctcttttcccaggattgttctagatccccagatcactggaaccctgagcatagatactaggctttagcttcctggctaccacagagccacacactctcaggtagaaaaatccctaaactggctgggcatggtggctcatgccagtaatcccagcacttttggaggcccaggcaggtggatcacctgacgtcaggagttcaagaccagcctggccaacatggtaaaaccctgtctctacaaaaaaaaaaaaaaaatttagccacgcgtggtggcaagtgcctatactcccagctgcttggggggctgaggtggggggatcacttgagccagggaggtggaggctgcagtgagctgaaatcatggcactgttctttagcctgggctacagaatgagaccctgtctcaaagaaaaaaaaaaaaaaacccgaaccatgtttttaatttcttaaaactgagagtactaaatgctcaacgttcatgttgtgtgcataaaagtgagactgaaggatgaatgtgtggggtatggatagatgggatgtgaatgaagcagtctctgggtccaagctctcctggaaattcgtggaacagaccagtggtcccagatttttagatttcataggccagtaaaatttccctccagatttttggaaccaacaaaggatcatcaacttttttgccaagtaagaacgtttttaataaactaatgctgcctgctaccattaccacctgattcttttttttttttttttttttttttttgagacagtttcattcttgttgcccaggctggggtgcaatggtgcgatctcagctcactgcaacctccacctcctgagttcacgcagttctcctgcctcagcctcctgagtaggtgggattacaggcattcgccaccacacctggctcattttgtatttttagtagacacggggtttctccatgttggtcaggctggtctcgaactcctgacctcatgtgatccgcccacctcagcttcccaaagtgctgggtttacaggcgtgagccaccgagcccagcgccatctaattcttttgttgtggtaaaatatatgtaacataaaattaaccattttaactatttttatttttttaagttaaattgattatgtaatgtttttgagacagggtcacactttgtcacccaggctggagtgcagtgttgctatctcagctcactgcagcctcgacctcccgggctcaagagatcctcccacctcagcctcccaagtagctgggaccacaggtgcacgctaccatgcctggctaattttgtttttcttttttttttttttttgtagagatgaggtctcactttgttgctcaggctgatctctaacccctggactcaaacaatcctctcacctcagcctcccgaagtattggagttaagagatgtgagccactgtgcccggccaatttttaaatttgtaattgatgcataatggttatgtataatcgtcgggtacggtatgatgttttgatccacgcacacattatgtaacgaccaaatcatggtaattgctgtattgtatccatcactttaaatatttatcatttctttgtggtgcattttcaccaattttaagtgcacagttttgtagcataaaatttattcacgctgtgtagccatcaccaccatccatttcaccttccctgacaccttacctgttcaacgctaactcccccttctcccctcttccagccccttggtaaccactattctacagcttttcattttcaaaggatgttttattgtctttagtctcatcgtgtgaaaccttaagagaatttctttacggtggagaaaaagtaactttatgaagcccattcctttctctactctggagaggctggtgacccagccccaccattgcaggaatgagacgggattgcggggatatggcaggcacttggggtgctgagagtccaggtgaactgtgagctcaagcacccatgtcgggcttgggggaccagaagacacatcctgaaacagctgaagcctctactaattcatcagcaagtttagggagcggcaacttttccctgcccagctgctggcgtttccttccccatacaatttctgctgagtttgggggaggggaggttgttcgagaggccccagctgggagaggtggggggagggcgatacattcttttccttaaggaacctgaccgaactttaaggtcagagctcagtggagagtgggagctgcagggttacctctttgccgttgattcatctctccaccctcccccactcttaatgatctttccattacagaacccagaccaggaagtgcatgacaggtcgcagctgcagacacatggctgggaggcctgggctccgggccagtggtgggagagtctgagctcccctccagcagtgggacccctgcacacacacacacacacacacacacacacacaccactttaacaacttggtggaagatgttctttcttatgcactgtcacaggtgatgacgagttggactttgctttgagtttaggatgtgatttatattataataaaggcaggagaagacactccccctgccccggtccaacctgagtgtttagatccccccaacttacagtccacctaagtggtccttaccagatcctgggagctttctattatcgtgcagatgccccaacttcttttcccaaaataggacccacccaatatggccttagaagcttcccagggtatccggggcagttgctagtcacagtcttaatgtctccgaaatagtatgttttcctctctatgtttctattaaaatgtcagccccaaaacatgtttctgggtggaggtctaggtgcaacagcacagcctttgcaaacacagatagacttgggttcaagtcataatagatgagttgagcctttcatttttcagtcttcattggggatggctctttccatttgcaagttgttcaggaaatgttaattgaccctaaactgtgtcctagggggcagttgtcacacaggagtttctgtcttcaccaccagctgtgtccttggcttccttccctgaatctgccaaggctggattctggtgctaaatgtgaaatggtgacacaaacttctaggaactgtgagcttggacggccctcctccatagccgcagggcatctacctttgctcttcttggatgagtgaatgaacttccctctttccagagcaatgctttcttcctgtttagataggagggagagaagcaaagtgtattgggaataggttgagcgaaagagtgtagtaagagttttctgtacagctctgtccttaatgtatcagtaaacaatagggtgagaacttttgctggggagagaggaaggagggaaatttcttttcagacaactcttgggtgcattcctttgttaatcacttaattacagcccttctcccagtgaggtagtgaactccccattgtgagaggtagggaggaggtgggggacactggtgctgattggagaaaggtggcaaaatccctaggggaaaaaagtacagatttgaaggaggcatcagatgaatccgtgcatagaagcttgagccccaaactcagttctcaggctgcgttatcctttacgacacccagagtccctctgtcttttaagatccacacacaactctccaggccaatagctcttggcgcctgcgattcccaagtgggattctacacgtgtcttgctgcccagctcggggggatctgtttttggggggtctcggggcgggtgcagggtcctggctgtggctttggctagtgcaggcggctcggcactaaattacagtgacgaggtgggacgcacaaaaggccgaaatctttttttaataaaaacaaaacaaaactctgggccccaagcccctgggctgctgaatggccatggcttcctgtcaggattagccgggctgcctgggcctgtgtgctcggcctttctcctcaggaaatacctttagtaagccccggtggggtccccatggcaacgcacggggggacctgctggcagaggccattcagtctgccattgtcccccggcccctttgttgtgagctttattgccggccctctggcaaacacagcagtttgcaccgttttgtcaggctgaatgtggagtttttacattttaatgggctcttctggcagtggcccatttgcatgcaaaatgtcccctcttactcttttcactttcttcaatttaaaaaaaaaaaaaaagcccttctccaaatcccctgggtcggggggctggtggacgccattggccctgggtgtcaggccctgctaattgatttggtgctcccggctctctttccacacatacctgtgccccccatttttgcagctctccttctatttggggactccgagagttgagagaaacacatttttggggctctctccacccaaacccttgtaggatggcagctgtgacccgggatttcggtgagatgcttctgcactctggccgggtcctgccagccgaaggtaagttttcagttccatttcaaagccaaaatacgtaataaaaaaacctctgcagagggcccccggagccccgctgcgctgttctgtgctccttttaagttgctttcaaagccaccccgagttcctcccccacccacaattgccccctcatttatctctggggagtttataccaagactgtaaacattcctggaccaccagtttcccccatgttgctgaggagtttagcctttctctcctaattttcttaactcagaaatcaaaaagatggaatagggatgatagaaattgctaccctgagacatcatgctcatggaggatgcctggattttgttgggggccagttatccaagccctaagccctttggagtgtagaacgtagagtaggtaatacaaatacctactgtcagcccagcaccccagcaacatgagtaagtgcaagacacaggcatgaacattttcagctctagggaaaggcacattcatgttggggagaggtggagaatgcagtttggccagtctcagaagagtgagttttaaggcctaggaaagtgatggagatgattgcttgttggagagagagaaggagaaaggcatttaggggaagaaaaggaaaatgaaaggagcagtgaggatattggctccactggggaggtggaactggggtagtggccgaaccaggggtgggagaggacgtggttgagaggctccagaccagctggggctgtcatggagtgttgggggtctggagcagtcaggacttgaaagccgggacccttgtgagccctgtgcagtcctgaggatgtggcccaagggggagggcggaccagctcttttgcctcgtgttcttaatcttctcagtgggtcatcaggggtcatcagctgtaagctgtaatcaacggtgaggggctcgagaagagaaggtgtcaggtgactgctggggattgagctgaggacaggagaggcagggtgctgtctcctgtggcccaggcagagcggcacagacctggagtgggccacccctcatcaccccatgtgctgcgacagtgctggctggactgaaccctggaagagtacctggacacagtggaggggccaggacccagcagatgcagcctctagagcttgtccctgttttgtgactttgggagccatttttccatgtttaaatgggaaggaacacaagtcacctggtcacaaggaagcaggccctatgaaatattaagtgcaatgccaaaacagggcattgttactggtcttgagtctgccacaatcacaatgaacacctcccccattttctcacctgccacatttggacagccgagcctgctggactcgcaggggcaggagagtgcattttataattaaaagcactcaactgtaaggtaatgattgatatgagctatgggcttgaggaaatgagggaaggaggggaggataaggccaaagcaaccaacttcagaatctcacgggaggaggtaggatgcagggggtgccattagacagaatcaaagggctgaaccagaagggcttcctcacctggggaagtcaagacactgtgaagattgaggctgccttgcacagcggtaaagctggactctggatgtatgatgtatgtggattctggagaaccaggctacctgtgtttgaatcccagctctgccacttaacaacctagctgggccatcttggactaatcccaaatctttctgtgccccagtttccccctctgaagataataattcctttttttttttttttttgagacggagtctgggtctgtcacccaggctggagtgcagtggtgtgatttcggttcactgcaacctctgcctcctaggttcaagtgattctcctgcctcagcctcctcagtagctgggattacaggcgtgcatcaccacgcctggctaattttttgtatttttagtagaaatagggtttcaccatgttggccaggctggtctcaaactcctgatctcaggtgatccacccacttcggcctcccaaagtgctaggattacaggcattagccactgcactgggcccgaagataataattctaactcttaaatacttcacaagattctaagttaacacatgctgagaactatgctggtatgtagtaagcctccgcatccataggatagaaatcatagtaggatcaacctcataagtttcctatgaggatgaaatgggagggtctgtgttaaaagctttgtgcagcctatgggatatagtgagcgtgctggaaatattggccagtagtagtattgctgtttactcagatgtttatggatccctagataatatatgggaaggcacatggtaaattacaaagtgctatgcaaatgtgttgttattcttcactgggttcctgttaagttgtggggtttggggatggataacttccagaccagagtggctgctgtgggaccgggctggtgaagcggtatttcaaaatacattttcaggtgtgtttgtccatgtggcatgaatgccctgcattcatagtctctgcagagaggtgtgttccctgggatatctttggtggctctgttctatccctcaacttacaaattgaaatcattatttgttactgttttctcccatgaaccttctgttcctggccagctgtacagcctggcctcatctcccactgcccctcagaccagggtacagccatgcctgtaagcacttcattctcttctgttccccccagacatttcacttctcatctaaatcctctcttttcccttccccgtcattttgtccaacctctgctctcactgctgatacttttctttatgtttcatgacgtcagagcctgtgctagacctgcctgtacttggtcctgacattctccatttgtctcatgttgcagtataaaatcttaatccatattaaggtgctgtgcaaatctgagcacccctgttagggcaagacatatgccttctgggcctttgtttcacccatttctccttgcacagtgacaagggctcccagagtcacctaatggtagctatgttgatgaaagttccctgactcctccttggatttttgagaactggggtctcatcttgtcataagaatagcaaggtttgtatgggtttgggtctctgatggttcccatgactggtggaagacacagatttagaatcaagaattgggaggccgaggtgggtggatcacttaagttcaggagttcaagaccagcctggccaacatggcaaaactccatctctactaaaaatacaaaattagccgggcgtggtggcgcttgtctatagtcccagctactcgggactgaggcacgagaatcacttgaacctgggaggcggaagttgcagtgagccaagatcccagaactgccttctaaatgactgtgggagatttttgtccagtcctgctagaagcaaaatgctgtacctgttggcttgttggaagtacaagcctgcagtatttggggggaaagtaggaagggaagagggattcagtagggcctcattatcattaatcgtgttcctgaacttgaaagcaccatgggaaaatcccctcccacccctgcctctgtcctttctagctgcttccttgaggattatcaaaaagtgtgggtctccggtgggctcctaattccttcttaggggatagagacaccttagagaagcagggtaggtttgatgtatgaatccttgtcactcgcactaaaaggagcactggttgcagcctgcacaaattcccaaggtccacccgccagctgctttgacccaggaacctgcgtggtaatgagatcagcagcctgagttctcgaacgatgttcaaggcaaaccctaaccctgaccttcccactcctgttgatgagaacggtgactccattctattggcatcaaagcataaggccccttttttttcacaatgcactttttttgttgttgttgagacagtgtctctgttgcccaggctggagtgcagtggcaagattatagctcctgcagccttgagttcctgggctcaagggatcctccctcctctgcctcccaagtgcctggggactacaggcatgcaccactatgcctggctaatttttttatttttcgcagagacagggtctcactatgttgccagggctggttttgaactcctggcctcaagcagtcctcccaccttggcctcccaaagggctgggattacaggcatgagccactgcacccagtccgcaatgcactgttaacacatggcacctagagcctgtaatagtgaacagccagtctttttcagcctcaggctaggtcaccagggaatccagataccagatgccctccagcctccattccccacctcatctctcaggaaacagatgcacaaagcaagtgttttggtgctgcttccctcacagcatccccatgtgcattttgaggacaacctttgtatctgattccaattaatcaggttctccaggagttggaatgttggtttcaagtgactgaacaataaagtggctttcttcatctttcttggccagtccaataaaagtgtcaggtagcttttctcttgctaatggacacctaacgacaccctggcctgttggtcttgaccagagaaaggccagctcagggcagctggagctgaagaggcaaggacctttctaatgaggacataagtgagggacactggaaagaccaaaagagaatggaaagtactgacatggtagttgcagggtgctagtgagcagtcatgcccccaaatcagccaccttacatagaactccccaagttcagggccactggatggggttgtgacgcagtcaagcagggcccagaaagcatacaagcagttggtttcatctcctgtaagaaagtggcatcatccctgctttgtaaacggagaacctgacacacaccaagagcactcctagccgtggaaaaaagccgctagaacccgaggttagtctgatttttggttcctctgaaaattagcttttgctggatgctagattcagttctggacttactgagtagtctctgggtttttgacattgttaggcactgtgggaaaattataacaggtacgtctgcgctgagttgcttgctaattcctaggagagacttggacattttggacaattaagaagcaatacaggccaggcacggtggctcacgtctgtaatcccagcactttgggaggctgaggcgggtggctcatctgaggtcaggagttcgagaccagcctgaccagcatggtgaaaccccatctctactaaaaatacaaaattagccaggcgtggtggcacatgcctgtaataatcccagctactcgggaggctgaggcaggagaattgcttgaactggggaggcaaaggttgcagtgatccgagatcacgccattgcactccagcctgggcaacaagagtgaaattctgtctcaaaaaaacaaacaaacaaaaagaagcaatacagctctttgagaaagatgcagtcataagtggtgcagagttgcagtctgcccattcctgctcctcactcatcgctgttccgaacaagtcagccaggaagccgcactgcaccaaggcttttaaagataccagaaaacacctgtgaagctggaggtgaccattcaccaaattcgaatccctctaatgatccgcagcgtaaaatccctggagaaggtgtgtgctgacttgattcagaggaggaaaggaaaagaatgtctaagtgaagggaccagtttgaatgcctgccaagactttgagaatcactataagaaaatctccttgtggtgaaggttcagagacatgggatcgtttccagatgagaatccacaagctacccactgacttgcacagtccttctgagattgttaagcagttgacttccatcagtgttgagccaggaattgaggtggaagtcaccattgcagatgctcaaagtcaactattttaataaactgattagcggttgttataaaaaaaaaaaaaaaaagcagcagcaatatgggttgagcgcagcggctcacacctgtaatcccaacactttgggaggtcaaggtgggtgggttgcttgagtccaggagttcaagaccagcctgggcaacatttgaaattttaacttattttttaaaaaagaaagaaacattatacccaatatctgtcaattgatgactgcaatgtggtatgtctacacaattgaatattattaggtcattaaaaggaacaaagtgctgattctatgctataacatggaggaagtttgaacacatgctaagtgaaagaagccagtcacaaaagatcacatattgtatgattccattgatatgaaatatctagaatagccaaatccatagacagaaagcagattagtggttgcttagactggggataggggatggaggagtgactactatgggtcaggcattttttgaggggcgagggatggtaaaaatgttctaaagtgagattgtggtgaatgattgcacaactctgaatatacaaaaaccattaaatggatgaatattacagcatgtgaattacctgtctgctgtttaaataaaatagaaacaatacaaaatggaatgtaattgagtgtgaatttgtgtgattcaggcggtaactgttttacagaaaattagagatgagacattgatataaacaaggcttcctagtttcttgttttgttttaagacagggtctggctgggtgcggtggctcacacctgtaatcccagcacttgctaactgaagatgcaaggaccgaggcgggcagatcacttaaggtctggagttcaaggacagcctggctaacatggtgaaaccccatctctactaaaatgcaaaaataagccagccattgtggcatatgcctgtagtcccagctgctccagaggctgaagtgggaaaatggcttgaacctgggaggcagaagttgcagcaagccaagattgtgccactgcactccagactgggcaacaaagcaactctgtcttaaaaaaaaaaaagggtctttgtcatcccgtccagtggcatgatcatagctcaccgtagcctccaactcctgggctcaagcaatcctgtctcagcccactgagtagctgggactacaggcatgtgccaccaagtctggctagtttttaaatttttttgtagagacgaggtctcactatgttgcctaggctggtcttgaactcctgggctcaaatgagcctcctgcctcagcctccccaagtgctgggattgcaggcataagccactgcacccagcccctggacgttttggatggtggactttgagtagtttggggtaggaggactctggagtggcgctgacagtcctcaggaaggagtaagctttgccatgccagggaggatgcagccgtgctgaaagcatcccaactggggaggggggggggcgcggtggggagggacagcccctggtagagagaatggggctgggtggagagagtggaagccaattgcagggagtcttgaaggtgaggcagggatgtggattttactctgtacacagggtagattttgatcaggaaaataatgtcaagcacatgacagcttggaagcaggagtctgagctgcagccccagggaggccatttaaaagattatcccggctgggcgccatggctcatgccagcactttgggaggccgaggcaggcagatcacgaggtcaggagctttagaccagcctgaccaacattccccttctctactaaaaatacaaaaattagctgggcatggtggcgcatgcctgtaatcccagcaactcaggaggctgaggcaggagaatcacttgaacccgggaggcagaggttgcagtgagccgagatcgcagcacttcactccagcctgggcgaaagagcaaaactccatctcaaaaaaaaaaaaaaaaaaaatttatcccgagatggttccggtaaagggataggacagagcatacctgagccacgtttggaagggaaccggggtctaaacttgcatcaggaggaaagcgagctggttcttgaggcttttacagatcacgtatagtggagttttgtttgcacgttctggttgggacgggcaggaagttacggatccaagctggtatcagctagagcgggtctcaccagggccagtgttcctttgctgcattctcttggggggaaataaatgcctgggggttctctttgctacatttttgtctttgggagctgcttttttctctgggatcggctgcaataggccttgtgatgccagagggtaagaattcaagtttactcttgaccaatgggttgcacagatcacaagctgcaaaatatttaatcaccgaggtcatttgagggaaatgagatttgcatcaatagaagtgtctgctctgttcccttaagagttgagtctaaactgcttttctccttaccttcgtttggcaaaaccacagaccattaaaaatggaaagaataactttttctaaggcccacaaaagcttatttttaatcagttgtgtggtctactcacctttgtggtgttccccttgaccggactcacaaaaataaacgtgtgcaagcctagtggtttctgagcccttttaaagcagtacccctgtttctgacaactcttatttaagataaagcccatgggtcaatgcaggactgggtctgcaaccttggcccccccaagagaaaccactgtcagtccctgtcagttgctgatcatgatgcgcgggacacccattttcatttttaaggtttctagcggaagcctgttgagcacttgaggaagaccgtgtttcaaataagggggagtgaaagagaaaagggagagtagaaaggaaggcagtgaagagccagagtgactgcacgtgtggtatttattgagcaagcatttcttgagcaactcctgggcgccaggcatcgtagtaggtgctggggatttaaaggtaccgatgacacatcaccgcactcaggttcagaaagaggactgcccttcagtgtgacaggtgccaggagggggagggcacctaacccagactgggagtcagcaccgccctggaggagaagtcaccagctaggctgagacagaagagtgagtagtgagagctggacagaaaaaaatcaggggccctgtggccactggggcagccgtgagccacagcaggggctgagggagaacatgctgtttcagagccttatgcatcggggagcggcagtcgctccactgagtctcttagggtgaacaaatggtgagaaaagtcctctccaaggctgtgggcgggatgtgggtggtaggtgagaggtggaagatgccaggagtacatttgaacatcctaaaaggaaatagaaagttcatttcccctcgtgagtgcagaggggtgtgctcaggagatgggtaacagcccaggatggtgaactcaggtgtgtccgggccacgggccttcttgaacgcgtgcgggaagaggcactggtcaggggagggacaggtgctcttggtggtatcagatcttgtgaggtgcagacaccccggtgggtccagtgctcccacccagggacagagaaggatggggcacggggagggagagtggatggtggggggcctgagggtgtgcccagtcagagggctgaggagaaaggacctttgtgtgcgacagctcctgctgccagagcaagtgtgggttttatggcagctgtggcctcccgtcctaatatagtcaacagctccaaatcccctgccctgacacctgttagcgagaggttccctgagctgacctctccttgggctgcccccccagcatgtgcatctgacgcgtcgagggccagacccccaccctctccgaatcacacgcatcctggtcagcccccagttgacaaattgccttctctcgacttgggcaggggctgctggggttttgaggggcggggtttgttcagctgttgctagggaagggtgaggctgagctatcccaaaggaaatggggtgttcctctggcaagtggcaatcttggcaaagaactgagcatctggggagggggcaactccggacacaaagaagtcctggggagggccgacctttccccttaggatgggggaaatgaaatgtgatccgcttaatgctgctacagctgcttcctaactttgcctctttcttcctttgacttttggaggagtggggtggaaaagagatgggggttcccaggcagccagctgttttccccactgacccatgctccaattcccactgccctggctcagtagcctccagtaagtgatgcccaggatggtgcggctccgtgtggccagcgtaattccctttgtctctcccctcctcccctctccctgtcttcctctctcgccccttggcttcccttcccggccccgtggtggctgcagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcaggttggtagccaagccctgcccttgcccctccctagacccaccccctccagccctctctgccagtttcagaggaaggtgaacctcctccccctccgtgatctgcccccactctgcttcagaaactgctgcccactaacattgctccctgcctgccgcgtggcttggctctcagagaggtgactaggtggggtgggccccagggccggagatctggggcttccaggacacacctcggaggtgattgccagggctcttgggatgttaagaccctgtgatttttttccaccacagcttgcccagatctccaggaggctaagtggtgctcggccagcttccactccatcactcccttgccatttggacttggtactcggcttagtgattagaggccctgaacaggtggtggtatccctgctctgctggagaggaacccaggtgcaccgcaagggagctgtgcgagggcagccagggagccctggagctctgtgaacttgggaacttgccactcttagaatgtgactttcacaaaactaggagttgaggaagtggagctgaaattttctttatgccatttatgcacctcagggtgtggacttggcagcagatccccaaaggtgataggaaggactggagaaagatctggcatgaaccctgatgggtgaccacatgtgtatcaagcgtgttcttacaagaaataaatacttattggggagaggtgttggcagctgctggggtggtgggtgccctatctgctctgattaaggagggcagcccccaaaccttagtagacacatgctagaaaaattctgactgtggggtgtttagcccatcctttggaaatagcatctagccacagtgtgtctagacctgcctgggtttccctatagtcagccgtccaaagaagaatacaggttgcctggctccagcacacccaggtggcaccacaagttgagaaagcgcctttgaatgtaggacggaattaagttaaataggaacagctgaccctgatggaaccacccagtgtgaaggcttccaggcagtgggggcagtgcttcggggaaggaagcaaacacgcacaggaactgttcttaaacagtttccatcccaccaagagatcatcactaagggagcagtgggactgggatccccatggggagggtgtccgtgttcatctggaactgcactagccttggtgaaatctaggggtccctaggaggaacctcagtgccccttcttcttcccatagatgctctcccctcctcggaggatgatgatgatgatgatgactcctcttcagaggagaaagaaacagataacaccaaaccaaaccgtatgcgtgagacactgtttcctatcttactgccctttgggtctgggcattgggtttaagaggggaggggaaggctgaaaggggaggaagaggagggcacatggggtcacggtgcctgttctgctaagtgccaggcactgctcacaggtgttgggcagatgggcaagacacctccaggtcctggcctgggccctgctcctgagcctgaccagctgctcctctccaccctgcctgtctctcttggctttccccgggcagccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtacgtgtgtgtgcatgcgaaagttagagtaatgggaacaggggaggccgagttaggaagtcctgattacatgcttttcatttttttaagtaatactttccacctatacaggttattcattaaaatttttaaatacaaaaaaatgcaaataaagtttaaacatttcttcagtcttctttctgtaatatggtttttacatagttgatcacatcatgtatgtaatttccttgccttgtcatttgttaacatgagtcttttcctgatatatttcaagcatgaatatttgaaacataatttttcatgactgtataagattccattattttaaaatcccataatttggctgggcatggtggctcacgcctaaaatcctatcactttgggaggccgaggtgggcggattgcctgagctcaggagttcgagaccagcctgggcaacatggcgaaacctcctctgtactaaaaatacaaaaaattagccatgtgtggtggcaggctcctgtaatcccagctactggggaggctgaagcaggagattgcttgaacccaggagacagaggttgcagtgagctgagatcacgtcatttcactctagcctgggtgacagagtgagactctgtctccaaaaaacaacagaaaaagtcctataatttaatgaactattttgtgatattaggtattttctggtttttcaccataataaataatgttgcagtgaatctctgtcagcatttttttaagcgtgcttccttaggacagattgttacaagtgaaattactaacttaaagggtgtaagcattttttttttttttttagacggagtctcactctgtcacccaggctggagtgcagtggtgccatcttggctcactgcaagctccacctcccaggttcatgccattctcctgcctcagcctcccgagtacctgggatgtgcagccaccattcccagctaatttttgtatttttagtagagacggggtttccccatgttggccaggctggtcttgaactcatgacctcaagtgatctgtccgcctgggcctcccaaagagctgggattacaggcttgagccaccgcacccagccagaaatattttaaattaattcaccatgcactcactacatgcaagacaccatgctttaaatgctgcaagatagcgttcctgcccataaaaattttgcagtctgataggaggcaaatgtccatgagcagctaccgtaaaaagtagactgtgatcagtgctttggtaggcagagaggaaagggtgagcacagttctgaccagagactggactggaggagatggtttttgaaatgagctgtcaaggacagtgggggctggattcttagtgtaataggagaggtgcacagttgggaacattcttggtgtatttgggagtgtttgcagaaggcacatctgtccggatcacgaatgatcttgaacgtcacagtggagacttctggagtctttacaccccatctgccagcttgcagagtgtgaacgggctggtaggggggcaatccacgccttgtcctagccaaccctgcagcctggggccctgtgccaccaggctctgatatggagggcaggtgccacggggtgccgacattgtcatggggcctgcattttcctctggaccctcaatgtatccctttggcatttcccctcaggtccgttatgccacctggagcatcataatggactctgtggtgccctctgacaagggcaactacacctgcattgtggagaatgagtacggcagcatcaaccacacataccagctggatgtcgtgggtaagagggcagaggcagcaggaggaatgagtttagtgggaagagccaggcttggagaacacagccggggtgtccaggtttcttaggggcagagtcaggatagcgattggcacttcttggctttgtcaccttgagcaggtcacttctcccttttgagcctcacttttcttatctgtaaaatagagttaagatcagacagtaacacggtcaaagctggttgtcactgtgaaattgaaggtgctgttcagagtctgtcctgaaggaggcgttgttggagaggtgttaaatgtagcgtaataggagctgtcgcttaatgctagcaagatgccaggctccttaaatacctgccctgtaatgctcatggcacacctgcaaggtgggcagtattagtctagccctgcacaggagcacaggcgcataggctcagagaggtcagacaccttgctaatgcagaactgcacacctgtgccaacttcagggcatcacaggagactctgggaagaacattgagcctcttggagctattaccgcaaccttttccttctaggagttctgaaactcactccctagagatcattgggtacagaatctctcagccagtgttcttcttgattatgatgatatggtctaagaaggagattgtggccaggagcagtggcttatgagctccaggtggcatgatgggattactcacgcctgtgatcccatcactttaggaggccaaggctggaggattgcttgaggccaggagtgtgagaccagcctgggcaacacagtgagaccctgtctctataaaaaaatttaaaaattagcctagtgcagtgtcatgtacttgtagtaccagctgagttaactgaggctactgaggtgggaagatcacttgagcccaggaattcgaagctgcagtgagctatgatgacacccttgtgctccagcatgggtgacagagtgagaccctgcctttaaaaaaaaaaaaggtaaaaaggagattctgatccaagaggttggggtaagatctgagattccgcgtttctaacaagctcctaggggatgctggtagcactgctcgtggaccacactttgaatagcaggagtcaaagtgactctggttttttaaggaggagcaggttgtgctgaggtctgggggtgcaactgaattagaaggttctccattaaagcatgagcgacttactgtgactgtaaatatgatgactgccttggggaggaggatcctgatggcttagggcctgaagagagggtgtccctttccccagctctgttttgagaggcttgggctcagcagaagtgctgggaggtttacaacccatcactgggaaagccaagtggggcgcaggtgagcccacccctctttagccatggcaaggtccccatgacaagtgcctcctctcccatcttccacagagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaaggtaatcatggcaccagtcttcgtgggccagtctactgggaaggagaccactgtctcgggggctcaagttcctgtgggcaggctcagttgcccccgaatgggatcattcctcacgcttcaggcacacacactccatctcagtagggatctagccacatcccccaggactagtaacagaggtcacaaagtggaggtgagctgggaacagagggctgcagggatgggtggtgctggtctgtaataagctttgagagcaacgtcactggggctttggggtcagctacacaaggaaggcatttggacccctgccttttcattgcccgaaaccagagcctttccaccaagcgtttcccagtcttagccctgtgtcctgagttacgtacgatctttctggcaaatggggtgcatgataagagcatctcttacgaagagttggaaaaacaaatgccatatataaattctaagccatatgaggacgaggagtaatggcattttcttcctttttcctctcactcccagacattcattgtccctgaatgctccattaatccagggaaggtaattgcctaaatctccagtggatctcgcaacaggaaggaaccagaagctgggaaagttgtttacctctttgtcccagagttagacctcatcctcccctagcttagctgtctcagagatatactggccctcccttctcttctctttgctgctggtgctaaaactgctctgtaggtcattggccactgtctccactcacaacccctgctccagtcctggagggagtgggttaaacacaaatagaacattccatttgaagcagtgattctttttttttttttttttttttaatcaaatgctttggacttttgaagtccacttgttctgtacttgtaaaagggaaagaaggccgggcgcagtggctcacgcctgtaatcccagcactttagatcacttgaggtcaggagtttgagaccagcccggccaacatggtgaaaccccatctctactaaaaatacaaaaattagctgtgcatagtggttggcacctgtagtcccagctactcaggaggctgaggcaagctaactgcttgaacccagaaggcagaggttgcagtgagctgagatcacgccactgcactccagcctgggtgacagagtgagtgagactctgcgttaaaaaaaaaaaaaaaaaaaaaaactaaaagggaaaggtaataaatctcacttaacatctcccttcgctccctgggcctgcctgaaagttacacgggagcaacgtgcgtggccacatctcagctttgcccaactgactggtgtgtcgttggtttgttccagcattcggggattaatagctcggatgcggaggtgctgaccctgttcaatgtgacagaggcccagagcggggagtatgtgtgtaaggtttccaattatattggtgaagctaaccagtctgcgtggctcactgtcaccagacctgtggcaaaaggtaatggggagatggatgggaccctgtgctggggatttgatgtaggccccaagctgctggggcaggcggggaagccagtactggactgtccttgccaccctactgtatttctagtgcccagagccatggaaaaatacccggcctgggaggctggtttggtttggtattgtgttggtgtctgtgggttccctctctgccttctgtgtgttccttggctttgtgtggatccatgtgaggactcacggggacacggttttgctgtgttacaaatggtacttcagactgaagttgtgagtgagtggtgattaagagaaggggccataggccaggcacagtggctcacgcctgtcatcccagcactttgggaggctgaggtgggaggatcgcttgaagccaggagtttgagaccagcctgggcaacatagcaagaccccatctctacaaattaaataaattagccaagtatggtggcgtgtgcctgtagtcccagctagtctgaaggctgaggcaggaggattgcctgagcttaggtcgaggctgcagtgagctatgtttatgccactgcaccccagcctgggttgacagaatggtaccccatctcttaaaaaagagagagaaggggttaggcattcccttgcatactcgcatctgctggctgtgtatgcacatgtgcgtgtgtgtatgcgtgtgcatgtgtgtgtctgcagcccccgccatccctcctgtgttcaccttctggctatctttacctgaaaccaaacagcccctgcccgccggccccatttctccatgccgctcaccgcccgcatgctcggatgggccagtggctgccagcatctggtgaagggtcgtaaccagccatcgtcttctcaggtctgccggagttcttccctcagggtctcaccctcttcctctaacaggttttgctgcctggtggttttcgtttgttccttgttgcaaagaagatgtcagggagcatttcttcctctagtcccccttctttctgtctccttcccttgctctgcgtctcttagaggtctcatgtcctgtgcttgtccattttgcttccgttgtctcttctagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaaggtacacactgtaacttctcctctcgatgtcctgccctcgccacgggcacggggggagcatgcatttccaggcttggggagacacagaggcaggagagctggaagaatgggctcctgcctgcctggtgccacatcctgccccagctttgagggctgaatcctctcagctcagagaagagcttccctagttttgcaggcgcacggaggcctcccacccgtacacctgcctctgctctccccctggccattgcaatgcatgcccgggatctgggtttaccctgcagcccgactcctccagggcaggctccttccgtccttgggtccagcagcctcccccctccgctgggtactgagcatctgaaaagtctcagatagggccctacacctcttctcccttctcaagtgctcagcccaggggtggggcttgctgcttgcaaagagcagcccaccctcctgtactgccatcctattgcctttgaagaaggaggtcagcctggacaggtgaactgagttgccttcagaaaggcctgtctcaggcagccgcagcaggcttcacgatgtccatgtatcctgtttgcctgctgccgtctctcctctcccaagaggggaggtctgcgtgttgagccagggaggaaggagcctgcagcctgctcagggtggtggctggtgactgcggggccagggcttgctgctgtctctcggaatgtcctgcatgtgggtctggctgttcctgctggcactgccctcttctctctcccctcctttcccactctgccctgcttgcccgtcagggtctccggatgcccctgctggaggcagagaagcgttctgtttttatcatcgtccctgtcttggtcctgtccgtgctccccatgtgctcccaatcagttgtcttcgttcctcaacatcagggaaagaaaaaacagcaacacttctccctgtcatcagctctgctgtctccttgtcaggccttgggacgttctctgggctcagtctagggtcgtgcctcatgcctcatgcctctctgggaaggttcccaggggcgccgcctccatggttggctggtgggttttaaaggggaaggttgggaggaggcctgtggaaggaggagggccgtccacacccgtggggcaaagcgtgttccatgaaaccagtgctgtgcgtgctgggatgaaagcctcccagcctctcgtgctgaagggaaaggtggaccgaactggcttagctgctgtggcaatggggtggggggtgagtcctaatcagaaggtgggagaagagaataacaaaatggaactccgccccctgccgccacatttccttaagttttaggagttggggcctatgagtagaatttgaaagaactaccaaaaaagcttatttttggaaattaagtcagctttgcctgtggtttggctaggaataaatatttacctgtgtgcccctacagagatgacacagacccaaagtgggacattgagcaaggcacaggctggttcccctcctgtcctctgtcctcattctgtgagtgccaccatcaccaggtactgtggcctgcagaaataaacgaggcaccaaccctgccctcagggaccccgtgtcttcttagggacagaggactcagaaacatctgtgtccccgcatgttaagtgcatgcacacagtgctgaggctttgcagagaagggccatggctccctgaggagaccaagaaaggcacatagaagtgacttctcagctggcccttgcaggatccctgggtgcctgtacctctccagtccagctgagcaaggaggctcaggaattaatgaagatggggcttgtgtagcacgatggttctaggccatcccttttccatggctcaagtccattgaaggcagcctccaaaatcagggggttgcctgatcctcctagtgccacaatcccagtcctagctagaacttgccatggttcttctccctaaaagttcccaggggacaggagacaggtgttgcttttctaatggagcgggacctcgcatggacggggccctccaagcctgctaacaccctgttcgcactgactcagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtagatgggggatttgcacactcagcaccacctctctctctgggcctctaatgccctgccctctccattgtccctaatttatagctttgggccttattttctggcttctgggcaaggcacagtggaatatcatgaactaagtgctctagagtctgtttcaagctagtgtagcccgtgaatttcctgcaccctccatatcacactgcaagtcctccggactcctgggacatggattgggaggaagtcctatttggacagaatgtgcagccaatagcatgaatttgaactgtccccaagggctgcttagaagtgcagagatgcagggtagagaagagaactgtttgtattagtccattttcacactgctgagaaagacatacccaagaccgggcaatttacaaaagaaagaggtttaatggactcacagttccacgtggctggggaggcctcacaattgcagaaggcaaaaggcacgtctcacatggcggcagacgagaagagagcttgtacagggaaactcccctttataaaatcatcagatctcgtgagatttattcactatcacaagaacagcacagggaagacctgcccccatgagtcaatgacctcctaccaggtccctcccataacacgtgggaattcaagatgagatttgggtggggacacagccaaaccatctcagccataccatacccttgtcccctgtgtgcccacccttccccacgggaggaaatggtacagatggcacaggtgtgtgcaagaatgaccgttccctcagaagcctgtgctcattctggaaggtgctttgggagttaggaatccataagctaaggcaaagtatttgcaaagagtcaggagaacagagttgttactgcaatgatcagttataaaatgtcaagctggaagaggtgcatttggtctgcttattttaaaggtgagtgaagtccagaaaggccagcttgtggcagaaataggtcagtcctagaagttgggcctcctggcctaccatggtctttggaccactctgtgttgaggaaagaacatcagatacacagacatgtgcctctgccattgttgggaagccctgactaagaatgggaaggagtcaccccgtcccccctccttgctctagggtgaccccactcttccttgcaggtgtctgctgactccagtgcatccatgaactctggggttcttctggttcggccatcacggctctcctccagtgggactcccatgctagcaggggtctctgagtatgagcttcccgaagaccctcgctgggagctgcctcgggacaggtaataatactttgactcccaactttttgaaggcattccttgcttgctattctagtggtggaaggtgtgtatactaacaccttctgggcggtgaaggttcatgaaatgcctgcagaaacattcattccactttctgctcgcagttgggtgaaatacagagaggtggagatggggtgcctctcaaggtttgaacttcaccagccccaacttatgccactctctgtttcccccgaaagactggtcttaggcaaacccctgggagagggctgctttgggcaggtggtgttggcagaggctatcgggctggacaaggacaaacccaaccgtgtgaccaaagtggctgtgaagatgttgaagtgtaagtgatgcttctgtccttgcaaagaaaatcttgtcccattccaagcaaacagcaggcctcgggcccagcagaacagcttctctggtgcctttgctgcccacacctgctccgctgcctgcttggggttacctgggagtggagggggtgttctgcaccttgagattgttctatgacgtcactctgttccttggcgtcaacctgggctgtggtcaggtgtttatcctggatccatcgcttgcaggctttcctcaccacatccctgcccactcactaccacctattgcaacaacggctcccatgagagggaagagaaaacaagtttggatgaagtggggaggagagaatcaagtcccagggaaaagcagcccctcgacacataccccactcccttagcctttatcctgccctcctcccttcccaagtaaatgagtctcaacgtgttctttaaagcggacgcaacagagaaagacttgtcagacctgatctcagaaatggagatgatgaagatgatcgggaagcataagaatatcatcaacctgctgggggcctgcacgcaggatggtgggtgccggccagactggctttccctgcccagcggggagaagatctgagctggggtatcagtcccaaggcctctctcagccacagctagggaagggggttaagagaggctgctttggcagaggtttaaaatgtgttatctcgggatctgggctccgctcattggtgttcattcaggaatacagatacctagattcacacacgtggtgtgttaacagaggcagctgagtaattatggtctaagagcgctcaggctgggtgcagtggctcatgcctgtaatcccagcaatttgggaggccgaggcaggaagatcacttgagatcaggagttcgagaccagtctggtcaaaatggtgaaaccccatctctactaaaaaatacaaaagttagccaggcatggtcacgcatgcctataatcccagctactcaggaggctgacgcataagacttgcttgaacccgggaggtggaggttgcagtgagccaagatcacgccattgtactccagcttgggagatactcccgctgtctcaaaaataaaataaataaataggccaggcacagtggctcacgcctgtaatcccagcaccttgggagggtgaggcgggtggatcacttgaggtcaggagttggagaccagcctggccaacaggtgaaaccccatctctactaaaaatacaaaaagtagccgggcgtggtggcgcatgcctgtaattccagctactcgggaggctgtggcaggagaatcgtttgaacacgggaggcggaggttgcggttagccgagatcgcgccattgcactccagcttgggcaacgagcaaaactccatctcaaaaaaaaaaaaaaaaaaaaaaaaaaattagccaggcattgttcatgcctgtaatcccagctgcttgggaggctgaggcaggagaatcacttgaatccagaaggcagaggttgcagtgagccgaaattgcgccactgcactccagcctgggcaacagagtgagactccatctcaaaataaacagacaaactggggctcttaccccaatgttgctcgggaattttctggactatgctgggagtaattatttctctgattttttttgggtagtagaatggatttcccaggtcccctaagaggaggcaggagatgggaggttggccggggtgtgctgctgggggtggggtttctttgaggtgaagccaaacctgctcacctgctgctggccccatggcctcttctcctgtgcctgcaggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaaggtgtggaacctgaaggctcccctgggtaatgccagggtgggaacagagcccccctagtcttccagcctgtgacttatcatcttgtggtggcgttgtggatgcactgagcactggccctgtgtgccctgtgtgttgtcttaggctctctgggaactgcagagtcaggagcaccagtgtagccaggtggccttggggtcagactgatgcagggtccgatctgtgcactgccactttctgcgtagcctcaggcagctacttagcatcttaaaattcttcaaatacaaaataataataatatcagctgggtgcagtggccaaggcgggaggattgcttgagctcaggagtgtgagaccaggttgggcaatatattgaaaccccgtctttaaaaaaaaaaaaaaaattaaaaaattagctgggtgtggtagtgcgtgccgatagtcccagctactcgggaggctgaggtgggaggctagcttgagcccaagagtttgaggctgcactgagccatgatcacaccactgcaccccagccggggcgacagagcaaggccctgtctcaaaagaaaataaagtataacaatacctgttgtagaattgttatgaagataaaatgaaactgtctgtgagtgttgagtgcagtgtttggtgtgtaagggctggcctggtttgagcccagccccatgtggacttgctgtgctgggaggcaggacctaggagcatgcatcgctgcagacgcagcagaggcataaggggccagtctttggggaaggaagggaggagcgcttgctgtgatgagaagcctggagctggcagagaatgttagaagagggaaagcaaaggttcggggggcagagcagtgtggcagaagttctatgagacaagtcggctagttgcatgggtggcggccgcccagagccttccagctccctcacctccccgcctcccgctctcccttcctccttcctcagtgcatacaccgagacctggcagccaggaatgtcctggtgacagaggacaatgtgatgaagatagcagactttggcctcgcacgggacattcaccacatcgactactataaaaagacaaccaacgtgagtgccgacaaggccgccctgtgctggtggtttcatctgagaagcaaggagtggggtgggctgagaacccaccccccagtcccttcccacttgtgccctcatggccctgcctggggccactccaacctcccctgtgctgctttcagggccgactgcctgtgaagtggatggcacccgaggcattatttgaccggatctacacccaccagagtgatgtgtgagtttgtaatagcaattgccagggaggtgtgggatagagagcttctagcactgtagagtcctgctttctccctggactgaggagtcctctttctgccccagagagaaaaacaaaacattgtctgtggccattccctctgctccagatgttgaaaggctgatctgttctccatgctgtctcctggcactgccctgggtagaggatttgtgctgggggaggggaggcggagaagctctaacaccctgtggctctccgcccatttgcaggtggtctttcggggtgctcctgtgggagatcttcactctgggcggctccccataccccggtgtgcctgtggaggaacttttcaagctgctgaaggagggtcaccgcatggacaagcccagtaactgcaccaacgagctgtaagcccgaggagatgtcggaggccctgagccaggccttggggcaagagtgggcttgaggggcagggggctagactagagagtatccatctccaggagacgtccctgaccttacagtcctgccgcaggtacatgatgatgcgggactgctggcatgcagtgccctcacagagacccaccttcaagcagctggtggaagacctggaccgcatcgtggccttgacctccaaccaggtaaggctgcccgtgccagagccagagctcaggccgtccccactgcgtgcacgcacctccctgagcagggaggaggggcccggcccatcgctgcttcctctcgcccatcacaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaacctattttcagtttaggtccctcaataaaaattgctgctgcttcatttatctatgggctgtatgaaaagggtgggaatgtccactggaaagaagggacacccacgggccctggggctaggtctgtcccgagggcaccgcatgctcccggcgcaggttccttgtaacctcttcttcctaggtcctgcacccagacctcacgacgcacctcctgcctctccgctgcttttggaaagtcagaaaaagaagatgtctgcttcgagggcaggaaccccatccatgcagtagaggcgctgggcagagagtcaaggcccagcagccatcgaccatggatggtttcctccaaggaaaccggtggggttgggctggggagggggcacctacctaggaatagccacggggtagagctacagtgattaagaggaaagcaagggcgcggttgctcacgcctgtaatcccagcactttgggacaccgaggtgggcagatcacttcaggtcaggagtttgagaccagcctggccaacttagtgaaaccccatctctactaaaaatgcaaaaattatccaggcatggtggcacacgcctgtaatcccagctccacaggaggctgaggcagaatcccttgaagctgggaggcggaggttgcagtgagccgagattgcgccattgcactccagcctgggcaacagagaaaacaaaaaggaaaacaaatgatgaaggtctgcagaaactgaaacccagacatgtgtctgccccctctatgtgggcatggttttgccagtgcttctaagtgcaggagaacatgtcacctgaggctagttttgcattcaggtccctggcttcgtttcttgttggtatgcctccccagatcgtccttcctgtatccatgtgaccagactgtatttgttgggactgtcgcagatcttggcttcttacagttcttcctgtccaaactccatcctgtccctcaggaacggggggaaaattctccgaatgtttttggttttttggctgcttggaatttacttctgccacctgctggtcatcactgtcctcactaagtggattctggctcccccgtacctcatggctcaaactaccactcctcagtcgctatattaaagcttatattttgctggattactgctaaatacaaaagaaagttcaatatgttttcatttctgtagggaaaatgggattgctgctttaaatttctgagctagggattttttggcagctgcagtgttggcgactattgtaaaattctctttgtttctctctgtaaatagcacctgctaacattacaatttgtatttatgtttaaagaaggcatcatttggtgaacagaactaggaaatgaatttttagctcttaaaagcatttgctttgagaccgcacaggagtgtctttccttgtaaaacagtgatgataatttctgccttggccctaccttgaagcaatgttgtgtgaagggatgaagaatctaaaagtcttcataagtccttgggagaggtgctagaaaaatataaggcactatcataattacagtgatgtccttgctgttactactcaaatcacccacaaatttccccaaagactgcgctagctgtcaaataaaagacagtgaaattgacctgagagaaaatgaaatggccgttttacttagaggaccaaattgggtctcctgaggaaaggaatccagtttatctaatgaagatgttgtgccatgaaggcactgagtctgtctggtttcctgagggttaaaagattagggctgggatcaccacagcattaatcaatactgcctttccgtctcttctaattgccataggctggagatcatcggtcccttggccctgctaatgtaatgtattgatctcaggtaagtaagattgagcatcaaatgaggcaagaaatctgtctcattgttaatgaggttgctgtgcttattcgccaccactgggtggagccagcgagctgaagtttcagttggcattaggtgaagcaccagtccgctctcaagtcacattggtccaactactacctgctagtgtgtgctggtggtgagtgggaaatctttagcctagatttggcattacagaaaaactgggcagcactgatgtggctcgttttgggatgattttagaattagacatgacacaggtgcaaggccctaagtgtcagtggccaccacctctctattgtagcagaattgtgtgtaagacccaggacacatctagcatcactgtagttgggtttttagagaatgcctaaagtggccaggcatggtggcgcatgtctgtaatcccagcactttgggaggctgaggcaggcagatcacctgaggtcgggagttcaagaccagcctggccaacatggtgaaaccccatctctacaaaaatacaaaaattagccaggcgtggtggtgcatgcctttaatcccagctactccagagactgcggcaggagaatcgcttgaacccaggaggcagacgttgcagtgacaagatcgtgccactgcactccagcctgggtgacagcaagactgtctcaaaagaaaaaaaaaaaaaaaaaaaaaaatctaaagtcatacccaatgagatcattagtggcaggtagagccaaggcatctgcatctatagagaagggagcagagaggagaaagctctgaaacagctggcacagccttccattccctccactgaggagagccagggaagaaggtggtcagtaagaacccaactgctaagacttggtctgggcgggttccttctaggtggaccgtcaacagtattcaggaccatttccaccatactgccctacatgcaggtcttcgcgtgcagaagggatctatttcataaacatgctaactagaggtgtaactttcattaccccgggaggctcaaagagttggtggttaacgatttaccagaacaccactagctggggctagatgtaaggatcactgaacccaacagccaagcaccctaaatgatgagaacaacaaaacatccttgacttctctgagctgctagcagaagagtgggaggagaggtctatcaagtggcccgggtcccttgaccaggtcactgctcattcccaccctgctcggagggaaagccagaaggaactgtaggacagcccagcagtacctatgactcattcagctaaaacagaattgagcaagtttagctaatccctttcccacatttaacacctgaaatgtggactaattaaaatacccgtcatttttgaaatgggaaagtgtattgtgaatcacctcgataggcaggatccatgattgctgtatgtgcacagtagggattcatcattcccaaagaactgggcttcattagtgggacatggtggggcttctctgatggagcacaaatttagaaagcattgtagaatgcatattcttgctgtgaagtgctggtgacattcctcatttaggtgatcccagacaggacagtggagttttacttgttttaactgactgctgtctaaccacagcaagtaaagaaatctaattttatcacctacaggctgaaatacctttggccttctaaccactccccaggggaagaaagcccttggtcagctgcatggcagtctatctattatttcatattattaatactgaaaacaccaagcataaatatcctaatgtaatacttgttgctgggtagcacagggattatatcagactttcacaatccctatgactaatagtcttatttgtgaaagacaaactggccagaaacacacacacccaacacaaacatggttaaggcttaaacccttaattatgcttcctagcaaaatggtggctaatgaaagccatatgtgctagaagagtggctgcctcgcagattgcggctgcctcacagattgctgcagcctctgcaggcccaagatggaggtgtcggaagcagccaaatctttctgattgccagtctgtttctccaggaagcttcattatatccagaaagatcttactggggagtatatccatcccatctcataaggtactttgtttccagggtgctgatcctactggtggatcattcagaaagttaatcaggtgctcctaaaatggtttttggaacttccaagttcttactcagaattccaagccataggagacaggtatctaaggtgccaagctgattccattgtgcaaaaaatttcctctctgaagggacgtacacatgaaactaaaaaaacaacatgatggggggtgggctttatacaaagttgagtggggtgacaatggtacagaggaaatgggactttgcaattatatttttctaagtggtctgaacttggtctcactacccacatcacctggaatggttaccaggcctcaaaggactgccccacgggctaaacagctgatccgctctctgaagccagacagtcttatctgggaggtcctttacagatgccactgttgagggccggaagctgaagagagtgagctccatcctcaagtagtcctttatgctccttttgaactagccttgctgttctgggccgtcatttgtgatttggcctggagtgtctaggcgtaaaaaacaaggactgtaggcattagtcacagacgtgtaagttcttaaggagtgaatgctatttttgttttcttaatcaaaatagtgaccacaaagtcaaatctgagattataatttaccttggtaataaaagataaaggagatttacaaaaaacaaggtatgtgtgtgccttgggatgcttttctgggcttaccccatctgtgtcttcatagattctctgtcctgccagccatgtctttggtccacaggagccacttcccacttcaactctcccacaacctccccactgtttactctcttcatgccctgtgctcttgccccaaatcccttcacccaattgggaaaactggatgatagataagtagtttcttatttacatgcatttctctggaaattaaagttgctttccagctagtatttcctcacgtcggaagcatgtgtaaaataacacatggaaactatttccacctggcacataagaaaaaaagggtctgcctatattgtaactgacttctacactttgcatgttttagtctgacccacaatttttttttttggatagttgaagtaaaaaacgtggttacaagatgactaaagtttggcctacaatttcctgtttggacaacaggaagaattgtgcagtgttttgcaacaggactaattctagattctcactgcccttaaagataactagagggaaagggtcttctctttctttttcatttattaaagatacttacaggttcttcagaagaagtgatgggtcctttaggtaatgaaataggtgttgatggtgttatgggtgatgatgtaactggtggcggctgtataaagtcttcatccttaaacatcagaactgagagttgggttactgatttaaaagaaaatgtgtattaatctacagtccactaccttgactaccaggaacttgtcacaactacctcatatcctggcacaggattcaaaaggcaaaatctggaacctaattacgtgtagccaaatattaagcttcctcttagatcaaacagtacaataaatattccttattaaggaacattattgtattgaatttcaatttcattaaggggattaaaacaggagaaaatgacccattgctattttcattttttaatctaattaaccaaatggaaagtaactgtctaaccttagttcccttcagttgaggtgcaagatccaccatgttctctttagattcagtgaaagtaggtaattccacaagaatatcagtctttggagcctggggagataaacattttatgtatcataagctttctgctcttcctaaaacccagaaacttttacagtagtcaatgccttttttagcactatttgctttccactaaatccctaacttcctcctctagctacaccctttatgagtaacctatgaaatatgcccctgatgtagcaacttagtattatttctctttgagttttgagtactttatatacaaaagttgcactctgatagattctagcatttaaaataatcattagcaatccactgatggcactggtcctgctgttggcctcaaaagccatttctcaattatttgtttttctttttttcttttttttggagatggagtctcactctgtcaccaaggctggagtgcagtggctcgatctcggctcactgcaacctccacctcatgggttcaagcaattctccctgcctcagcctcctgagtagctgggattacaggcgtctactaccatgcccggctactaatttttgtatttttagtagagacggtgtttcaccatgttggccaagctggtcttgaactcctgacctcgggtgatccacccacctcagcctcccaaagtgctggattacaggcatgagccactgctactggcctcagttattttctaatagcattgatgtaacttggtctatgttgcatctttttcatttttagtatctaataataaatgataaaattgcctgatttactaaaatggtaagctcctataacgcaaggaagatggggagaggagtggtattaaaatagataacgataagaatgggagtggtgatagaatagctagctaacctatctttaggaattagatttgaaaaacatatatcactgtgctttggaagtaatttgtggactttggagggataaggctacatacatccaaaattacagtatatttgatgtctctattcttcacagaacctagcatgctacttgttctcattttgtatatatacatggagaatagaagtttaaaaacatgggtgggaaaaagccaataacttgcttaggagcttatcattttgtccttaattccgttctcacccactccagaaagcaacatctggataaagagcttatggccctctagaataattctgagaacccagatttagctgagacagtgagctcctccaagatttccttgcccctgacagcaatctaagaatgacgattaactttggtctgtctcacatgagtggatccaagagttggatagaataagaacccactagcctgccttttagaacatggtctatactctgaaactgctcctagtctccctagagtttttcctggacaaatcccaaaaccagattactctagaaatatgaaaagggaaagcaagatggtgtttcctgaagttgggttttcatattggacttcaaataattttccttggcttgtccaaggagtcaacagcataattaagatgtaaaacgactggccctcacttagtacttggactagtcccctaaaccacagtgtagcatattctacaagaatctttcctttcttactcatgccgggttctgagtcagacaggaagccaccagctagagaagcgggaggccctttctgatgggcccagagcaagatgctgtagtgactgggccaatcttatgctcttccctacaacaccaggaagaaaaatgattaaggaaatgagttgaaagacattctagataagccattcaatgcttaaagactaataggaatctggacaaatgaaatagaacaggaaccattcagtctaaaaggagaaagcagcagaaacacccacacccacacacaccagtctgctaatgaagatagttaagaaaaaggaataaactgctcctattagtaaaattctcaatcaagctgggctcaaaggcagtagcagccttaaggctggaggtaaaactgagtggcttcagttttctgttttgttttgtttgagacggagtctagttctattgcccaggctgcagtgcaatggcgtgatctcgtctcactgcacctccgtctcccaggttcaagcaattctgcctcagcctcccaagtagctgggattacaggcgcccgccaccacgcccagctaatttttgtatgtttagtagagatgagatttcaccatgttggtcaggctagtttcaaactcctgacctcaggtgatccacctacctcggcctcccaaagtgctgggattacaggcgtaagccactgtgcctggccttcctttgttttgtttgtttgtggttggttggttggtttttttagaaatttttaaaacacataaagccagttgggtcaaattctaaaaggccaaaagaaatgcctgctctaactgcaagagtacaccaagtgtttgtggagaggcctcagttggatggacgtcgagggtccccattaacccaggtactcacctccccactgagtggtatctcaatcggcttgggcttcacatctatcaggtagaaggtgcgggacaggagcaaaagggaaggagggacgttctccttcaggtggaggtcctgccactggagaacgggaggggaacaacacgtgagaatcagaacaccagagccagagtgatccgcggtcatctaccctccctggctgacagcttcccaccgcccccgccctttccgccaagccgctcaggtgatgagtcacggcagaacacggacaagagcccagccctggcttctgcactgagggggcaccctacagcctccctcactatggtggaatcactctcagagagggagaattcaattaaactctcaacccaactgtggatcaaagtagtcaagtatcttctgttggacaaagtgtagataatgtgaaagaataaatcacagcctgggcaacacagggtgactctgtctctacaaaaaaattttctaattatctgggtatggtggtacatgcctgtggtcccagctaggaaggctgaggtgggaggatcgcttgagcccgggagtttgaggctgcagtggcctgtgttagtgccactgcactccagcctgggcgacagagtgagactctgtcttcttaagatcagtaatatatgcacaaaagataaaattcaaaaggtaccataaaaagtattcacaaagcttctgcagtgacagtgtcatagccaacgttcaagaaatacatgattttaaggatctttctctacaatgtgctgtcttccaaccagagctggtcccacacatgagaggaaaaagtaacctaacatggtttccaagccacaccatggctggtaacctaagatcatctgtgcattcttcatggcatttcttacaatgatgagaatgaaatgtaataggagttactcctttgttttaaagcattgatgctcttacttgaagtccaaatatgctatctgaggaaaaatattaaacatgggttaccacagtgtgtgctggtttggggcactaattgaaaagcagccccaggtgggccaccaggcaaagtggggacctccagacagattcacacagatgacaggccttgaactgaaatttttgccaggacccgttacactacgtgaagtaggtcaaaattctaaggtggtcccaagacaccttgtccctgcaatacccacaccctctcctagttattcagcagtattctggctgctgtgtgaagggattctacaggtgtaactgaagtcccaagtcggttgaccttaagatagggagattctttggatgggcctcaccaatcacatgagaccttaaatctggggctagaggtcaaacacgggggaaattggagatttcaagcatgaggaagctctggcatatgagaagttctctcttgcagatgaaggaggccaagaggcaaggaatacaggtggccactagatgctgagagtagcccggggctcacagccagctgggaaacaaagacctcagtccgacagctgcaaggaactaagttcagccaacaaactgaatgaacttggaagcaggtcgtttcccacagcctccaaaggagcacagcgtgcacttctgacctaccaactgtgagctaatataccagtgttgttttaagccactaagttcatggtcatttcttaggcagcaatacaaaactgatagagatcccaatcaaagtgaaaaatcaacctagtccttcagcatcc

SEQ ID NO: 383 - DNA, 3944 bp, Homo sapiens
cgctcttgcggccacaggcgcggcgtcctcggcggcgggcggcagctagcgggagccgggacgccggtgcagccgcagcgcgcggaggaacccgggtgtgccgggagctgggcggccacgtccggacgggaccgagacccctcgtagcgcattgcggcgacctcgccttccccggccgcgagcgcgccgctgcttgaaaagccgcggaacccaaggacttttctccggtccgagctcggggcgccccgcagggcgcacggtacccgtgctgcagtcgggcacgccgcggcgccggggcctccgcagggcgatggagcccggtctgcaaggaaagtgaggcgccgccgctgcgttctggaggaggggggcacaaggtctggagaccccgggtggcggacgggagccctccccccgccccgcctccggggcaccagctccggctccattgttcccgcccgggctggaggcgccgagcaccgagcgccgccgggagtcgagcgccggccgcggagctcttgcgaccccgccaggacccgaacagagcccgggggcggcgggccggagccggggacgcgggcacacgcccgctcgcacaagccacggcggactctcccgaggcggaacctccacgccgagcgagggtcagtttgaaaaggaggatcgagctcactgtggagtatccatggagatgtggagccttgtcaccaacctctaactgcagaactgggatgtggagctggaagtgcctcctcttctgggctgtgctggtcacagccacactctgcaccgctaggccgtccccgaccttgcctgaacaagcccagccctggggagcccctgtggaagtggagtccttcctggtccaccccggtgacctgctgcagcttcgctgtcggctgcgggacgatgtgcagagcatcaactggctgcgggacggggtgcagctggcggaaagcaaccgcacccgcatcacaggggaggaggtggaggtgcaggactccgtgcccgcagactccggcctctatgcttgcgtaaccagcagcccctcgggcagtgacaccacctacttctccgtcaatgtttcagatgctctcccctcctcggaggatgatgatgatgatgatgactcctcttcagaggagaaagaaacagataacaccaaaccaaaccgtatgcccgtagctccatattggacatccccagaaaagatggaaaagaaattgcatgcagtgccggctgccaagacagtgaagttcaaatgcccttccagtgggaccccaaaccccacactgcgctggttgaaaaatggcaaagaattcaaacctgaccacagaattggaggctacaaggtccgttatgccacctggagcatcataatggactctgtggtgccctctgacaagggcaactacacctgcattgtggagaatgagtacggcagcatcaaccacacataccagctggatgtcgtggagcggtcccctcaccggcccatcctgcaagcagggttgcccgccaacaaaacagtggccctgggtagcaacgtggagttcatgtgtaaggtgtacagtgacccgcagccgcacatccagtggctaaagcacatcgaggtgaatgggagcaagattggcccagacaacctgccttatgtccagatcttgaagactgctggagttaataccaccgacaaagagatggaggtgcttcacttaagaaatgtctcctttgaggacgcaggggagtatacgtgcttggcgggtaactctatcggactctcccatcactctgcatggttgaccgttctggaagccctggaagagaggccggcagtgatgacctcgcccctgtacctggagatcatcatctattgcacaggggccttcctcatctcctgcatggtggggtcggtcatcgtctacaagatgaagagtggtaccaagaagagtgacttccacagccagatggctgtgcacaagctggccaagagcatccctctgcgcagacaggtaacagaaagtgtctgctgactccagtgcatccatgaactctggggttcttctggttcggccatcacggctctcctccagtgggactcccatgctagcaggggtctctgagtatgagcttcccgaagaccctcgctgggagctgcctcgggacagactggtcttaggcaaacccctgggagagggctgctttgggcaggtggtgttggcagaggctatcgggctggacaaggacaaacccaaccgtgtgaccaaagtggctgtgaagatgttgaagtcggacgcaacagagaaagacttgtcagacctgatctcagaaatggagatgatgaagatgatcgggaagcataagaatatcatcaacctgctgggggcctgcacgcaggatggtcccttgtatgtcatcgtggagtatgcctccaagggcaacctgcgggagtacctgcaggcccggaggcccccagggctggaatactgctacaaccccagccacaacccagaggagcagctctcctccaaggacctggtgtcctgcgcctaccaggtggcccgaggcatggagtatctggcctccaagaagtgcatacaccgagacctggcagccaggaatgtcctggtgacagaggacaatgtgatgaagatagcagactttggcctcgcacgggacattcaccacatcgactactataaaaagacaaccaacggccgactgcctgtgaagtggatggcacccgaggcattatttgaccggatctacacccaccagagtgatgtgtggtctttcggggtgctcctgtgggagatcttcactctgggcggctccccataccccggtgtgcctgtggaggaacttttcaagcagctggtggaagacctggaccgcatcgtggccttgacctccaaccaggagtacctggacctgtccatgcccctggaccagtactcccccagctttcccgacacccggagctctacgtgctcctcaggggaggattccgtcttctctcatgagccgctgcccgaggagccctgcctgccccgacacccagcccagcttgccaatggcggactcaaacgccgctgactgccacccacacgccctccccagactccaccgtcagctgtaaccctcacccacagcccctgctgggcccaccacctgtccgtccctgtcccctttcctgctggcaggagccggctgcctaccaggggccttcctgtgtggcctgccttcaccccactcagctcacctctccctccacctcctctccacctgctggtgagaggtgcaaagaggcagatctttgctgccagccacttcatcccctcccagatgttggaccaacacccctccctgccaccaggcactgcctggagggcagggagtgggagccaatgaacaggcatgcaagtgagagcttcctgagctttctcctgtcggtttggtctgttttgccttcacccataagcccctcgcactctggtggcaggtgccttgtcctcagggctacagcagtagggaggtcagtgcttcgtgcctcgattgaaggtgacctctgccccagataggtggtgccagtggcttattaattccgatactagtttgctttgctgaccaaatgcctggtaccagaggatggtgaggcgaaggccaggttgggggcagtgttgtggccctggggcccagccccaaactgggggctctgtatatagctatgaagaaaacacaaagtgtataaatctgagtatatatttacatgtctttttaaaagggtcgttaccagagatttacccatcgggtaagatgctcctggtggctgggaggcatcagttgctatatattaaaaacaaaaaagaaaaaaaaggaaaatgtttttaaaaaggtcatatattttttgctacttttgctgttttatttttttaaattatgttctaaac

SEQ ID NO: 384 - protein, 609 aa, Homo sapiens
KAAEPKDFSPVRARGAPQGARYPCCSRARRGAGASAGRWSPVCKESEAPPLRSGGGGHKVWRPRVADGSPPPAPPPGHQLRLHCSRPGWRRRAPSAAGSRAPAAELLRPRQDPNRARGRRAGAGDAGTRPLAQATADSPEAEPPRRARVSLKRRIELTVEYPWRCGALSPTSNCRTGMWSWKCLLFWAVLVTATLCTARPSPTLPEQAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKTAGVNTTDKEMEVLHLRNVSFEDAGEYTCLAGNSIGLSHHSAWLTVLEALEERPAVMTSPLYLEIIIYCTGAFLISCMVGSVIVYKMKSGTKKSDFHSQMAVHKLAKSIPLRRQVTESVC

SEQ ID NO: 385 - DNA, 39376 bp, Mus musculus
  misc_feature (1)...(39376): n = A,T,C or G
ctcagctcttcagatatcttctggaacctaggacattgctccttgcagaatagtttcatgatcaatattgattaataatataaaagcatggttttgcagtgccgggcatggactccatgtttatacatgttaaacaggtgacctctcatggattggcacctttggaaatccttatattttatatataaaatagtttctgagtcacttttctttattggtacaagtagatgtgagatgcccacccactgacctgtagtgctttttaaaggaaaaaggtacattagatagaaagggagataaagagcagttgagaatctgattctgtaaagtatagctcttgcctgtagatggtagaaagtggattgttggctcatacacagatgactccagagcccacatacccacatagcttctgttcactccctcaagcaaatggtccacaggttagatgtgtttcattgtggtatttcccaagaagtatatgtccatcattccctgaggcaagttggtaagagtgacgttcagtgcactccactgaagtttcaacccctttaagaattagcacagcagatggtagtgaaaaattatgcacattttattatgcattgcacattttgcttattagaatttttcatatgacactctgcatttttaaaagcctaaagatgaaaacaaagtagaattattcattgaaatatttaaatcagcttacagcaattataacaaactatcaaaataaaatccagcaccctggaaggtagatagattccccctgaccagcatcttgaagaagtgtttgttctgtgggatgagagcaggcagggaatgctcccttggtgagattatctagtcatcaaaggtcatgtgggagaaagatggtggtagggcaggggcaagagactaagccaatgtcatagaaaaaggagaaccaggaagggagaagaggtgacaccctgtctaggtgtacagagaaagtacttctctttgttcttcccctcgattcatccctgccttcctttactgagtgagccatcccctcctgaccttaccattctccagctctcactgccacagaaagcatgtgtgattcacaaaccaccatgtgggcatgttactgaagctgtagaagaaagggtatgggggcagggagtgtgaagatgcctgtgtatcttgggcaagaatccctggcatcttaaagacaacattcaagatcaggatggagcaaccatgacatataagagacttctagaaatcatcagaatacaaaggttatttttctatatgcaggttgagtccaactaggctttcttgcaccatttctagaatctagagtcagagggtcaaacatgttcttaaagcacttgagtctgcttcacatttaatacatgaatcccttgggctgacggatggccacacagcatgcagccaggtacgtaggaaatttaaaaagttctggaatcaagcagactgggctagatccttccctctatgccccactgtctttttgatctaggacatattacccaacccttctacccttgaatttcctctcctgtaagttgtgaactacatgttgggttgttctaagaattagaaatcacagtaccatgcttagcatagccttggtctgcaaaggactttagtaaacaagaatcactatgccagcatactctttgggtatcatctccagactccaagttctctgtgataggaatgctttcagcattgggtgtgaataacttttctgccacctgttaagccaaattctgtttcttgttatgtctgtccatcaactcgggtgctaccttttgtgatctcacagaatgaatctaaactttctaacaagtaatataaaatatttgaagacactttcagtgtctgtctaatctccatggtaagcccttttagatctgtgaatctttccaaagaccctgcatgatctcactgaggatacttctgggacccttccatcctatgtgaataaccatgggaagatgtttgcccagccatgaggaaatgtggggatagcaagtcttaggggcagtccatcctgaataaatttgtctgaccatgctagtgtgtgcctcccattaggtatagtgtgtagcttctcctgcctttcaccacggtgttgaggaatatgaacactaccacttttcccaagaaaagcattttgtaaatcacatttgtcaaatgttgcattgaaaagtttccccgtagctctcattgttttcgtcatatcgttgtcctcatttccccctctgtctgtctaatgattcccatgacttgaagttcctgtccttccactgcagactcaaacacataacctgtttaaccaacagaatgaggcaaatgacagcgggccacttcccagcatagtttaggaggccatggatattcccatgttgcttccattgtcctgtcatcatgacaagaacccactcataccagcttactggtccaaggaaacctggagacctataggatctggccctcaacaaaggtacctgtgtcaaccagcacatagccaaagctatgagcagagcaaagacccgtagatgcagggcataagacatacatacagaaaacagttcccatcctcatcctatcttaccagaatacaaatttcaaagaatttatgggtgggacatttacaaaaccataatcaagttgaacgaacatttcataggaatgttcttaccaaatggcaaaagccaagtgacttacctaagagacacaaatcgtcagggggattcctatttggcatagttcatgttcttatttggcccatgttcttggagtacacaccatctgtcagcactctgaccagactctgaaaatagactgggggtgggtggtggggaatacacaagactcaggacttagaaaatctgtattctattgaaaatgtagaaagttgaacatttttaaagactaatgggacaaccagatcatatgtgctatgaagaaattcaagcagagcaatggctacattaggtagaccgaggaagaactcttatgaaatgagacttgtgtgctatgaaagatccagtgggggaaaagatagcattgagggccaaagaaaatgcaaaggccataatctagcagcaggctcagagtatttgtagtggaagcagaagtacagaaggggaaaatatttcaaaatgaagtaagccatattcaaagaggccaggacatgcagagctctgctggccaccataaagactatgtagcttggatcattctaagaatgggacctgatttcccaggctttgggagctgtgtggagaagagattgtggctagaaaagagcagaaggaagctgaccaggtttcttgttgcatcatggtggctactctagagagatagcaaagctagagagaagtgggaaggttacaggcgtgttttagaaacacaaccaagactcactgatggatcaggaacgagggaaagtgaagaattgcaagtgaattctaggtttaattttaatgactcagaggttggttggtggtgccatttctgtagatgacgaagggtggaggagaaataaaccagagaagaagtcaagagttctgtctggatgagttctctatgacttaggcctttgtggagatgctgctgctgctggacatatcaagtctgtgctcagtgctgaaaacagaagttggcagatatttgtgtagagagggtgttagtcagagcctagattaattcatctaggcaaagagttcacttttttaatttaaaatttaagaagttttcaattaaaaaaaatgttagcagaaagaagtgggaggattaaagtgtagcacaagctgacatttaagagcttagcagagggagaagagacagaagaggagcctgagagagacgtgacagagtgtggagagatggagccaagagaagaaagcttccgggaggagactcatcagtgtggcttcggttggactgaagactaactgatcatgaagtaagatgaggccaggggagctaatgaagtatggagctggttgataaccttggaaactaaatagttagcctagttgtggtagctcatgcttgggcttccagcagtcgggaggctaaggcaagatctccagtccaagaccaacctgggctaagcacagagatcctgcagaacccaactatccaataaacagacttgtggagacagaagttgaaatggaattgttgacaagtggctggaagaaaaaaagggggtaaccctgagggaccctgagatcttgaagaagaggaaaacataaatgtagagatgcagcatcaatttacttttggtttatgtagaaaacacaggagcacagttaaatgtcagtgggcataaaaaccaacagggaaaatgtggatactgaaggctcaccagcataaataagcttagcagtcttgtaaagaggagaagggaacagagaggagatgtaggcttccacatgcccttccatggtaaaggggaggcaagcaatgagggctatagagagccagtaagcactcaagttttctcagtgacatgtgattttaaatcagcatttggggattcaggacttctgagaccatgttttgtacttacaacttactgaacagaatgaaaatgatcactacttttacaatgtattttcaaaagtattatagatggacagtagttcagatagatagatagatagatagatagatagatagatagatagatagatagatagatagatagatagatgagtcttagttagggttttactgctgtgaacagacaccatgaccaaggcaactcttataaggaaaacttttaatttggcctggcctacagattcagagattcagtccattatcatcaaggcgagaacatggcagcatccgagttggcatggtgcgggatgagctgagggttctacgtcttcatctgaagactgccagcagaatactggcttccaggaagctaggatgaaggtcttaaagctgaaacccacagtgacacacctactccaacagggccaccccttctaatagtgccactccctgaactgagcatatacaaaccaccacagacagacagacagacagatagatagatagatagatagaaatagatatagatagatctacttgtggagataagcatgaaattgaaagatgttacaccagaagtactgaaccaccagcagtcattccttaggtccaataagttaggagataagactgagagaccagagagcatcttagccatgagggacaactcactcaggaggtagaaaacaggtcaaagcagagaggaatgagaaagaaacaacctgaacttctttctcctcccattccttgctggttgtttcaaaagactaaagccaagtggagcccagctagcaagtgttactgactaatgagattcatggtgaaagtcagtgagtagacagggtagaaataagcagcacaacccctgacattccatgccatagaaacaaaggcagttctgaaaagcacgccaaagggcatctttaccctccatgctactgtatagaacacagcttgctacccaatgggatgtggaaatacgcagctagtggtgctttttgcaaatcatcatggcccctcaaagtccaccaccactcttcatatgtaatgtttactttcatttcaccacagggaccttagtaataggacaacttggacttgagaaccctcacttgcgtgtccaaggccaggagacagccctagaaatgcacccaactagccatgtgcctttgtaaaacttttgaaagatatttattctaactacatattaatcctgtggcttcctactctgatgctagagaaagtccctctcaacccccaattgcataaatggtgggttccataaatcccacagctacctctgctttccatctgggatgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngtttagctacatgatctgtactacatttgccttcttggtctagactgtattactaactgtgggctagttagaccttgctcgatgtggacctctgttgtgggaaatattaaaaattgaacccgccaactctctgcaagacttgatcatgctcccatgctcctgccaccatagatgccaactctctgcaagacttgatcatgctcccatgctcctgccaccgtagctgccaactctctggagctagccccctcagcatctgtctaacttgtcctgcgagccactagttccctctctgctataatcccttgtaaccagcagtcccatactccagtagccaaatagatccaccatcctcacggtttaataacctggtaaaatcaagactcaagcttatagttaattaattagatttatgtatcaataagatcacactttacaagatgccaataaataatttcagagaaaattgataatgataacgctttaacccaattattataagcttttgataacaccatgtcagcctccattcttcttctccctcctcctgagacctctctgtctctgtaactcttcggtctgcctcccttttccctgtccaatcacaagcctcccctgcaataatgaaattggacagggaaaatcctatgtcagacctcctgtagtaggatatggatgttgcctgctttctccttcaaaatgctggtgatactgtgagccattgtcctcaaaggaaaagtgcagtcagaaacatgaaaccagttagctagcgcctgaggcccaggtctctggggctgagtcaggacatgtgactgtgcaaatccttttccaggaaacacaagaaacactacaatctggcatagaaaaaggaaacacaacagcccttctctgaactgccataaagctgtatcttccatctcagagacccgtataccagggtagagcgttgggagggccacctaatgagagatacttgtgatgagtagacaccgcctctgcggagcgtttcaaaccaattcaacctgtttttttatgactctgtgcaccagcaactgtgaacaacaccagcaattaagcactccttcctcaaaatgtgctggtctcgggactacatgcacttgagtggcctcctttggggcaccgctggatgctgtttctgcagcaacccctacactgcccgcccatcacatcctccacactctacccccgcccctctgtgctgttgctcagactttcagtggcacctgctccccagccatgacacattcaaatgtccctcatctaaaaataaactcttaaccctgtttcccctttattcgactgttaggattagaaatttgatgtgaaaccttcttaaatagtctgccttcacaatctccaatctctactcccactagctgctaagcatgactgcggctgctacccaagcactcagactttcctctgctgttgctgtggcctcccagctgccaggcccagtggactttgctcataccttacagaagcactggacatcatgagagcccatgcctctgaggcctttccccaaggacttctaaaccataccctcacatgcgcgcacgcgcacacctcttttgaaagagctaagatttcaatgttaagtcaaagtggctggtttgttttgcagtgtaccctcctcccttgcttcccagtactttgtgcataggagttgtgttttctacagcccttggtagtcctcatgcttggaagcttccaagcatccttcagaaagaggaagtccctgagcccttggctgctgggccatggcaaaggcagcaggctcaagactgctgcttcttgtttaggcaatggtattgttgcctacaattgaaaatacagagccaatgcagagttgaaaagaaactggtatgctaagaggagttagggaaaacaaaaacacaaggggcaagctaacaaatacatctgaatacataaaatgttagcaggacaaaccagtccagaccttccagaaaacagcttatgatagacaaatggaaacttaaaaattatctcgggcctacagattggtggaggacatcattgtgtgaaactacccacaaaaggtttctgagtgagaagaccctgtgtgcaagtgtgctcaggggagagatcacatgaggacctgggaggacctgagtgtgcacttgctctaatttcaaggatatatttaataagagataaataatattcacatttaatttccaaattagtcctctatttattaaaattacacatttttccataattctttgtgttttccagtttagtttgctcacctttaaggtttacattttaggtttatctttcttgagctgcaatttatccaatgggttaacattatcttaggtattctaaaactgagcataaaataagtaagatttaaacttaaaaccacttatctactgcacttaagtcaaatgtctaacactgaagtttcaaacctgtgggtccaagatgctcaaaatcattgaggtatacatgatttcaaaatgcacttaggccttcctcattaacacaacactgtggttcttgaacaccgccttttctgtgtttaactcaaagttttccaaaggtttctagtagtttcacacctactgagagagggccgattccattccagttacgcgctctcagctggttgttgcaattatcctgtccccattgttaaaagagaaagaagccatagccttgtgggatagacagggaggtagcttgctcttcagtatgtcaagaagaaagatgttaggtcacaccgcattcaccactggactagagttctcatctgattcttaaataaacaaatatccttgccttgtacctcaaaagtcatttaaacaccgggatgttcttctattctttcaaaatattcataattataaagactgatacaatgctctttggttgtatgattttgtattgttccatcgctttgtctgtcttgccaggtagtatacaaggttagtcaactaatgcctaccgtgtgtgtgtgtgtgtgtgtgtgtgtgtgtgtgtgtgtgtgtgtgtgtgatgttcatggtattggtgttaattttcaatgcatttgaatacatatagagagttctctaaatcactgcctagttatgcatacatcagttactataaaaattttaaaagacaaaagggatctctttctaactcattcattcagttggtctcctagtcacttgggcatatacaagaggcaatttgcccacattttagggattaacttgataaatacttccaaagtattttatggtttctataatacagcttccattttccttaaccatgaccctacatataaggatgccctggaaaagaattctccaggagtttgcctgaagatctgctattttgtcaggtaatgtgtctgtgatctggagactgtgtggcgtgagatgggatgaaaagctgctgcctacaatgtgtctcctgctggtcctccctacctctccctcccagccttgtgtaggcttcctcacactgatggctgcctctgacactaagctgccttgacattgtattctgcctctgacattgtattctgcctctgacacagtattctgcctctgacactgtaatctgcctctgacactgtagtctgcctctgacactgtattctgcctctgacactattggctgcctctgacactgtagtttgcctctgacattgtatgctgtctctgacactgtattctgcctctgacactgtagtctgcctctgacactgtaatctgcctctgatactgtatgctgcctctaacattgcaagctgcctttggacactgatggctgcccctggacaacaaagaccttaatactggaaagtcagccaaacagtggatttcctccagtgtacctgtgcttaagatttttttattcttattcctcttagatttatgagtttgcataagagaaggataaaaggataatcaagggtctatgttttcttctttattttatccttagttattatggtaatatagctcattgaacattttaaaaattctgaaaataatataataagcactcacaaccaactactattttgtatatatccttcatgaagttcttttttcctcgtttcattttttagtatttcttgctaatattttttaaggtgacataaagttggtggggtttatgatagcattttgaaacataaatgttcttttcactgctttctgcttacatactcctatccctccatcactttgcttaggcacacatttaatcccagcatgtgggagacggaagcaggcagatttctgagttcaaggccagcctggtctacaaagcaagtgccaggacttccagagctacacaaagaaaccatgtctcaaacaacaacaacaaaaatagcttttgcttagctttctgttgtaaagacttctctctagtttttacaggttatgataaacatgatttttcatagttataataacatgtaataaaaacatactttaaagatatacacaccatttttggataattgtttgcatacacggccatatctgggttctttctgatgatatgccttcttttctcgagtcaatttgtgtgtggagacacggaagcctgctagatggttttcttccctccctggagccctctacccccggatcttttgctatgggacaaatctcactctgtcttctgagtgctttttttgtaaacgcagattcctctgggaatctgcccaactgagaggcccagggctcaaggctttcttcttccttccttgtaggtattggataacagaattctggatcatgttcaagatggatgccagcttgaccagcaccatggaagagttccaagacctggtgaaagccaatggtgaggagacccactgccacctcatcgacacgacccaaatgtgagtgtcaaggttctcgtgggtcgttcgaaaccacattcctccagtaacccgagctgcaatgctgggcctctcactgcctccacctccaagaagctcagacagacaggttccatgggagccccaccaacaataacttgacatttaatagaaaagcagagaggccacggagtgaggaagttgcagggggtgggagcaaagagcagagggagccagacctgactagaagatagccagacctgactagaagatagccatcccgcgagaaactgaaagcctgcgtctgggctagggtctctttagaagttagggcagcaagcaaccctaaacttacatggaccaggaagtattacagaatgtctcacgcagagatttagaacattcactgtgagatctgtgagagaccgttcgactccctgagcttcaagggaactgggggatatttcacatcattctttgagttccttattcacacagttggctcactctggaaaatgagcccaacttaatttggggaaggagggcatacatatgacatgctggggtttttatgtgtggtcaattgttttgcaataatacaaactcccaaaaatacagagttctcgaactgcaacactggagagatcaattcacccaaactcctggttttgcctgtggtctatgactaacaggcccaggtctgtgaatggtcttatccatctacttatcgctgccatctattttgacaccgctcagagaactcgcggtagcattgtaactgctctctaagccttgcttatggtatccatgcacaaagagatgttttcaaagccacatcccccaatcccaactccaactgttcatctgtttggtcttctgttctcctctgcttggaattatataacttggtagataaaagaattttttgttacccaaaaatatcaaccttctcattttaaagatgaaaaccctagagcccagggccacttgaaaacctcagtcatctgtcctaatatttcctttcacgacgtctttcactgtgcattctttagaattgttaattgaggctatttcctgacctggtatatttaaggaatcatgagttgcatttgagagtcgtgagtgcaggtggggaagaggtctatagaatttgtatccttttccaagcttaaaaccagggaatctttgtgtcaaggccctcagaaatgcttgtttagaagcccaagccttcaccctgctgcctttcaaacctggctgcttccctctgcttagtgtgaaactgaaactaagaaagactctggggcgggctgtgaagacattggggaataattgggtcattctagggtcagttaatttatatggtcatttctgtaaccggggacttcggagagaaatgacttgtttctgcccagtatgaccacatgttgcctgcaatttcttgaggcatgctgtattcaccctattcttttctgagatattctggcataaaaattagctccctcttatgatttccaccaacagtcccataaccctagcaggaataatggagcaaggagagacatggaaggagtggacatactaaggtcagaggaagagtcaggaacatgacctaaaaatgcctctttcccatgcctctctcttgctgcatccaaaagactcatttctttgaatgattatcaggaaaagcaagatggagtgggggaaactccattaatgcaacgtttttgccaaatggagcttgctaactatgctttgggaattctgtgggtaacactggtatgctttctcaggaaaatcacttgtgactgactcttgttttcttctccctttcttatttactcacaaaagtaattctcgagactggtccaggaaactgactcagaggataaaatcgaatactagcaagaagcgcaaagtgtccctgctgtttgaccatctggaacctgaagaactgtctgaacacctcacctaccttgagttcaagtccttccgacggatatctgtacgtagacaaaggggcaagaggaaagctactccagggaacttaggaatatgagcagagaaagtcagcaggcagtttccccctaacccagcgtgatgctctccttggcatagcactgaaagacttccctctcaggcatcctgggatctggaaacccaaggccattagaattcctttggctgcccatgccctgcttccccatcccacaccctccaagcctacacaccactccagcattcactcagcctatcaagctatggcactgggagattcacatgctatactgcatgcatgcttatatgagggcacacatacccttcacccctgatcatcattagaccttcaggaaattgttatgtaacctttaccaaaaaaaaaaaaaaaaagaagaagaaagagaagagggagaagagggagaagagggagaagagggagaagagggagaagagggagaagagggagaagagggagaagaaggagaagaagaagaaggagaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcccagcagcttccacttgggaccgtccccaaacactcttctgggctaactacccagattcctcgtaggcatccctcagagtgctgggccccgttgtgaagcttcagctggggattttccatttaacccacccctccagtcccaaggctagagagatggtctctgaaaagagaccattatcccactggaaatcagagttgtgctggagacgttggcagagcagcccctggcctgtgtggtgtctgctttaggccagtgctcagctgaggcaggcagaagtgatcatcagtgtgagactgaatcaaagccagcatctctgggttgaacagtgttctgtttacaaataaaagcttcaatatcttttgagtagcctcgccccttcttagaaggctatttcagcagactcttgcttgcttttgttcttcctcaaacaataattttccatccaatataaagctgcaggaaaatgtatctctgcttcgatttctttgtttaacactttctgggaggaatatattacagagatagttctctctttaaaaagaaaagtaagacaaataggttgaacatgtttctagtgagaagaatataatgtattcattggagcaagggtgacagcttcctcttagagcagggaagacttttgctttctgtagcagtctcagtttttctcaagaatccttctgtcctgctcagatgtgtctgcccaccagcagtcacagcatcatgggtggagattgagtaatgcacatctgttttatttaggctgggcatgtatttagggaggattcacacacacacacacacacacacacacacacacacacacacacacacacacacaccttaacaaagctaaagtctattttccaccatacttcaagtctagcaggtatcagtagaggctgcttggagtggtcagtcttcacctaattgagaactcccatcacctccagagcaggagaaagggagagtggcaaggtgtgcattggtgcttaggtcagccttgatgcttcgagaacatcctccaagttatttcacctgcccacactggctttcaaagtacacagttcagcacagcatcagagcccccgtaggagaatccctggaaagtaggttcttctttactgttgaagctaagagattcttggggcaggggcatggcagatataatcatctcataggccagactgtccagaatacttaggcctcacacatgtagtcccattgtcatccatagttaggaaatcctggccactgtgtgattagttagccatgtttcacatatccttctcactcggcttctgctcaagtttgtaagtacgaggtagttcagacaggctagtgttagtatgcaaattctcctattagcactacctcccatttgtgtagccccatgaagaatggaagttcttccatactgtgtgttatcttgatgcttacagcaggttcatgtacgaggcgggcaggctttatgatcacagatttttaaatagcagatggagagataaattgtgttcttgaactgtgttcttcaactgaagattcagataaccattttctaatatggtgtgttctattcagaaaggaaaggaaactatctactcaagtatgccaatcaatgtgtactcatccctgtatgccaaatggacttgatgtagggaggccggatgtgatctccctcccatcattcttttgggcctggtagaaaaggtatcaggaaggcatccatagccttgtttgcccataccagttcccagccaccactgagcagagctgatgtgcctttcagaactccaagaatactagtgctccattctgatggttgtcttttttttccatccagttctctgattaccaaaattaccttgtaaatagctgcgtaaaagagaaccccaccatggagaggtccattgccctgtgcaatggcatctcccagtgggtacaactgatggttctcagccgtcccaccccgcagctccgggcagaggtcttcatcaagttcatccatgtggctcaggtgagtggttggactgagaccttcatcctaggccatgaggtaactgacttatccctgaacccagtctgagttacatcccttctgacccacagtgggctttgtgcatcttctgtggtctcctgcattctcacccaagagcagcatggaaggccacaacaggccacctcgagataaggatccagctctttggtgtttttcaggacacactattttctcataactagccacatgggcaattctcaatttcactgaagccagaccagcctgagttgtcttagggtctaggttcaaggctctgctggatggcatactcaatttttaagggacagagattcaaacttctcttccccagctgttaccctttaccagcacatgcatctcacagggaataacatctttaccctaataataggcctggcaatagaatacaggcaatatgattgtgattattatgttttccaactctggattgtctacaaatccagttctccaagtttggaaatggtccacctgctctattattcattaagacagactagacactgtccaaagcctaaccttagcctagggaactataatttatggggttgtacccagaaatttttgttgtatatgttctcaataattcttggagatcaatgatttagatggtagtccacagatcagatgtcacaaagaggggtgtgtgacatccctactgatcttgctatagtctggagagaactgttattctaactctatggaaaatgtacagaatagagatatcagcttctaagcactgccatgtaatgacacgtacaatgaatgattctgctgtcgtctgtcctatgtatcacagaaactccaccagctacagaacttcaacacgctgatggctgtgatcgggggactgtgtcacagctccatctccaggcttaaggaaacaagttcacatgtcccacatgagatcaataaggtcagtaagctgtcttctctggggccatgagggccacacatctcttgtcaacaaggttaggggccaaggaggcaaattccaagaaaaatcaggatggatgagtcacagacccgagagtgtgtgcggtcccagtatcactgtgcccctcccttccaggacacttaaaataatgtgggcctctttcctgtgactacaaggtgtcagaagttcagttaccatccttgtcatagacttccttacccagctctcctcactttagaattttttttcccaaaaggaatagaaattcagttgctcaacgagtgcatttacacagtgacagcctggaagatcagcttaccggaacacttgcagactgtctggacacttgaatttcagagttggagatatattcattagttgcagtattgttgggaagaaccctgtcattgaactgcatcccccgccatttcctgcagctttatgacacctttagtcgggtggcgtctcatgcactgtcccacattcttagatagatgtcacaggatacgctttaacgtcttatggcagagagctgatggcgtaagtaccactcagcatgacatagtgagccatgcatggcatgggctagctgatgatggatgtttgagcactgtcatctaatggcaggggactttactatccacaaacaaaaccatcctacactggaagaggactctttttagagaaccatttccatgtctcgctgtccctgtccatctaccccatgtatccatcctcctttcaaggagtcccgtttgtttctgctttcatcgccatgtggggcccgtgagaagcctttcccctatggccgggcaaacagggataatttttggtcatcccctaacacactgaaggatcatgtatgtatcagaaggcatggaaacagtaataaaaattactatgccctacattctgccattcatcccaccttgtgatttcacatagctcacactcaccagcagtgttggacaaaggggtgatgagggagctctcttgctgtctcagaatgactgagtgggcacagcctatgtctgtacttcttcactgtacagagacaactcttgttagacacaatcctattagaggaatttgatactgtatctaatatggttatttcatgggaaagcatgtctggcaaggtcgttccacctccttgcttctgaaaacgtgggcattattgtgctttgacgatggagatctataactgacatgaacctgatgtgtttgaaaagaatgtatctggctactccctccagacacaggcctatttggaaaatcttgagccacggaatagtaacctgcgctgtactactgcagctcctccaaataaaacacaccctttcccaggccagcagcaaaggaggcacctgctgacctcatgtgccaactcagtgcaatgcttctgggagcttttaagggcaccagggagggcaaatcatggtttggggttaggaaaagcacttatatactatatagtcatatgcctttaattgttgtgtcaggtgcttatattagttctaaaactaaatctcttttaatataaaataaaaccctatttaaattaaactatgtagtgatattgaagaacacatactttgtttatgactaccctctgacatttgatgtagctggagttttagttggggagttgtagtagatactaactagatgtatcactcactatccaacatatgagagatggagtaaaaccgtggcaggcataagagtggctgctacaggcagtatactaggccctgcgggtgccagtgaccgatctgttctgctttgtaggttctgggcgagatgactgaactgctgtcctcctgcagaaactatgacaactacaggcgagcctatggggagtgcacccacttcaaaatccccatactgggtgtgcacctcaaggacctcatatccctgtatgaggctatgcccgactatctggaagatgggaaggtgaatgtccaaaagctcctggccctttacaatcatatcaatgaattggtccagctgcaggagatggccccaccattggatgccaacaaggacttggtgcatctgctgacggtgagattcccatgggagaataactgctaagactagctataaactggggggctggagcgggtggagaggagggaggattctgctttccttctcatatactagctacagagtagagccaccatctcctccttatggataggatacagaggcacagagagcaactacacagaggagttgacattattaagtaacagtgacctcaacttagactcaggttggggaagggggcccaggagaccaactttgttttaagcagtaagtcttgcagaattctaggggtcttctactactcctgcaaaagctgtccctaagctttcaaaatggagctgatcacacgtggagacagggtactctcataaaatacagtaaggaaggagaaaaaaactagtcacacaaaacaagaagaaaatgagttgttctttgggtcctgctaccgtcagcttagatctctgtgcctggagacattccagccaagggcaggtgtggggcgtggagatctgggtttgtagtgggtatggggtgaaatcagctgtacttccttccaaagctgtgatgctccagtgtgccagctgcatgaacacgggcctgtactctccaagtctactccctacagcctaggaggtggttcaagcttcccctgttccgatatcacaagttgaaacctgcttctatgtgcagagtggcagggatgatgactgtggtctcctcccacctgccggagcactctggtggtaccacaggctccagtctcagctcaggccccattctttaatcacccctttttctttaatcaagtgactttggcaagtctcagacacaaacatcaactctacacagaaacatagatggtaaatctcaatttaaatagaccatcttggaactttgtcagtatttaaagaatattctaacaagaaagaattactgtgttccctattaaaatagctggtatcatatcagccaaactttgtggatcttatttttttattttactgagagagagagagagagagagagagagagagacaaagagagagagagagaagaggactcttctgacctctgcagagacaaagcaggcacatggtacacatacacacatgcagataaaacactcgtgcataaaataaaatggataaaactaaaaacaaacaaacaaaatgccaagcaccaagaagatgaaccactggaaaattgaaccaagaaagaaacctcagttctgggaaaggcagacagtgtcccagcaattaacagtgttctgcttcaacctgcagttatccctggatctatactatacagaagatgaaatctatgagctttcctatgcccgggagccgaggaaccacagagctccggtgagtttctcatcctaagactcttgagtgtggcagggttctaaaggctcatcgggtgccttctccactggccttccactgccagtacattgtttatgctgtgtgcttagctttatgcaaagcacagagaaagctgctcaacatacatgggacatacagttcttatccataaacaacttatggtttagaggaagggactgctgtgtggaaagtaaatgatggaatacctaaagagggtcagaatggtacaatctaccagggacttataaacaagaagaggctggacccatgggggcccacagagaaacaccaaccaaagagcatgcatagaccagacctaggccccctgcacagatgtggcagatgtgcagcttggtgttcacatggatcctttaacaactggagcgggactatctcttattcagactctgtttctgcctttggatccctttccctagctagctgggctgccttgtctggcctcaaggatgcaacccaatgtgccagggctgattggtacagggcaggacaggggtccatcttccccaaggagaatgggacgggggcatgggagaagagagtgagatggaggggactatgattgggatgtaaagtgaacaaataaattaatgtaaggaaaaatgggaggaggcagtgatgtgaggcacactgttgtctgcctccaggtaaagtgtgcccaggtctctctcctaagactgggtcatgatgactgcctctgggggtcatgaagaagcactttaggaacctgttctttttctgctgctacagcacacagtcaggtatcaggaaaggaaagagccctgttaccctgtattagtcacaaggattttcctattccattttagccactgacaccttcgaagccaccagttgtagtagactgggcctctggagtgtctcccaaacctgacccaaagaccatcagcaaacacgtccaaaggatggtggatgtaagtacctgtttcagcaggcaaaatcctggtatggactgctttaatattaggtggtagggaagagaaagggccagagacacaaaggtgagaaggcagggcctgggaacacagagctgcttcactccacacacgtagaaggtttcagaggaaacggcaacaccctggttttccagtaggatggatttgccttgcttaaacacccttgcatgggaacgtatgtttaaaagttatcagtgggtatagggcaaatgtcaacatacaataatgctaaccaggagaataagaaacctggcactgtttggttctgctaactcatgaagaggggtcatctgcatgaggcggtctttatacttgagtcacacttgcagaacaatgaggagcacaggattcaaggaagggagcacgttcaattaggctactctctgagcttcctagagaaggggacaggccctgcagggagggcagagtgaagggagaactgacccatgctctacacagtgcagtagccacctggatagccctgtagtggctgggacagcagaggccggggatgtgtcctggttgagggatgactggcttctccagtaaatggaagaaattctctttttttcctagtctgtctttaagaactatgatctcgaccaggatggctatatctctcaggaggagtttgagaagatcgctgcaagctttccattttccttctgtgtgatggacaaagataggtgaggcagagcatgtgagactgtgaggggtcgctgcagaactcacagatgcatgggctgtagtgtatgcatgatccacgctggaaagagcgagccgccaccaagtgaaagcctctctcccgtagtctgaactgcagcagatggtgaaagccatggggtttctgtagagttcacatgcaaagtctctccgtgccaccagctaaggaggatgcatttggccctccttcttgctttggtgttacagattatggagacaattcatagttgtatcaacacttgctgcatttgtcttgtgggtataaaagccttatcctagttctctttggaaaaccaaatgcatggctggtagattctgcatgtgtccttcctatctcaagccagagaccacagcatctggcttttgcctctctatacacgcatttcacatcgcttcccttttgagtctcgagcacacacacatttggccctttcccagccgtgaagagcagtcaggctgcctctctttctcactatatgctatcctgtgcctttactatgaggagaactcaagaaagcagccataaggaggacaaaaggaaaggtttgttttgaaggcgagaggccactcttcctctcctgacctcaatgacctgactatcattgctacagggaaggcctcatcagcagagacgagatcacggcctacttcatgagggccagctccatctattccaagctgggcctgggctttccacacaactttcaagaaaccacttacctgaagcccaccttctgtgacaactgtgctggctttgtaagtgttattcttagggtgtgtcagagttgaacttggagctcaagagtgtgtgtgtgtgtgtgtgtgtgtgtgtgtgtgtgtgtgtgtgtgtgtgtgcatataggacagtttaaactagtaaaacagtcatggcctcaaaatcttcatatactcactcattccagctcagagcatatgagaacactcagaaagcattgacctctgcttgtatctaatttttcttggttttttttttttttttcttccttgatacattaaaattctgggacaaatggtacagaaatgtgaaatttggatagaccttttaaaagtgttacatgctgtttcaaatgttagagaatacgaaaatgagatgtttttcttcccctttcaaaagaaatgaagttacccgtgtcccagtgggtctttccacgcctatgcccacaaggatgtcctggttaaattcaacatgtcccagaacaagaactaaaactatacagtagtgggaggggaacatattgagaggaggggtcggaaagaatgggagaaggataaaaggacaggacagagggatggatgtgactagaacgtattatacacacaagggaagtcatccaaaaataaatcaatttcttaaaaattgtttctcaaagattacttgagtgctatttgtcttctatcccgactcatctaataatgtcctccagagtggagtttctgccttggactgcacactcagtcctaaggagcctgttggtctgggttcatccacatcaggcctgagctgggtcggacagagctcttgcataggcagcatctgtctttgatctgcagcttcctgtcacaggaacaggacataaggaagccaccaggcgtacctatgtgattgacagtagaatgaggacaaagagtgagtgccaaggcacagcctcacaccagacaggtgactgacatatggcatattctcttctctgcctcgcagctctggggcgtgatcaagcaaggctatcgctgtaaaggtaagtctcaacatcagggattatatatcaggggtcattttccctcatctgaagagctggcattgatgacatttcttgtacatagttgtccattcagtctgagctttcctggttgaattcagagccttgcatccaaactggtttctgaagaaccccctgagaggggttgttgccagcaaagagagggatgcctgtaagacgagccaggcagctctttttccctctacaagaccctctctttgcctcagttgctctggaaatacagatggctgtgctccctataggatagatcctcaaggaaagataatcatttctgggtaaggtcactaaaggcccaggtcagttcttccttttaccaacggatacctcaggatctaattagccaagtcagcgtctcctctctcccagactctgatcacaagctccagggctcacggggggtggggggggggatttagcatgatgagatgaccttccctagattcgttaagagcatcaggcatcctagctccagaggctagaccagccaggtctgacaagagaacattccaggaatgtggttgtgagagagatgctagcgatgtgaaagacttctgagtacagtgtcttgtctgcagactgcgggatgaactgccacaaacagtgcaaagacctggtggtgttcgagtgcaagaagcgaatcaagagcccagcaatatccacagagaacatcagctctgtggtaccaatgtccaccctttgtccactgggaaccaaagatctgctccatggtaagtaggcactgggaatgtttgctgtgaagatgtacaggggagggtcaaatttagagggtgagaaggatcattgcatgttgacatttccagttaaccttgacctcaattgctatgccattgttggcttgtcatggatcttaactgactgagtgttgtaacagagtggaagttgggcatgaaagccatcgggtactattgggccccaaaaccaagggaagagactgactttttgccatgatacctggatcaaacacttaaataattagagctctcaatcatttacagaacattccatctatacctttatcctgctatctttaaaagtgcttaagaaaccttgctacatcaaagcagggattcacacttatttataggaacgataactgtctaggtaacttttgggcaaacagaaaaagatactttgagagctggagggatgactcagaggtttagagcagttgatgttcttgcagagggcctggattcagttctcagtacccaccagtaactccagttccaagggatctgaaatccacttctgacctccaatggcactgcaggcatgtggcatacatacatacacaacacgggcaaaacatgcgtacatgttaaaaataatttttaaaaaagggtaaaagagaaaacatgttcttttcttggtgtggatggatcctgatgcaaactccgtacttttaactcatgccagaccctgggtatctgaaaacagaagacacttggaacgtggaactcctgagacaaaggtctccttaaaacaaatgttgagactcttgagttcctctttgtctaagagcactaacaaatgtatctctccacagcacccgaagaaggatctttcattttccaaaacggagagattgtggaccacagtgaggagagcaaggataggaccatcatgctcctcggagtgtcctcccagaaaatttcagttcggctgaagaggactgttgcccacaagagcacccaaacagaatcgttcccgtgggttggtggcgagacgacccctggtcactttgtgctgtcttctccaaggaagtcggcgcagggcgctctttatgtgcacagtccagcatctccatgccccagcccagcactggtccgaaagcgggcattcgtcaagtgggagaacaaagagtcccttataaaaccaaaaccagaacttcacctccggctccggacctaccaagaactggaacaggtgcccccagtctcactcctcttcccccccccccttagttctcttgctgaagtaaaacccaatagggaaacacataagagtgaagatttaaatcaagatgattactaggttaggtcagcagacaataaaaaggaagaaagttgccaaatacaggtcatctaagtcatcttactggcaagaaagaaagagacattagctctaacagtatttaattttatcaatgaatgccttcctgccctttcccctcagacatcaaggtttgtatcccatttgcaggcctgtccgtacataagccaccatccacctagtttagttagtgtacttatctgtacactgtacagtgaagctgctcccaggctccaggatgggcatcagttaccagcaaggctccctccctgccaggccccaggagagtcagagagcaatgtgctagagaacgtctgtgactcgatttggtgactgaagaacacggtatcaggaggaacacagatttttctggatgaaaaaaaatgtcttttattcatatcacctttaaaatgcaaacaaattaatcagaaggagaaacttaggagaaactgccaattgttacctttcagaacagtaaaagaaatcttaaaaaacagaacatgataaaagtagagagaggactttggtctcagatgctaagactttcttttgtttgttctttgttcatatagttttagtttttgttgttgttttggttggttggtttttgtttgtttggtttgtttgtttgttcggtttgttttgttttttgagacagggtttctctgtgtaaccctggctgtctggaaactagctctgtagaccaagctggccttgaagtcacctgcctctgcctcctgagtgctgagatctaatcccagacatttcttaagccacttgttaaacactgcaacctgtttgggtctctgtaaaatgcagggctgtaaaaaagtccaggctgaggttccaactcttacatgtccatgaaaggtagcaacgtagttatgaaaaagacaccatgaagagcaggtgacaggtcaccagaccatgagccatgacggtttattagctgcttctccttcctttcaccagcatcacagaaacctgagggccagaaatctccacgagcattttagaggagcaactgtgtgccctgcttttccattagggaactgcttctactggtctttagtttgacagtcctggtcacaaggaacaaagtccagttaagttcgtatttcaaatagcctgctatacggacggctggtgtgttgttttcctttatgtagtaattcagaatcagcatggaaccaagtaacaaaggaaattaagactgggtcagacacaccagggctctaaaactctgtcagcattttctacttctacaaaatgtgtgcccaacatctatttccaggttgtgggtgaggaggaagcacccctattatcagacagccattctgttgtcacatagcagtatcaggctcacagccagtgctcaagctcacataagctggcaaagggtaccctagtgattctgtgtgagaattcagagggtgccaaattaacgagacaatgcacctatagtctatgatgcccatgtaaatcagtctagcataaagatactttcctcaaaaccagaagcctggaaagcaaccactggctatataattaaattactgccattacaacactacatcccaatttgggaatgaggcaaaactcttccatcaaaaaggagtatgagttatcagtaacagggggttatgaacttaggttacatcaactgtaacatctcacttcacagagctttgaagcactgctttcatagttcagaacagaccagaccagactactttctgtcaagttacgatgcctgcgtcacactacccaaaagttgtggcttcctccacccaatgcccaagaatggattgttctgtcctgctagccactcacatctgagatctgataacaaagagtaattgctatttgtgcatgcccatgatagttaatgtgttcttttatactcacagctaaataactgctttgaaaatagtttataattcttaaccacagggaacaggagatgccaatcaaatataatgctcttgatactgtcactaatttcctattcactgctgctctattaccacaccttattctcatttccttttaggaaataaataccctgaaagcagataacgatgctctgaagatccaactgaagtacgcacagaagaaaatagaatccctgcagcttgggaaaagcaatcatgtcttagcccagatggaccacggtgatagtgcttaatccagaatttcaaggaccagaatctgcagaagggtatactgggatctcacttcaaaactcattgcagacgttcagcacctttagattgactgactttaaaagggtagagctggccactactgttgacatccttggtttttacctaaacggtttttaatgtgagtcgttggttttcagtcagttgaatcaaagggaagaaaagctcaagcatgcaaagtctgagcattcctattctaaccttctttctttactgaaaccaataccaaacatgcgctaaaataagtctagagtttcctgagggtgtcccaggcagcccgctttactgattcatacttagataaagagtccctggtgaatccatttgctgccttccgcaaactgacttactttgttctacccaaaccccgctcataacggaaacaatagcctaagcgtggtgactttgacatgcctgcattgtttgtgaaactgatccctacagtgttcgctacctcagacctcatcaagagcctctttccccactgtccttcacttgcccgcctccttcctcccttgcttataggcacatcagcacatctacctagaagtgaactcctagcgatgtagcctggttttaaatccagagcttcttaattgaacttgacattgtctaattgcaggccaacttatagctctaggtcttagtcattatgaaatacaaaataaaactcactcactacccacaaacagcaattaccatggcatacacacagctaaatagctaagtcaaaccacaataacacgtttatccagatagtctttctatagtgggtagaattaagaatctgtgactttttaaaagaaatggtctgtgaacagtgtttaattcttcatgttctagtctctctctctctctctctcaagtaatctatcataaggttctcttttgaactgaatttgtgcttaagttgtcttcacttttattatctacaaataagctaatgggtgtgacggctttcatagctggcagtatttacatgtgtgtagaatgtatatatatagtatcagacatgcatggagcttggaccttctcccttagaaaatgcagacgtgaatcaaacaccttttagtcacttacacaaatttgcaagtatagttctgctcattataaggcaaactgctaacaatgtaaattgttctgcttaacaaaaccgtgagtaacagtgtcccagtattctttcgtgaaggttaaaatcagtgggtttgtcttgttgcctgtgaagcaattcacaaactctcttgtcagcttccttttagctttcaaaaaacatctcatctgattgtgtccttttgaggagactgtttccatgctaggaaggtctggcaccacactaacttgtaatttaatatgcaagacaagcaatttaagagtctcatcgaactaaataagttccaaacctagctgggcaatggggacacatgcctttaatcccagcactcggtgggtagaggcaggctgatctctgtgagtttgaggccagcctggtctacagaatgagttccaggacagcaagggatatgctgagaaactctgtctggaaaaatcaaaggaaaaagtgtttaaaagtttcaaccctacgaccaagagcataaagtctacagaggaatatgaactgtacatggtgctgccccctaaaggactcaaatcatttaagatattcctttgatgaaagaccactgcctgtttgcacacctctttggagcatttcagtgacaaagagctggcttgtggtgagtgtctctctaaactttaatgaactactttacacacagttatccttcttctacatcccatctcagaaacgtgaaaagcatagcacctggtactacgcctctggcaggtgtctatattatgtggaaacttttatggagtgataggactaatggaagacctcaaaatttgtattttcactctgttatgcactagtacaagtgtagagcttgattctttagacaatgcctttttcttatttctcatccccaataaagatctcccagtgagattttgtgtaaataatctgtaatataggaattcagagggcctcagtcatttatcacagctagatgaccttacagacagcagaaaggacaggaaagatagtgggagacagtagttttcctcacaaattcttacattccagccaagacaaaggatgtgtgaagtctgagttggtactgttcctgcagaatggtaggagcaggtgggatctcctgatacaatctggaacaaagtttggcctgtcacatgaggttttgtttaccaggctgtcttgaaatgtctgggcagatgggtgtctgccaaagcaaggactgatcctgtctgtgaacagcaatgtctctgctcttcttctctgtggagtgactcacccatttactgaccacttgtgaaattgtctaaagatgtatactgtaaaagcttcgaaagaactgtacaaactgtaagatattttatacctattttatgttttctgtgtctcatatttatatcataaaaacattggatccctataacttcaaagtcgtgtgcttcttcactttatacatatgtaggcattttgttaaactttttactggaattcaaaccaaaaatgctcctccagtctattaaaaagggttttctggggggggacccctagcttatttgggttaaaatgttcttccttttttacaggatgaggaagtaacaatgcagatatgtccaccttataatgacctctctgaacatcaagtctgtcaaaggctcaacaccaattaaaggggccaaagctatcatctcctgtggctcttatcttaatgccacagttctagctaagaaaaccagtaaggaaagaagacaaagtagacagaaagacggttcagtctcgtgtcccgatccactcagcaattcatctgtggtcactctttggagtgatcagaggcaccatttgttctccctatccagattttgatgatgggacccatgcagaggaggatgccagccactcacacattgcacattgtggtacatttgggttgggggatggggtgtatctccataattaatgttattttaggtgaaataacgaagtcattctgacaagctgaccctgaacagaaggtgaaagtgcttcttgcccaccctcattcccagctcacagatctcaccacaagctcttcgttacagagtggataaaccagatatcactcactatgtgttttggctacaaagcctcacggtttgccacaagtcctggtaaatgagaaacacctagttccctctgatgtcagttcatggggttggatggtactgagctcgctcagcccaggggaaaaactcagttgctactttaatttggaaatttctagtccgattttgtccacagatgctcataggtggataaagacatagaaaagggggaagacagtaagtataagaaaataggaggaaaaaaaccccatgaaattaaaaatagaatcaacatgcaaaaaggtatcaggcttcagggaactgtgaaatgccatccatcacaaatgtccatgtgccctacctaatccatttataatgttcttgtgtgatgaaccataaaagccctaagtcgccctactgccagaccaggcatcacatagcaagcagtgtgcaaacacattttgagcaaatcttcttgctgcaatgaagttcacaggctgggtatacagaactggctccactccactgtaattccagaagtgctcaactggggaaagactttccagtagttgttggggaaaaccccaacagcactcataaaagggacaaaacaaacaaacaaacacaaagctcaacagaaataaactaatgtcactgccatatttacataaatctttagggctgaacagttaaaagagcagagcagatattgtactacaggccaataatcccagcattcaggaggctgaggcaggacgatgccaagtttgagagccaagttttaagaacaccctagactgcacggcaagagcctgtcataaataaaagtaaaaagtagctgtaaattgtcctttactgttagcaagcaatgcttataaaatggaagaaatgcaaaatttttcaacaaactttttttgcctactatataaatgtaacttttatttccacagataaagggatgagatgagagttgtacccgagctgtacaaacgctcagcttaggcagagcccagagcattttttcctctgttctaactatccctaggcctaagcctggaagcttctagcctccttacaatctaatcctccaagatgactgattcaaactggcttttcttggcttccaactgaattgctgtgcttggcctcaaactaactctgacaatctctttctctcattctctggctcattcggcaacctttctctataaaactgtcctggtaaaactactttttggagtttaatgaaaatgaagccacaacatacccaaacttatgggacacaatgaaagcatttctaagaagaaaactcatagctctgagtgcctccaaaattaaactagagagagcatacattagcagcttgacaacacacctaaaagctctagaacaaaaggaagcaaattcacccaagaggagtagactgcaggaaataatcaaactcaggggtgaaatcaacgaagtggaaacaagaactattcaaagaatcaaccaaaggaggagttggttctttgagaaaatcaacaagattccttagccagacatactagagggcacaggaaaagcattctaattaacaaaattagaaatgaaaagggagacataacaacagatcctgaagaaatccaaaacaccatcagatccttctacaaaaggctatactcaaaaaaagtggagaacctggatgaaatgaacaagtttctagacagataccaggtaccaaagttaaatcaagatcaggttaatgatctaaacagtcctatatcccctaaagaaatagaagcagtcattaatggtctcccaaccaaaaaaagcccaggaccagatgggtttagtgcagagttctatcagaccttcaaagaagatctaatcccggttcttcacaaactattccacaaaatataaacagaaggtactctacccaactcactctatgaagccacaattactctgatacctaaaccacaaaaagacccaacaaagatagagaacttcagaccaatttcccttatgaatatcgatgcaaaaatcttcaataaagttctcgctaaccgaatccaagaatccatcaaaataatcatccatcctgacgaagtaggtttcatcccagggatgcagggatggtttaatatacggaaatccatcaatgtaatccagtatataaacaaactcaaagacaaaaaccacatgatcatctcattagatgctgagaaagcatttgacaaaatccaacacccattcatgataaaagtcttggaaagatgaggaattcaaggcctatacctaaacatgataaaagcaatctacagcaaaccagtagccaacatcaaagtaaatggtgagaagctggaagcaatcccactaaaatcagggactagacaaggctgcccactttctccctacctattcaacatagtacttgaagtcctagccagagcaattcgacaacaaaaggagatcaaggggatacaaattggaaaagaggaagtcaaaatatcactttttgcagatgatatgttagtatatatatatatatatatgtgtgtgtgtgtgtgtgtgtgtgtgtgtgtgtgtgtgaccctaaaaattccaccagagaactcctaaacctgataaacagcttcggtgaagtagctggatataaaattaactcaaacaagtcaatggcctttctctacacaaagaataaacaggctgagaaagaaattagggaaacaacacccttttcaatagtcacaaataatataaaataccttggcgtgactctaaggaagtgaaagatctgtatgataagaacttcaagtctctgaagaaagaaattatagaagatctcagaagatggaaagaactcccatgctcatggattggcaggatcaatatagtaaaaatggctatcttgccaaaagcaatctacagattcaacgaaatccccatcaaaattccaattcaattcttcaacgaattagaaagggcaatctgcaaattcatctggaataacaaaaaacctaggatagcaaaaactcttctcaaggataaaagaacctctggtggaatcaccatgcctgacctaaagctttactacagagcaattgtgataaaaactgcatggtactggaatagggacagacaagtagaccaatggaatagaattgaagacccagaaatgaacccacacacctatggtcacttgatctttgacaagggagcaaaaacaatccagtggaaaaaagacagcatcttcaacaaatggtgctggcacaactggcaattatcatgtaaaagaatgcaaattgatccattcctaactccttgtactaaggtcaaatctaagtggattaaggaactccacataaaaccagagacactgaaacttattgaggagaaagtagggaaaagccttgaagatatgggcacaggggaaaaattcctgaatagaacagcaatggcttgtgctgtaagatcgagagttgacaaatgggacctcatgaaactgcaaagcttctgcaaggcaaaagacaccatcaataagacaaaaaggccaccaaaagattgggaaaggatctttacctattctaaatcagataggggactaatatccaatatatataaagaactcaagaaggtggactccagaaaatcaaataaccccattaaaaaatggggctcagatctaaacaaagaattctcacctgaggaataccgaatggctgagaagcacctgaaaaaatgttcagcatccttaatcatcagagaaatgcaaatcaaaacaaccctgagattccacctcacaccagtcagaatagctaagatcaaaaattcaggtgacagcagatgctggcgaggatgtggagaaaggggaacactcctccattgttggtgggattgcaagcttgtacaactactctggaaatcagtctggcggttcctcagaaaactgcacatagtactaccagaggatcctgcaatacctctcctgggcatatatccagaagatgccccaaccggtaagaagaacacatgctccactatgttcatagcagccttatttataatagccagaagctggaaagaaccgagatgcccctcaacagaggaatggatacagaaaatgtggtacatttacacaatggagtactactcagctattaaaaagaatgaatttatgaaattcctaggcaaataaatggacctggagggtatcatcctgagtgaggtaacccaatcacaaagcaactcacacaatatgtattcactgagaagtggatattagcccagaaacttaggatacccaagatataagatacaatttgctaaacgcatgaaactcaagaagaatgaagaccaaagtgtggacactttgccccttcttagaattgggaacaaaacacccatggaaggagttacagagacaaagtttggagctgtgtcaaaaggatggaccatctagaaactgccatatccagggttccatcccataatcagcttccaaacgctgacaccagtgcacacactagcaagattctgctgaaaggacccagatatagctgtgtcttgtgagactatgcaggggcctagcaaacacagaagtggatgctcacagtcagctattggatggatcacagggcccccaatggaggagctagagaaagtacccaaaggagctaaagggatctgcaaccctataggtggaacaacaatatgaactaaccagtaccccagagctcttgactctagctgcatatgtatcaaaagatggcctagtcggccatcactagaaagagaggcccattggacacgcaaactgtatatgccccagtacaagggaacgccagagccaaaaagtgggagtgggagggagggtatgggggacttttgcgatagcattggaaatgtaaatgaggaaaatacctaataaaaagtatattaaaaaaatcaaactgcttgagctcacgctctctgtctctctctgtctctctctctgtctctatgtctctctctgtctctgtctctctgtctctctgtctctctctctcaagtcatctctcctgtgcaaattgggcatatccatcctgactaattctttcaaatttctgattcatccctttgcccctcaattagacattattttcaaacatggttgcttccttctacaaactaaccttactttcatagtttgggattaaaggtttctactaagggtgtgtctgcaactcaaccagagggattaaatgtgtgtggcttgtctgcatttcagccagatcacatagacctagaaattctctggatgtgatcccttgccagagcagccatgttgttggattaaagtttcctctactgcctaccccacaatattttactcatatataagtatattttataacattttactttttagactacacagctactgatacatatgcttccttaattatggaaagctttttgtttcaattatgacaaatgaaaaaaattaaatataaacacaaaatttctaaatttacaagtgagaacaacacacagattttctatcccacattcttcaaaggcttagctttgattgcagcacacatagtacttatttttacacttttaaggttattttaagttttactacagtttactatacaatacagtacacacctgtcaattatcacaagccagttttccatggataacacattggttgttgctcagacatgctgacctggagtccacactgagagagtttacaggatgaacagctctggtggaacatcttcactgttcaccatactggatttagaacccctaagagacatatgtctgtgtgtgtatataagtgtttccagtcaggtttaactgaggagaacaagccccacaagtggacagcaccatcctctgagctggagattcaatactaataaaaggggagggaagagaaagtcctctctctcagcaaggatgcagctcagtatcctgactagactcaggatagctaatactatctgccatgtttaccctgccatgacaggactacaaacctgaaccatgagccaaactaaaccattacttctggaagtttcctcttgccaggcatttagtaactaatataccagctgtggtatctatccttggttgtcagtatcttgaatcaactagagcccaagctgctgggcatacctgagagggatttttctagattagatatttgatgtgggaagatcaccctaaatctggatcgtttaaggtgggaagattcacctgaaatctgggccacagtttctggcagcagcctacacaaaggacctgaagaggaaagctcttgctctctgcctgcttgccctcactctcattggcaagtccgttccttcactgctattacagcccctttctttggaagtcctgaacaaaataccagttagtagtctaaactcagtgttcagcaagtagtgcctagacttacttgtatacttatgaatcatttcatgaggggtgtctcctttcttatttctcaactaaagacaagtctttgagagttagggtcatttccactcaagcacctgcggcctagggctgctgtaatctgaatttacaactcctaatggccacgcctttgaccactccatccaatggccaaatcacttatagcattcctaagttgtttttttccaaaggatgctttaacccaacctctgacatgtggaagcttgaaatggtagctttggttctgtgacacagcctgcgtttcagagcttggtatctaaaacctgggtactctgtaggagcaggctatttttcatagcttcaggtaaaattggtatgtcccttttgttcctttattcttatctcatttttttcttctattg

SEQ ID NO: 386 - DNA, 2112 bp, Mus musculus
atataaggatgccctggaaaagaattctccaggagtttgcctgaagatctgctattttgtcaggtattggataacagaattctggatcatgttcaagatggatgccagcttgaccagcaccatggaagagttccaagacctggtgaaagccaatggtgaggagacccactgccacctcatcgacacgacccaaattaattctcgagactggtccaggaaactgactcagaggataaaatcgaatactagcaagaagcgcaaagtgtccctgctgtttgaccatctggaacctgaagaactgtctgaacacctcacctaccttgagttcaagtccttccgacggatatctttctctgattaccaaaattaccttgtaaatagctgcgtaaaagagaaccccaccatggagaggtccattgccctgtgcaatggcatctcccagtgggtacaactgatggttctcagccgtcccaccccgcagctccgggcagaggtcttcatcaagttcatccatgtggctcagaaactccaccagctacagaacttcaacacgctgatggctgtgatcgggggactgtgtcacagctccatctccaggcttaaggaaacaagttcacatgtcccacatgagatcaataaggttctgggcgagatgactgaactgctgtcctcctgcagaaactatgacaactacaggcgagcctatggggagtgcacccacttcaaaatccccatactgggtgtgcacctcaaggacctcatatccctgtatgaggctatgcccgactatctggaagatgggaaggtgaatgtccaaaagctcctggccctttacaatcatatcaatgaattggtccagctgcaggagatggccccaccattggatgccaacaaggacttggtgcatctgctgacgttatccctggatctatactatacagaagatgaaatctatgagctttcctatgcccgggagccgaggaaccacagagctccgccactgacaccttcgaagccaccagttgtagtagactgggcctctggagtgtctcccaaacctgacccaaagaccatcagcaaacacgtccaaaggatggtggattctgtctttaagaactatgatctcgaccaggatggctatatctctcaggaggagtttgagaagatcgctgcaagctttccattttccttctgtgtgatggacaaagatagggaaggcctcatcagcagagacgagatcacggcctacttcatgagggccagctccatctattccaagctgggcctgggctttccacacaactttcaagaaaccacttacctgaagcccaccttctgtgacaactgtgctggctttctctggggcgtgatcaagcaaggctatcgctgtaaagactgcgggatgaactgccacaaacagtgcaaagacctggtggtgttcgagtgcaagaagcgaatcaagagcccagcaatatccacagagaacatcagctctgtggtaccaatgtccaccctttgtccactgggaaccaaagatctgctccatgcacccgaagaaggatctttcattttccaaaacggagagattgtggaccacagtgaggagagcaaggataggaccatcatgctcctcggagtgtcctcccagaaaatttcagttcggctgaagaggactgttgcccacaagagcacccaaacagaatcgttcccgtgggttggtggcgagacgacccctggtcactttgtgctgtcttctccaaggaagtcggcgcagggcgctctttatgtgcacagtccagcatctccatgccccagcccagcactggtccgaaagcgggcattcgtcaagtgggagaacaaagagtcccttataaaaccaaaaccagaacttcacctccggctccggacctaccaagaactggaacaggaaataaataccctgaaagcagataacgatgctctgaagatccaactgaagtacgcacagaagaaaatagaatccctgcagcttgggaaaagcaatcatgtcttagcccagatggaccacggtgatagtgcttaatccagaatttcaaggaccagaatctgcagaagggtatactgggatctcac

SEQ ID NO: 387 - protein, 686 aa, Mus musculus
YKDALEKNSPGVCLKICYFVRYWITEFWIMFKMDASLTSTMEEFQDLVKANGEETHCHLIDTTQINSRDWSRKLTQRIKSNTSKKRKVSLLFDHLEPEELSEHLTYLEFKSFRRISFSDYQNYLVNSCVKENPTMERSIALCNGISQWVQLMVLSRPTPQLRAEVFIKFIHVAQKLHQLQNFNTLMAVIGGLCHSSISRLKETSSHVPHEINKVLGEMTELLSSCRNYDNYRRAYGECTHFKIPILGVHLKDLISLYEAMPDYLEDGKVNVQKLLALYNHINELVQLQEMAPPLDANKDLVHLLTLSLDLYYTEDEIYELSYAREPRNHRAPPLTPSKPPVVVDWASGVSPKPDPKTISKHVQRMVDSVFKNYDLDQDGYISQEEFEKIAASFPFSFCVMDKDREGLISRDEITAYFMRASSIYSKLGLGFPHNFQETTYLKPTFCDNCAGFLWGVIKQGYRCKDCGMNCHKQCKDLVVFECKKRIKSPAISTENISSVVPMSTLCPLGTKDLLHAPEEGSFIFQNGEIVDHSEESKDRTIMLLGVSSQKISVRLKRTVAHKSTQTESFPWVGGETTPGHFVLSSPRKSAQGALYVHSPASPCPSPALVRKRAFVKWENKESLIKPKPELHLRLRTYQELEQEINTLKADNDALKIQLKYAQKKIESLQLGKSNHVLAQMDHGDSA

SEQ ID NO: 388 - DNA, 63828 bp, Homo sapiens
  misc_feature (1)...(63828): n = A,T,C or G
ctggcctcccaggagagagatcccacatcaccatggatctgatcttgtccttgacactggaccccagaggtcagcaacagaatggtcagtgtcagatgcattcattttgcatcccagtggttgtttgtaatcaacccagtgaggtagaagtcattatccccactttgcatataatgaaactaagacttgaggtcaagtaagttccccaaggtcattcaactgagacttgacttccggccaaagtctaaaggatgcgccacgctgaccctgcctttgccaggacaatgcccttgaagcttgaggaccctgtatcagactgaggcatgtgaactttacagttggcagagctcctggtgggcctgggtccaggaatggagagctctgaccctggggtcctctctctgattccagtgtgtggataacatccgatgcaatgggctcatgatgaacgcatttgaagaaaattccaaggtcactgtgccgcagatgatcaagtaagtgcccttaaccccatcttgaccaggcagcattccagagactgagtaccacaaggtgacagccaggacactgggatgagccagctactggggttcagagatgctgggctttgtctttgggggtgttttggatgttttcttgtttgtttgttttgagttgggtgattgctatttggatgattgctttggcttagttttttgggttttttttttaaattttttatttccataggttttgtggaacaggtgatatttggttacatgagtaagttctttagtggtggtttgtgagattttggtgcacccgtcaccccagcagtatacactgaaccccaatttgtagcctttttttgttttgttttgttttgtttgttttttgttttttgttttttgttttttgtttttttgagaccaagtcttgctctgtcacccaggctggagtacagtggtgcaatctcagctcactgcaacctctgcctcccgggttcaaataattctcctgcctcagcctcctgagtaggtggaactacaggcgtgtgccaccatgcctggctaatgttttgtatttttagtagagacagggtttcaccatgttagccagtatggtctcgatctcctgaccatctcgtgatctgcctgcctcagcctcccaaagtgctgggattacaggtgtgagccaccgcctccggctccaatttgtagtcttttatccctcaccgccttcctaccctttccccctgagtccccaaagtccactgtgtcattcttatgcctttgcatcctcatatcttaggtcccacttatgaatgagaacatacaatgtttggttttccatccctgagttatttcacttagaataatagtctccggtcctatccaggtttctgtgaatgccattaattcattcccttttatggccaagtagtattccatcatataaatataacacaatttctttatccactcattgattgatggacatttgggttagttccacatttttgcaaattgtgctgctataaacatgcatgagcaaggatcttttttgcgtaatgacttcttttactctgagtagatacccagtagtggggttgctggatcaaatggtagttccacttttccttctttaaggaatctccacactgatttccatagtggttgtgctagttttcattcccaccagcagtgtagaagggttacagaagtcttaccttttcaccacatccatgccaacatctatttttaaaaattttttttattatggtgctttggcttagttttgttatggttcatctgttttgtacatgtggattatttctgtattaggttgtttaaaatataacattaggaatgaaactttatgtactcttttttaataactatttttctcttcctaattaaaaaatgaatatatagaacatttcaaaaaccagaaaaaccaaaacgcaggctccaggaccactgtgtttgtttgaacaatccccagagacaatgtcctactaaacgcagctctccaagccctgggtaatacagcctccctcacctgcaccaggcacaattctcttgcagtcacctgcacgcctaaccccctcaccacacactccttcctgccccaaccctggagcccactggctctctggcctccattcccacctctgaattctgagcctgccttgctcatctggtgcacgctaggactctgctcccatctgggccatgttgctgttgccagaacaatcatctgggtaacccaggcctgtttgctacttcacatacatgctctggggaactgcagatgtaatgcgtttaatgcagaatatgatttaatgtgtgaaatcctttgtttccactcgccaccactctgaagtcaagtctgatgaagtgagtcctttatgaacctactgtgtgccaggagctagccgaggcagtttcaggtccaccaggtctttaagcctctgcacaagttgataaggaattattcccctcatgactacatcactgaacaggtggtggggtacagcagaaaggtctggccttgaaggcaacagccctggtccccagccctagctttgtgtgtgaccctcgtccccagccccagctttgtatgtaaacctggtccccagccctagctttgtgtgtgaatatggacaagtcgcttaacctttccgagcttgggtttctcacgttgtaaatgggggacatgataatacctacctacctacttcctagatccgtttcaataatccaataaaactcacagctggaattaccattatatgtttagtgagtacccactcaattaccattatatgtttagtgagtacccactcatgctctggaaagggtgcccattgagacagcaaaaggagcagatgaactttgggaggccgaggtgggtggatcacttaaggtcaggagtccaagaccagcctgaccaacatggtgaaacctcgtctctactaaaaatacaaaaattagccaggcctggtggcatgcgcctgtaatcccagctactcagaaggctgaggcgagagcatcacttgagcctaggaggcagaggttgcagtgagccgagacctcaccactgcactccagcctgggtgacagagtgaaactctgtctcaaaaaaaagagagagtgcggatgaaacaaaaataaaattaaaatcacctatgaaagaaaaaaataacaaaattttgaataatgatggtgataaagtgaatggaatgtccagattaaacttacaacttcaaggacccatctgcttaccaatctaaagcctggttttcttcacaggaggaccagggaggggaccagggaagcagaaatgagcaggtggggtctccgtcctcgggaaattcatcgtttagtgagagagagagagacatagagagattattagaaagcagtgtagtgcatgctgtaaaatggaatctgtgtaatccaggcgaggtccagaagatgagtgatagatctacctggcacagttgaggatggtttcttatggaatgggacattagagctggcctcgaaggaccagttggagtttgctagacgactgagggggaagggcattctgggaagagggaacagcatgaacataggttcggaggcaaaaaagtgcacggtgtttggggagagtgcagggtcgaggagagtgatgtcatgcaggcaatgaccttgatgcaattgtggcctccaggtacactaccagacaaactattctagaggctttggaacagattcataggctaagttaagatgcttcattacggcatctaatgtatcaattttttttttttttctttgagacagggtctcgctctgtcacccaggctggagtgcagtcgtgtgatctcggctcactgcagcctctacttcctgggctcaagtgttcctcccacctcagcctcccaagtagctgggactacaggcgtgcaccaccacacctggctaatagtgtatcaattacaaacacatagcaagacaccagggaaaggcgatgagatagctggttaggctagtgtgtgtgcagatgggaggaccacactgcctgcatcctgctgacacagtgtttctttgtgccacctctctccctgccacatcagccttcactgctgatggagtgaagtttgaaccaaggagcccatgcaatggaaagcacttgggccaatggcacagaattgccctctctctggtatagggacgagtgcctggccacagctgtagccgtcagttcacctggagaacagctacacctttctctgcatttcttgggcaggggacacagagggtcagaatagccattgccaatgggtggctgacttaagacctaataaatattgaatgttccatatgcctcatgaatattaagcatagcatcaatatttggctatttagtgccattggtccctctgtcccttcctatgttcagcatgtaggtgctctccttggtatactgtgtctagtataaatcttctgtacttagcttcatctgtcttccttatttaattctcttatttttatggcccaatttgactttcttaaataatacagcgatccacatgacatagtgaaagatggggctggcggtgggcaagggtcagatcacggtaacgcgaccggcaaggagtggggctttattctgtaggtgatagggccaaacccaggggagtggcaggctccccactgccagccactcttatggggagaatggggagcggatagcctagctggagaaaggtgcaggggtgataggtgggaagtggggggtattccttccatatgtctcccaaaacgtgctgagtttctggcacagttccctgctctcagactgagtcaagagcatcctgattttgggtttgcaagacaaaggtatacgccccacgtgtcccgagtactcccaccagcccctaacatgatgcatccaggccttcccgcagcagctctgtggatggatgtagcggtcagcgtctcaggtcagccaccagcaacccaaaactgaaaagtctccttccacctgccaggctcctggggctgaggccctgccccaacatgtggcctcaagagcaggtagactcaaggtgggggcactctccctgggaaaaaagaaagagaaagtcctttacccttcaggcaaggcctgtcattgatgcctgggagataggaataccacttggagcattcatcaagaagtgttgaaagatcagagagaagcaaatctgaatttccactgagaaaatgttcacattgtaaggcactgaatacactttctagcagggatagcaagtatctggcactcaagccagtcatctcccatccagagcccctggcagacattgctaatggatcacagcactctcttgtgttgagtctggaagcacagctctgggccactgctaccagtctgcctactttaatgcactctcccattttgcagacagggaagctgaagtgcaggatagttctacagaatattggaaatattgccgggtgcagtgactcaagcctgtaatcccggcactttgggaggctgaggcaggcagatcaattgaggtcaggaggtcgaggccagcctggccaacacagtgaaaccccatctctactaaaaatacaaaaaattagctggtcattgtggtgcatgcctgtaatcccagctactcaggagtctgaggcaggagaatcgcttgagcccgaggtggaggttgccatgagccgacattgcgccactgccctccagactgggcgacagagtgggtgagactctgtctcaaaagaaaaaaaaaaaaaaacaaacaaagaggctgggtgcagtggctcactcctgtaatcccagcactttgggaggccaaggtgggcagatcacaaggtcaggagttccagaccagcctgggcaacacagtgaaaccccgtctctactaaaacacaaaaaattagctgggtgtggtggtgggcacctgtaatcccagctactcaggaggctgaggcaggagaatcacttgaacccgggaggcggaggttgcagtgagccaagatcgcaccactgcactccagcctgggcaacagagcgggagtccatctcaattaaaaagaaaaaaaaaaaagaatattggaattgccagaggcactggaaccaacagtgattgtgaggtttaaaacagaaaaggaaaggaaaaggaaggagtagagaatgcaggggcttttcttcactttctcttccccttccggtggcaggagcccacagagaaggtgctagaagcaaacccttgccagaggggtcagatgatccctatttggatgccaggtctgggctggatgctttgggatccgtgacatgggagtagctgtactctccctctgaaacatgcagcccagtgggaatgacttggcttcatttgagagacagttactgagccccttcagcctccagggctggacgtagcccttactcgatgttgctgtcccaggcacttcctccagcccagtatttcttttattattgcttcttcacagtttctcaccttccttttgagacttttagtgttgactaaaggaaaaatgatcaacttttaaagaattcaggtttgttttcttcagaagccttcctgaggactgtagacggaggccagcagcccgggagccacccttctgtgaggtcctatcagatatcagcacagtgtttcagcccactgcttaaatgcaggtggggggctcagcacctgcagaatcacatcagacttgctgagaagtgacactgaagcagaatcacatcaaggtttgggcctgagagtgcgtctggttagagatgacagaggtgtcatcactaaccttatcagacgtcatattatgtttgggaaaggcaaagacgagggtcatttatcttgtagggagaatagagactcaggcaagagacctgggaggccatgtgctctggcctgctttgtcctcaaagcatctttccggagcgctgcacatcgtcacggagtcaggggccttgtggagtcatgccagcaagcagaaatgagcaggcgtggcttctctcgtttgctactttgtctcacggtagtgagaggtcccctctctgtccactctgtgttgcttccattttctgtcatttcaacctctttgtccttctctgagttctaggggactttctcaaatgtgtttaatagaccactcagattttctgagtgtccgatctgccatttgctgcatccgtcccagccttcaatttagcactcttgtttttcatgtccaggaaatccttctgaccttggattactccctcttcatggttgcttctcaaggtcccatagatgcagtgtatactttcctgaatcttggtggaaaccaaatcaggagttttctaaaatgttttgtgtcttgcagcaaagctaacttagaaggcagcatttcctcggtttctttggaatggtctctttttgaactgcagtatctttacgggccctgtgcttttcccatattgttctcatcctaaaaagaaatcccactgccctgctcattgaaggcactcgataaagtttatttatttcaaatcccaagaatgcttccaaagaaaagtatttaagaaagacagtgtgaaagggatgctatgtccatttgctcacttcctctgagcactatctgcactcctaggtagaagataccctcgaaagaacaggtgagccaggtgcggtggctcacgcctgtaatcccagcactctgggaggccaaggcaggtggatcaagaggtcaagagtttgagaccagcctggccaacatggtgaaaccccatctctactaagaatacaaaaattagctgggcatggtggcgcatgcctgtaatcccagctactcgggaggctgaggcaggagaatcacttgaatcgtggaggcagaggcactccagcttgggtgacagagcaagactccatctcaaaaaacagaaaaaaaaaaaaagaaaaactagatagtctgggcacagtggctcacacctgtcatcccagcactttgggaggccaaggcaggaggattgcttgagccctggaattcgagaccagcctgggcaacatggtgaaaccgtgtctctaccaaaaaatacaaaaattagcgaggcatagtggcatgtacctgtaatcccagctactggggagggtaaggcaggaggatcacttgagcccaggagagcaaggctgcagtgagccatgatcacaccaccgcactgtactccagcctgagcaaatgagaccttatctcattaaaaaaaaaaaaaaaaaaaactagatacggccatcagcatgtaagtaataaggacaaacaaaaaataaagaagtaaataaaaagaaatgagcactatatttgattctaagattcttggtagtcaaaacaaaaagtaaaacatgattacaaagactcacaacatccaaaaaatgaaaacccagagttgcccaagagtcctaatagctcccattggatgaccaataaaagacgattccagtggcgtaagcaccagagggcgctgtgtggtacagcagccttcagggccactggttcccactatgccctgtagaggctgctgacctcaagttcacaagcagctgaaacaagacccctgcaagttcaccccatcttagcccctttgttctggctaactgcactggacacctgtccttacatcttgacagctgctagcagatcaaatagaccacattttgtttttccatgtatcagctgatggacacctgggtagtttccactttggggctattacaaataatgctgctaagaacattcatgtacacatatttttttttgaggcagagtctcgctgtgtcacccaggctggagggcagtgtcacagtctcggctcactgcaacctccatctccagggttcaagcgattcttgtgcctcagcctccctagtaactggtattacaggtatgggccaccacacctagctaacttttgtatttttaagagagacagggtttcgccatgttgcccaggctggtcttgagctcctgacctcaagtgatcctcccacctcagcctcccaaagtgctgggattacaggcgtgagccactgcaccccatccacatacacatttgtgtaaacagagttccttacgtcttgtgaactcaacaacaaatgtttttaaatttgtaatacttctccagtatttctaggggttttataatggagagtttttaggatattgggaaaaagaagttgtagccctccttcagtgtcatccttcccaagcttgttctcttaataagaccatcctgtgttgtcagtgtgtgggggaagcagtgatgagcaggcctggtgggtgccattcagatgcctttagacccacatcacctctgcatccttcctcccctctcaggtccgacgcctccttatattgtgatgatgttgacattcgcttcagcaaaaccatgaactcctgcaaagtgctgcagatccgctacgccagtgtggagcggctgctggagaggctgacggacctgcgcttcctgagcatcgacttcctcaacaccttcctgcactcctaccgcgtcttcaccaccgccatcgtggtcctggacaagctcattaccatctacaagaagcctatcagtgccattcctgccaggtggctgaggtgccctcctcctcccatgcccggagagcttccaagccttggaggaaaactgagcttgcacggggccggggggtgacctggaaggtccctggaggagcagcagtaacgtgttggggtgctgcgggacacacaccgccactgccccctctccccaggaaccaagcctccctctgcagagaggcagggacagctcacctgcctggtgctactgctcagtctcagctgcttccatctccacctgccaggatcctggggtgtggagggtgctctcacctcttagccccgctcctggaagcacagggtcccaccgtcaccaaaggacagtgcttcctttggtgaaaaaagagaaaggaaatgaggaggggaaggaggacagaaggagagagggagagggagaaagaaaaataaagggagagaggaaggaaggaagggagggagggagggagggagggagaaaaggactcttacccctgctttgcttagaccacctcctactctaagaaatgatggagccctttttggcctacttggggtgagtcaacataaggagtgcaggccaccttagcctttgcttctcaaaagtcatggggcaatgaaggacttggccaaggctgtccagcagtaggccaagttcagggattggctcaggcccctaatggacttcactgcatccaggaatggtaggtgattatcttttccgagaggccacctacccagatcccagttgtggacagcccatcccagccctcagaggctcagaggctctctgagtgccctgccccaaaacaccctaggcaagacattatgccagagcctcagctctagggctgcctggagcagagctcctgaatcacactggctccccagggctccccaggaacctcaccattcctcccccaatccacacctctgctgccagagcaacgcaacgacccagaatacacccgttccctcttctgttccctcctcctgcccccacctcaggcctcactggggcagggtacatcttgcctctctgccctgaacttctgaaacctcaatgatcagattcccagggctctgagaaaacagaagcaaacatcccatccaggatggatttaccccctaaaagtcactgagatcattcccaggggcccagcagacagtgtccttcctttcccagcagcagtgccctgcagaacaaagaggctggttcagagccagctctcagccctatggccttggctgagtcccttaacctttctgagactcagtttcctacctgtgacattcctgcagttatcctgtaggaataagagtgcctacgtcctggggcaacagtgagggttaaaagatcaatcctatcctgtgtgcaacgtggagcagacagcctcgatgagacaagctatggtttgcaatgttctggatgtataacctgtttccagcctggcctgaggtggaaccctgtcatgaggatggtaggggccactttcagcttcccatccccctaagtttgcatatagggccgctcaagccccaaagcaggtggaaaggaccctgcgtttagagtaggaggcatcagatgagtcatttcctgtctctgagcctcagcttcctcattccacaaaacatgcctgaggacctctctaaggatgaggccagagagtgtaggcgggagcaggccctgtgtgggatggaggggggttttgcacagtccgcagctcaggggacccttagcacttcaggtcagatgctgcagctgctgccctgagggggtgggggggcggagcatagaagccccagatcctctgcccaaaccatccagagcaggacccttggccccaggccatttaatcgcattgtccctgctcagaggatcagctcaagtatgggtttcagggatcctaagaatgatggagccgttgctgccactccgagccccaccggagacggcccccaggcctaggcgggcaggcaggcctacgctaactgtcattttcacccccgccctccccacaggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagtgagtggccatgccgtcggagctgccccccagcctcccagccccactgaggctcagcctggcccagcaaggcctcagggctgctcttcctgctcccatggggaaggaagggagaggcttgggggtcccaccaggcagatagtggaggcagcacagagtctgggcggtgcagagaggtagccgtatgtgggagcccaggctgcggggggaggcaggcagaaattcccagggcatcgccacactttagatgagtcagttcccatcacgagcaatttaggcatccctctgccctgaccacagcatcctacggcatccctgtgtttgtccatgtctgcagaggacagggcctgggccaggcccattcagggcccgggagagaagaggtcgtcagcagctcctgccccctgggattcagtctggctgaggacccagaccagacactgaaatgtggacacctgatacgaatggcttgtgtcaggaggatgctccaggggcacagaggttggggtgggaacaccattaggagcgtcatagaaggcttcccggaagaactgttcgatctcaatttttaccaagaggaaaggagaacattctagaccatgggaacaggatgggaatgactgaggagcaagaaaaggccttgtgtgtttcggggacagctggacgccaggcagacctggaatgctgagtgtgagacaggctggagatgattccaggacaggctggagcctccctactctcagggtttctcctgactgttctaaaagtgtcaggtctggttctgatttagatccgaacaggccacatcttgggtgccacaagcattgtctcggttagcacatgagagcacgtgcacacacgcacgcacccacgtgcaaccaggggctggtcagacgccccaggctttgaggaggaggcctttgaagagggaaggatttctctcctctgagctggcaagagggaaggcagagggcacccccagcagagggcacagctggggcaagataaatcctccgccaggctccataccaagtaacactcaccgtggcacatgcagttaatgggtgatgcatgcagctgaaagtcagtcaccaaggaaatggcctgccagaaatttcataatttcacattctgaaatgtaacgcaaggcagtcctgagaagtcatctggtaccaggcttcttgactggtgatccaggagcccatgaatctaattatgtgccaaactgtgtgtgtgtgtatatgtgtgtgtatgtgtatttgttatgtataaatgtgtgtgcgtgtgcatgtgcctgtggacattcttgtctaaagagaagacctgtggctttgtgttctcaaggtcagatgcaactacatccactttctacgtgggtaaactgaggcccagagcagttaagagtttctgaccaagacctcactgtgccagacctaggcttttaatataattcatcagcctccccagggtgtgtggaccaggagtctcccaagattaggaagcctctataattaattatccaagacaggacattttaagagtgaccaggggcacgcggcaataggttaaaagcagaggaaaactggagcagatggtcaccttaactaataagcttcaccaaaaaaaaaaagagagatcgtgtaactcaaagtgtggtccgtggaccaaccacatggccatcacctggaacctgttagaaatgcagactctcaggccctgcctgagacccctgaatcagaatttgcattctgacaagatccccaggtgtgtctggtaaggtttgagaagccctggtggagcaaaagccaccttggagatcgacagtgctcattagcaagagaaaggttctgatgagtcctgcgggaaacaaagctgttaaactttcttcagtggctgtatcccaagtttactctgttttgcctcagtaaattatagacataaattttaaaatcaaatatttaaattttaaaattaaaattaagaaaagtaaaattatttatttcttttctcccaggctcagaagtctccatgagagaggagtcagatattgatcaaaaccagagtgatgatggtgatactgaaacatcaccaactaaatctccaacaacacccaaatcagtcaaaaacaaaaattcttcaggtacaatgcaccaattcaaaaccacaaatagatttccagtttgggagagggcagtaggtcaagtcgagtcaaggcaagtgggtgtcatcccttatgctttatgagtgactcctaagagcagtaacttttctgatatttcataacccacccaccaccacccgccccccgccaccccaagggaaggggctgtgggcactggaacattggctgggtagatcctgctcttcaactcaaccaagtcactctcccaacttcagacaagactgccttgagcccacccagcacaggtgggcagggaggctcagcatctagggctcattcgtggaagatcctgattcagaaggtgcttcctgaaccccagcacaggtgggcagggaggctcagcatctagggctcattcatggaagatcctggttcagaaggtgcttcctgaactgagtgccaggctctgcacagacccctttcatcatcttgacagctttgcaaaaaggctaggtgtttcaaataaggggaaagactccaagaggcggtgacattgctcacccgcagtcccagactcctgatcctgaaggatccttgagaagcagtcttggtctccggttttcataaagccctttcccctatacaagggggctgtgagatacccaatggtgagagagagctcccaggggacccacctcccaggcagcccctccccacacagctttctccaatgtccctgctctcacatgcaaagggccgcctgcagcctgaactccccactatccaggctttcaaaaggaacccaataggtaacagggtcaccgagctttagagagaaactgcctggacatactgcagccctgccacagctgctcagacacacagaaacagagctcatggagagccaaatttcagaaataagctttgagtccttaaaataaatcatatgtgcctcacagcattaaatactgctattttgtcttcagtagtctggattgctttccagagacaagatgaaaccaaaggtttcaagagtaggtttctcctatcattactactaaaaattatgattattattattattactaatagcaatgatattccatggcatttatatagcttttcacctaacacaaagtactttcatctatgttattgcctttaatctttatatccaccttttgaagctttatccctattattcaaaggagactactgaaacccagaggggttaaatgacttacccaaggtcacacagctagtagggggtaggggagaatttcaactcaggtggctggactccaagagccatcctctctccatcccactgtgcccacgagcccatcagtatgaattgttatggatgtcagacattggacaggttatgtgttaatcccaagtagactgagagggtaagaaaactcatgatgctgccctcaggcaggcctgtgccctgctggacctgagaggtgaaggggttgagagctgcagaaagatggatggggtgactggagacctttttcagaagcaggagtgtgctccccaacctgggacagccctgagggtgttgtggtgtgactctccccagagcttctaacacagagagagacacacacacacaccagcaccacccgacatgccctggtaccctgaagacacagcctgctggctcttaaggctgctctagcctcgggacccctggttttctaacagcctgaggagttgggactggggacagctgagggttggttccctcctctctgcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcaggtatgtggggtgttctccactcacagggtcctccccatggtcagccccagtggcaggtgatagcagccatggtcccggggacttgctctgctgtgggtgtttaaggtgtgctaaggatggcacaggtgggtcctgttaaagcacccaacctcggggagctccctgcttcaattgactacagtcactcactggacacgaagcttcctgaatcattattttggcttgggcaccgccttccacttgtggaggtgctgggtcacaacccccacctctctgcactggttggggctctgcacacacccagggcctgaaccccacacctagagccagggccactgcacatctagggcacagcgtgccctgcaccctcctcttccagctgccagctgaatgccatccatccttcccccaaacttccatcctgcaggcctttgctagtgctgaccctcctgcctggaggccccttccttcccacccatcgccctttgctacttggccagcttctactcgacataaagcccattgcccatgggaacctctgtcccgccatgctcccacctcccacttctgcatccttgatcctgcagcagagactggaataggggcccctttgagctctgttccctggggaggccctgcgtggctctgtcttgggaggctgcctgaaccttccagcagctcttgaaagatggagaggtctggaagaggctgggcatgcatggaccgtgttgactgaggagccatgacatctgtgctattggtcagacactagttgttaaacatgttgttatccccctgcccatgaccccctcactcaccccaactcagccagatccgagaggcaaatccagactagtgtcaagctctgtttcttgtcctcacctgtcctctctcccctctgccacgcatgctgccagggtttcccccagaccagaggaatggagacaaggagtttgtgatccgcagagcagccaccaatcgtgtcttgaacgtgctccgccactgggtgtccaagcactctcaggtgggtgggagccctccctgggcaggctgctggggaccaccaggcaatggccccaggaaccagctgccttccaaaagcagctgcgggcagagtgagctgatggctggcagtggggcagcagaagggagggagctcaaatgtgccaccctgatgttcccggaggactgctcagattccctaggagggaacaaaggacatggaagggacaatgggtctctgtctatccaccctgcctgtagcaggggtacaggtaggtttgtgcctccctggcccaggggtgcagccagctgaaagatgggctttgatctggttccagtgcctttatctaagattctctaggcctggagagcctctcatgccctgccaggaagccaacagaaaggaaatgaggcaggtcagcctgccctgggcagaatagaaactggagctccttcctctggcctgggcccagaccactgcagagcagctcaaaaacagtaaccagagccacccatcacaccttcccggcaggactttgagaccaacgatgagctcaaatgcaaggtgatcggcttcctggaagaagtcatgcacgacccggagctcctgacccaggagcggaaggctgcagccaacatcatcaggtaaaggcagtacctggttcctggctcagaactgcctgctgggacaggagccctgccttctgcctccatgtgggctggtcagaggcccgggaggtgaagagcgcccttgtcaaggacagccccaagtaggagtgctggggtagaggtgagctcttgggggcaggctcagggctgggtagtctatttgtccttctttcctctctccccaccctgcgccagaccttgatctcttcaaagcaagaacccagcacacttctccatgtgtgtccacagctgctaacccctgtctagcctgtgccatccaatatggtaggcactagctacataaggctatttaaatctttttttttttttttttttgaggcgaagtctcgctcttgtcacccaggctagaatgcagtgatgtgatcttggctcactgtaacctccacctcccaggttcaagagattctcctgcctcagcctccccagtagctgggattataggcacctgccaccacgcccagctaattttttttgtatttttagtagagacggggtttcaccatgttggccaggctggtctcggtctcctgacctcaggcgatctgcccacctcggcctcccaaagtgctgggattacaggcatgagccactatgcccggccttggctatttaaatcttaatgaaaattaaataaaatttaaagttcagttcctcagtgacatgagcccagcagcctcagcttcacccccgacatgtggctagcagtccctgcattggacagtacagggtgtaggatgctgccatcactgcagagatctattaaacagtgctggcgaggcctgatttgtaggtgcttgagtgtctgttgaattgaattcagttaagttgtttatccccaaacccatgcttgtcctctcctggtggaggtcagggtcaggcagcccgatgtctgagctgctcagccagtgactcatgtgacctgggcaagtccccgctctgagcctcatccataaaatgggtgaacaatacccgcttcaaggctgggatgagatcacgggtgtcacttttacaggctgttcagtgggtggcgggcacctaccgactcagcctgtctgctcccagcccagcccaggtgtgagggcttgggccctggcctttcctcctcacctcttgcctggccccagcctccccagactttcccccaagtcctgcctgtgaccagagtgcccagacatcctccccagccaggccgtggaggccccatgctggggcccattcttccctcaggctcacagtcctaaaatctctttcaggcctccacatcttcagtacagaggccagagtgtgtgcacacatgcccacacacacacacacgcacacacacacagccgccactcgtggtcctcccaggaggccttaggagtgtgtggagccccccaccgagcatattgatcaaagccaccctcggaggggagcctgttccctgggtgtgatgaaagagcaggctctggagttggcagccctggtttggagcgtgggcccaccatgctccagctgcgggaccccaggtgaggcagttccctgaggggccgtttcctcagctgtaagatatacacgacaatgccttctgccaggctgatccagagagccactccccgcagccccggcaggcctgcagacccctggctgtccccacgcagcccaggcctggctctccagtgtccgcagcctccgttggtactcaccagctgtggctctgagcccatcactgtgagcgtgcggcactttggcctgactttgaggctctaccctcattccccaccgtgtgtaccactctcctctgctctcccaattccatccttgcagtccctcctctgggcctgtggctgccatgctgctgcctccccactccctgtgcttccttcctgtcatgcatcctgtcatccatgtgctcgcaggagcgcctgctaaatgtccagtcctgtgctggcaccagagctatggggctgaatcagacaccgtccctccctcgagggctccctgcctgaggtggcagaaaggccattcccacccagccagatgcaggaagcccaggggctgagagggccccagaaggggacctcccacagccaggagcgccaggaccatcaggaagaagagtgaaggaggaaggggaaagggtgctcctggcaatggggatgacgaggacagaggggcgtaagagcagaggccgtgtggggctgtccgagctggggaggggctgctgcaacgtgaagtggggctcaccgtgccttctcgctcctgcctaggactctgacccaggaggacccaggtgacaaccagatcacgctggaggagatcacgcagatggtgagctgggcctgccctcttgctttccaaggctttcctccccatcctcctgcccaggacccctgacccagcacaggcatcacccgtattcattttctgtggctgttgtgaaaaaataccacaaactgggcggcttaaaacaacaggaatgggctgagcgcagtggctcatgcctgtaatcccagcactttgggaggccaaggtgggcagatcacctgaggtcaggaggtggagaccagcctggccaacatggtaaaaccccatttctactaaaaatacaaaaattagctaggcgtggtggcaggtgcctgtaaccccagcttctcaggagactgaggcgggagaatcacttaaacccaggaggcggaggtggcagtgagccaagatcctccactgcacgctccagcctaggtaacagagcgagactccatctcaaaaaaaaaaaaaaagaaagaaaaaagaaatgtattctctcatagttctggagtctgaaattaagatgtgagagggaggccaggcgtggtggcttacacctgtaatcctagcactttgggaggctgaggtgggcagatcacttaaggtcaggagttcaagatcagcctgggcaacatggtgaaaccctgtctctaccaaaaatacaaaaaattacccgggcatggtggcgcatgcctgtgatcccagctacttgggaggttgaagtgggaggactgcttgagcataggagggagaggttgcagtgaactgagatcgagccattgccctccagcctgggtgacagagtgagacccccatctcaaaaaaaaaaaaaaaaaagatgctggaagggttgtgctccctccgaagcctcaaggggaggccccagtggtggtataagagctggtgttcacacccaggtctggctgactccagagcgacaactctccctcattccgtctaccacactgcctcatccccagaagttggagtgcagctcaccacctgcccagaaatgatgggaccccagagacagagctgtgctcaccatgaacaaatccaagctcatagtggcattccagacggaataagggaatgatggtcttgtgcacttccagggtccagctacagcccacttttttccaagtcagtgatgtgcaccccagaatgccatcacaagccaccccagagcccttggcccctgcatcacagcggctggggatactcaagacaggctcactctgaccacaccttccccaccagaggcagagattgtgccatgctggctcagccccttgctggttgagtgaccttcagtctgttggaagtagccagcgtgaggacttgggactctgggttctgggcccctgctgcccctgcccctcccatgttcccctcctggttcctggaagtggtgagggcacctatgaagctgtaagcactctgcccacactctgcccccagagcagtgctgcagggctgggcccccaggaacccacacgtggtccacaggcagggaggttgacggtccccagaccctacttcctccagactgaccctttggggccagaatgctgggtaaaccccaagacggaagtactcctctcggcagctgaaaggaagccgactgcactctgctcctgtttcccaacaggggctcacctggaatgtttacccctcaacagcatgagggccccttgttccttcgtgaacagcctgaggttcttccagaacaaacagctgctgagctgccctctcttgtccccagagcctgtgtggggcagatccgggttgagagggccccgcggcctcactagagacagtgaggattttcaaaagcctataaaaggtggaggaagttgtcagttttgatctctgcttccagggtcaccctctttcccaggccaccccagaagtgagcggaaggagccaaccaccccaccttggccagaatgcctcttctggcctctggtaccagtgcaggcctctgggccccacagcgcctgggcctctgggccataagccacccagccccttgagctcacccttggccctggcagttcagcccaaccccagggcaccaggcaggaccctcagatgggaaggtggctgggctgcccacctgtatttattcactcagctgcttcagaggctgagggtcccctccctgtgagcacacaggggatcccctgcctgggttctctcactacaacccggcatcccagtggccctgccactctcctttctgtgtccccaaaggcttcatgtcccccaacacccatgctcctgcacctgggtttctctacacacccttccctgcccagggcagctctgccaggaaaaactcaccgacagccaccacacaaacacacacacacacccacacacacacactacacacaccaaacacacaccacacacacatacactacacacacccagcaaacataccacacacacaccagaccacacacacagacaccacacacacaccacacacaccacaccacacacaccacgtacacacacacacatcacccacacaggcacacgcacacacaccacatacacacgccacaccacacacaccacatacacacatcacccacaggcacaccacacacacacaccccccacatacacatgcacacaccccacaccacaaacaccccatacacaccacccacacaccacacacaccacccacacaccacccacatggcacacacacaccacccacacaccacccacatggcacacacacagaggctgtttttctccacggtcctcgctccattcacatgacttggaaccacttaggctggagatccctgacgtcaggaaccgtgtttcctgcctttctatctcagcgtgtagcaagggccttggtgcagacctcagtgcccgtctgtggaggaaatgggaggaagggagacacttagtctaggagggatggccccacttcccttgggacccggcagatgggctgcttgcaggtgctcagcccagccgggacttctggacagggtaaagtgagcatggaaaagcgaaggcatgaggcacacgagacagtcatctctcagagcacctgctgcctgaggggttgaccgctctcctcctgtgtggcccaggtggtcctgaggtggtgatgggggaggattcttgttcctaacaggctcctcccaagaccaacacagttgtccctttacccaccgccttccagcatccctcactcagatccagcagaccttccacgaggcctttgtgcccaatacactggcctccctatgtccaccactcatccatctcctgccgtggccaccactgtcctctggctaacgtttccctgaagattttctctggtcaaagggcccaaatagtggaatcccttaatgatggtgtccaagggtggcccctgggggccagggacacggactaaggcccaggactaaggcaggacagctgtcttctgagcacagggccatcccaggagctaatcacgcctgggagtccacacctgctagtttcaaaaggaaattgtatagagccagctgtgggctcaggcggacgctgaagggagtggccaggcacagcctgaagtcagacgacctgggctccagtcctagtcagcccacttccagcttagcaacttgggccagtggctcacctctggaagcctccattgtctcatgcacgtgctgggagctccctggcagggtgggtgagggcggtccgagcactgggctgcacacaccggcacaacagggcggggcccatctccctccgtccccttccctccacctcccctcatcatactccatccaccctctcatcagattcgaggcagcgtcataccccgtccacccgcccacccaattcgagggcgagatacccccacagaggcagctgggaatccaggaggtgtccgtcatgggcctaactcaaaatgttgctcccccaactcaaaaccaggctgaaggcgtgaaggctgagccctttgaaaaccactcagccctggagatcgcggagcagctgaccctgctagatcacctcgtcttcaagaagattccttatgagtaagtgttgcaggcaccacccgcctccccccgcttcctcaggcactgtcttggacagcaccctggaagcacacgcagtgaatttccagagctgcacggaccctccacagcttgaaacaatagtgcctgggtcagcagaatgagggagagaagcctgttcccgttcctgcccaccaaattctctccttacctgtcagctgcacacacacacttttctggaatcatctctaactcagagctcctagaaagagagtatctagaaaagagcatgtgttcatgtgtgtgtgcacatgtacctgtgagaaactgtgcacacaggcaagagcgtgggcacgtgtgtaggtccagtgacctccagtagctgatttaggggacaggcgtggactttgaagaagccccaaggcctgctgttacctgttctggcctcagtcatccctggtgttcactgcaattattctacttatgtaattttctatccctcttccttcatctgatgctatgccaaaagggcatttgtaaacactatttttaataagtacacagcattctctaacagtgtgttactaagccacgagagtgttttcagccttcacttttatatttatccctgcggtaaacatccttgcaacaaatatgtctgaattcctaacaatggtcccagaatggtttcccagaattgggctcaccggatttgaatcattgtggggcttttggcctcagccccacctggcactctcgcagccctccccagcatgggtgctgcctcgtgtaaatagagagggtcggcactttggaaacctgtcacatctcctggacatagaaacagatgatattcctgatatgtccctctaggaggagaagcgggatgtgttttcaaacacaaatcacctccccggccccttctgcccacaggactctgccgaggtcccctctccctgtcactttatgatgtcaggagcctgtggcttggcttgcaggctttttaagccttttatctgcccccttttagggccttctattccctcatcctacagaccagctgctgcagtgactaaaatgtgaattctccctgtcagaaaacaagattcataacaaattatttccaccatgtgtgccttcccacaccttatttcagcctcccagtaaacctgtgaggaaaggattgtcttgattcccattttacagataaggaaactgaagccctgagctataaagggtttgtctggggccacacagctgcgacaaggcagagctggacttgagcccaaggttccttccttccagggctctgcagaaggttgttcccccagaaatgacagcctcaaaaagccaaaaaataaaataaaaagcatggagcaatgaaatcagcaaggcaaacctcaccccctccacctgggtctccccttacttcctacagggagttcttcggacaaggatggatgaaactggaaaagaatgaaaggaccccttatatcatgaaaaccactaagcacttcaatgacgtgagtatggatgggagcgcctctctcactggggtttttctttggcaagacgctcaagaggctgggtagagaacgggctatacacctggctggaaccagactcctgggtcctctccagccctgccaccccttgccatgtggcctcgggctggttgcctcacctcagtctcagtctcttctcctattaagtggggctgaccatggaacagtcataggaggattaactgcgtggtcatctaaagacattcagcccagcattggctcgctgtgagccctcacccagaacttgtgattcctaagtgggggttactcctcggagcagggtttttgcggagtctgtggcaaagagaacagaagggaatgaaggattagaaggaaaggaatgaagaccttgctatgcttcctatttttaaacctcatctcagtattagcaacaagcaatatttggctggacaatggcagacagcttccctctaattcatacattatccagaaccctcggaatctcctaaggttttggctgtttcagctactctggcaatgatgtcccactcgctgcccctcttcttgcctttcttgtggtaagatggtcttttgggataacactaaagagaatgtttaattctctttaatgttaggaggccacagtgctgagcgaatgtttaattaaacattctctttaatgttagaaggccacagtgctgagcgaatgtttaattaaacattctctttaatgttaggaggccacagtgctgggcgagactaaggctcctgaatctccctggctaggatcaggatggcccaatatccagctcctccagcccccttctctagacctcccagccccagctttcctggggaagaactgttgagatgggaccaagcactggacctgcaaactggcctggcataagcagctcaaagggcctggactgactctgattggcacactaagttcagatgggtgcatcacacacccccagctcccagaatccctcctcagagaaacatgggagcagcagagaactggggggcagacaggtcccagagccttctgaggcacaattcacatccacagggagcatttgcaatgttctttaataagaatatccactgccccctaaccgggtgcctaccttgtgcctagcactgagctttttgtgcatagtaatctcattgaaagctcacatcaactaaaagatgggggctgtcctcacatttttaggtacaaagaaaccaagactctggaagggcaaatgctgaggtctcctaactggtgtgtggtagctcatggcttccattgctacacagtgcaaatcagctgtgtgaggaaaaaaaaaaaaaaaaaaactccctcccagcaacttccccacatgtgtgcaagttccaacccctgaaccacagagccgggtccactcccagcctcgtgacagccctgagaacagttgcactcagcatcctcattcttctgagtttaatcatcaacacgaggaaagagcctttgagggccggtggtgggagcacatgattccacttgccctgaccaccttggccagggccacatcctaccaaccccagccgccagcacaccatatcctgggaggatcctcagcagcctagaagaaacaagaaagacccagagattgcagctcaggggaggagccctttggggcctcctaggcctgggcacccagtggttcctgcagtgagcacagcagcagaaaggagactcgtgtgcctctcaggagagaaagagggacagagaccaagcctcgggaaacataacctgacagaggcctgatccaaccacaccttacagcaccaggcaacaaatcactgtcccctcccttccctgtcccactgtgtgcccaggagtcgagcaagtgaaagacaagaatatgaagtgagcattcactgagtgttcaccccatgctagacgctgtgcttcaaaagcatcatctcatttaatcctgccatgcccactttgtggatgaagaaactgaggcttgaggaggggaaatttcatccccaacattacacagcagagtacaattttgaacgcacacggtctacttcagaagctgcccttgtaacgacctggcatttggccatctctgttcaaatccaccatttggttctgatacacaggatgtgtgctggcacaacaatgattttcctcgtctctccctggcacagttctatttgctgttttctggtccttttgcctttaatttctttgtcctcttaactggtactggccaggatcttcaggaccatggccaagctggggtactggtgtaaggcaagcaaggttcccagagagcaaaatcgaaggagctactcgcccttctgcacttgtaccccacacctcaactgcctcaccctagtcccgtctctctccacaacagcatggaatggacatggtgatcatgtgtctccttcttgggttttttgtggggttttttggttttttttgttttgttttgttttgtttaagacacagtctccctctgtcgcccaggctggagtgcagtagtacaatctcagctcactgcaacctccacctcctgggttcaagtgattatcatgcctcagcctcctgagtagctgggattacaggtgcacgccactgcacccaggtaatttttgtatttttagtagagacagggtttcaccatgttgcccaggctggtctcaaactccggacctcaggtgatccacccgcctcagctcccaaagtactggaattacaggtgtgagccactgcactcggccaccttcttggttttaaaggagatatttctaatatttccccatgtggaatgatgtttgctcctttaccaggttttttttttaattatcttttattccttgggtgctaatggatttaaccatgaataaatacagaattttatcaaatatttctttctgcatccatagagatggtcatatggtttttctcccttgctctgttgatatagtaaatgacaattatactttttttctaatattcaatcatccttgcattccagggacaaacccaatgtggtcatggtatattaaacaaatgggtgtgtaattttcctttcttatattatccatctctggtctcagtatcaaggtaatactggcttcatagaataaactggaagatattccttttatccttcttctctggaagatttgactgatctatttctttcaaaaattagtataacttttatataaaattctttttaagttccatgttctcttgatggaaaaaaattttaactactacttcaatttaattaagaggtataatacatgtactactttgtgttattatccttcctgattctcttaagtagtagttccattcttaagtagttttacaaatcatttttcttgatgagcatcctttagaaattgtttttgagaagatttcttagcgataaagccctgtaatttttaattcatctgtaaatgtccttttatcgccttttttaaagtagtagtcttttttttaactttttattttaaaataattaaacagtcacaaaggccgggcgcggtggctcacacctgtaatcccaacactttgggaggtcaaggccggcagatcacttgaggtcaggagttcgagaccagcgtggccaacatggtaaaaccccatctctactaaaaatacaaaacttagtcaggcatggtggtgtgtgcctgtaatcccagctacttgggaggttgtggtaggagaatcgcttgaacccaggaagtgcaagttgaagtgagccgagatgacaccactgcactccaacctgggcgacagaacaagactctgtctcaaaaaaaaaaaaagagtcttagaaagttgcaaaagaatgtaccagaaagcccactgcttcctgctgtttcagctccttgcaattctaattccctgatgttctagccccagcttcccacccccatccccagctgctccagatccaacctacatttgatttgttcatgtgtgtgtcatgtttggccaggtgatggagtccttgaagatatcttctactgtgtatgtgagaccagcagtgcttcaaagtgtgtcctgtccaagctctagttgtatgatggtagattccctcagaatttggcaccttttaactgtttatttttccagatgaactttggaattactttgtctataattacttttctagagaaagctctcgttggtatttggttttttgtatgtttgtttgttttcagatttttttttttttttttttttttctgagatggagtctcgctctgtcacccaggctggagtgcagcagcgcaatcttggctcactgaaacatccacctcctgggttcaagtgattttcctgcctcagtttttcaagtagctgagattacaggcatgcgccatcacgcccagctaattttttttgtgtgtgtattttttgtagagacagggtttcaccatgttggtcaggctggtcttgaactcctgacttcaaatgattcgcctgcctcggcctcccaaagtgctgggattacaggtgtgagccaccgcgcctggcctgagtgttttattggattacattaaacacatgtattagttgtcagaaaaatgacatatttacattcccatttgggaatttgatctctttctctgttattcaagccttttatatcctttggtgacctgttttttccatcctacatagttctcattaagttcctaggtatttacagattcccattgttatttggaaggttgtatttttgttgtattttctaattgattattgctaatgtatatataaacttttcatttttgtatattgaacctttagccagcaaccctagcaagctctgttagttgttctcgtagttttccaattccttcttgtattttcaagcaggcaatcatatctgcaaatagtgatcatttatcatctttgcaatacttactcctctttttccctgtcttattgcatcggcttaaagatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcaggtgcgggcaggaggctggcaccactgcctccctggggctggattggggctagggcaggaagacccgtgggctggccactgggcatccacaagtgggcaaaggactgggctgaggtctaacactcccaggtaaaacagaatagcttcccctatatcacctgggaccagatagcaggcccacagatatggcagtgagacctggactgtaatccccacttgagtaattaatacctcaaagtggaaagaatatgatggtgattattggtcccaacatttttcttctggagttggggcaagagtggtggctttatggggatctgcagggcagctgagacagtggtcagatgacccttccatcagaggacccttccatcggaggacccttccgtcagaggacacttccgtcagatgatcctgcaagccccttcccaggattctaatttcacctgcgcttctggccacagagagttagctgcttcctggaacgtgttggctagttgatcaccttaaatgtgtgctcaatccctcttcactcagaacatgaacctgaaaagccataaacataaaacatgaacataaaaccataagatagattcttcctcaggaatgaagttgcctgcattggggtcaggagggaccagcactccttataggagaggacaatgaggcacttggaccacttccttggtgcacttggtggatgcccccaccccagcctgcatgtgtgcaggaggccagacaagcacccccagtagacagggcaagcccccaagcacaatcccttggcagcagtgtctgtcatcctgacgctgggtgggctgtgtgggacccagtggctccaagggccctgtctcatctggaccactctggacttgcatactgtgtccccctcattgttctctttatcacctgctcctcactaccctcctcatgtcaatggcaggtcatgattccacccaccaagcagacgacatgtccataatcctccctacttagcagccaaactcatctgggacatctctgctacccttccctcaccttctggtcactccagcccctgatgacagcaggactacagaacatgcagggacaccccattacaacccagtgggattgggcctcttgcttcttggcacacagagatgccaggcttagggccaaggaccgtgaaagatgctactcttgtttgtgggctccaggaaagagcagagctcaggagcacaggagctcagagctgcaggcacatctagccaaacatggtacatgctgtcatgaactcgtggaggcaagtgttgagcaaggctctgcaaaacctccaagtcacccaacctcgtttggcttgtcaaggttcaggcagggcccttgccacagtctgggggcccattccaagtaaatctctctctccttctcccctgttcttgggaatgacatcatcttttccagaggccctgcagaccaggcttcagtttcccaccccacttaggcttcctggaacccacactccttgcatttcttggtcttgctctcctgcattgccctcctcatggagttgggagggaatgagtttggccatcctgaaatcttctgttctctacagagagtgcaaatcaaggacagtcagtggtcagggcatgtgattcagcctgtgttctaggatgtcattctggacctagggtcagctggcctggtccaaaaatcaaaaatacctttggcaccacatgagatctccaccctctatgcagtctggacccagctgtcttctgcagcccccagccgtgtaagagttgtgtgtctgcacagcacctggccccaggagcttctggaagttcctggccatggcctgctcggcatctgccagaggcagttcattctctctctacaggcgtcccatggacactggagaccctctaaaatggccacgtttcttagatggcctgaactgtaacctcagcagccagtttttactgctcacttaaatgtgctcaccatagcagaaaagcattatgtccaagtctggttcagcccctggcaagcgtcaggcagttggatttcatttgggacttttcatttcccctttcttcttttaacccctctccccatcctctttggggaaaaaaaaaacccaagagacgatctgatgatgatactcttccatacgacagtacaatgactaacgtggatttgtgtgtcgcctctcctggggatcgctgtactttagtggagacaaaagcctcgccttggctaacaatcgattttggcctctctgggagggaacattcttgtccagccagaagtcctctgcttggtgaacaggaagtgatggaatttaggagaccacaaaatcatctttcttcctgacactgactccaagggtccttgcttggttcctgctttcaatcccatattccaagggccccccatttctgcctgctggtgtccacactctaacagagacacccaagatcccagaggcttggtatcccatggagcatcacaggatagaagctcctggcccagctagaagatgcttgaactgcttcaacttggaacatactttttaagcagcagctgagaaaattctgtggcttcccaggccatagagctccttcctggagacagcatgacaacccaaagaggagcatccatacacagcaagcacggggatgtggaggaagttaaaaacgtgcccagcccagagccacaaattggttccagaatatcttctgcacattttcacagcctcagagtacggtgacacttcatctagaactgcatggccactgggacctcctgatcaagcttctgtgtcttccacaattctagagtatctgagctagtattgccttagggaacacctggacttaccctcccattttccagatggggacactgaggcccataaaggcaagaggagtggtgatttgccagtcggcatgccagggataggtgacagaggctggggaggccctaggtttcctgactcagcccccgcctctgacctcaagccgtatcaggtcattcctctgcaggtggatggagaagaaaaggaaggagggtgctgctctggaaaggggcaagtgcaggagggaagctgagactctggaacggaggtgggccagggcatccagcctttgccagtcatcggacagcagacatctcaagtgaaagcagaatcatctgccttgactccgtgtggtgtgtgctattctgctgcatgtctctttcaccagatccagaatacagctgtgctctgaacaggattagtccacaccaggtggcgaggctttttctacttgttgataaggcatggaactgaatggtacgctcagcccttctttccccttgaagagcacacacagatctcttcctgtcagaatggagacttagattgtccttctcagtagacaaatttctcagcagaaatctgaccccaagattgggcgtgtgcttggcctccggggcctgtgtcccctccaggctgactagggctctggtggcgtgacgtaccgctgtgctcccgcggtttctcagccacattctgaatcttgaggaacagagctgcaaaggaagtctctaacctatctcaccattttatcaatgagggagctgaggacccctgagggaaagggccttccctcgggctacacagggaaaggtgcacaaagccaggcttgacccggggtgctccatgggtcagacaaactccagccaccgaaactctgctccagcctgatgtgtgcgctgggcctggcgaggtcgcttggcaaagccctttgctgtggagcttcctcttctccagccaggccttttcttttctgatgatcagttcgtctcccatcttttttcttgatccttaaatttgggtggcatttctggtgtgaaaaggggaacgtgtgaaatgacggtcacatcctttgggtctagttcatgagaaagatcaggaaaatgaaaaatctgccatttcctgctctgagcacaggctcctgggagtcacccactaagtccttctaaactgcccaggtctcgggatcctgcagcatttccaagggccaaatccacactcaggtccctcacacccacttccttgcttctgagagatgtgggagcacaggcacactcaacaaggacccgtgcccaactcctgaggagttcaggggcaaggtgcccaaacacaggaggcccccagatcccaagggaaggcaattctggagccctgttgggcagcatgttggagtgtgggcctgatccccgggcctcggggatcacagcgtgtgctgtgtgttagtaaatgcttctgcttccttctagactaaagctttgattgataagctccaaaagcttgtgtcatctgagggcagatttaagaatctcagagaagctctgaaaaagtaagtgtgtgtcgttttgtcgctgttatttttaaaatcatagacctgcattgcagaggcattcacgtgccgcccccagccagagcaggaggtctttctgtctgtctgttcgtctgtctacccacaagacccctagatttcctggaccccaatggtggagtcctccatggtctgccagagaaactccagagtttgctagcatttcctgagagaagcacaggaatactgctgggatccctgaaagcatagtagctgtgatgataatagtagtggtgccagatttctcgattctaaaatgcacgttttcttttcacattttaataattctgacatcaggagacgtcttaacgtcagttttgtttatttaacacaattgtgtttcctttttcactccagaattcatcatcaaaatgtttgcattttataaacaatggcatccgggaattaaaaaaatacagttttacaataatcatacttaaagtttgtaaagcacttgcctagacattgtgcgcttaacgccatcaacattgcccacacggcggggtcctcagcctcagcacccttgctgttttgaccaggatgatcctttgttgagggggactgtcctgtgcattgtagaatctttagcagcatctctggcctctacctgtgagatgctaatggcacccctccaagttgtgacgaccaaaactgtctccagacattgccaaatgtccactagggggcaaaatcctccccacttgacaaccatcaggataaggctgcttcccgcatcctgttcttccagacaaagaaactgaagagctagtgtctggtccaaggccacgtggacggtccaaggccacatggccgtggcctagcaccaggactggcccaggctggcctccagagcttgtcaaggtttgccctgggctccagacgagctctcccagggaagcagtgattcagcccatctgcacacactgtggccacacactcacatgaagtggggggtttgcttctgtcactctcattaggtgcttactcaggcttctgcactagtctcaaccctcctttccttgagtgagtgttccttcctctcctcgcctgactggctactcgccagaccttggagagaccctgggagatccctggggtcccggttccctatatagctcaggaagcctctccccgcttcctggtgttcccatgatcacggctgacgcagggaacaccagagtttactacccccagaccctgaggatggggccagccaaaacctccagcccttgacagtggctttgacagactgctcacccctctgccagcctcgtctgcctcctctttgcgttttcttcctgccgcatttggtctgtcctttgccagctctgtgtgccatcgccttgaccatctccactttgtttgtgtcctcagacagatgttgcacccatctgtgctgtccagccgtctctcttctgcctgggctcccgagagcccctgtggactgtgcttgtggggagctgccccctccgtgcattcaccaacttgtccgtccgtccgcccccggggcaccactccatccacctcctcacatggctggcttcctcgtctgccgccgccaccaccgctgcctccactgcctctggggccccccattctgtctgagtccccaccctgaccgtcttccctctttcaggtggcctgtgggcccgtgtaagtgtctctcccacattcccctgctccctgcagcacagggcagaggtggcctgcgggcctctggaagctaagagctttatgcaaaccaggttctggacttgcagagacataggcagggcacacagaggagggagggactggggaaacctggggcaaatgcttcccgcaccccctctcctgaggctctaaggttttcacaaagagcggtgttgcatgaatactgagcgtctgtttcactaggcaggggacgggggcaagagtagcgaggtggcagtccatgggcatagccaatgacctccccagagaaggagtcctgctatgggcctcaccatgttggtctgcagcccattcatacgtcccaggcatctttttttagcttttcattaagatatccaattcgggctaggcacagtggctcatgcctataatcccagcactttaggaggccgaggtgggcagatcacttgaggtcaggagctagaaaccaaccttgccaacatggcaaaaccctgtctctactgaaaatacaaaaattagccaggcgtggtggcacatgcctataatcccagctacttgggaggctgaagcacgagaatcgcttgagcccaggaggcagaagttgcagcgagctgagatcgtgccactgcactccagtctaggtgacagaacaagactgtctcaaaaaaaaaaaacaaaagaaaagaaaaagaaaaagaagaaaaaatatccaatttctgccagcatccaggctggagaatggccttattgcatttcccagccgagacttcaccaccaaacaccccactagccactctcttaaatgtcccttgccccacctgcaacagccctaactatgtgtgccccttcagtccctgccagatgccctgagagtggcctcatctccccttctcattccccaagcctacatactggcaaagtcctatgcctgttccctcctcccaacctcccagcaatcggaaccttcccccagctccaggcaacaagaatttggttgaaaactgaatttagtagcaaaatgtggtcaccagcatttttggggccgattccagttttgactaccctgtctaatctcaaccgagcacacacttgcatatctgcaccttttgtgtttaatttgaataggaagcccttgatttagaggaacacgggggacaggctgttattgtaggctgctgcagtgaaagcctttcccctttgttcccctgaattaaggatgggaacagccatggaggagcgtgtcagctagctgactgccaggccatcccctataccctttaatcagggtgagaatcaatttatctacatggatgtcatgagcccaaaggctgagctctagagtctcaggggttccagcaaagccaagtatctatctctatctttattctctgcctgtgaccacagagcagcctagcaacccagtggtaaaatgggactttccacccccaccccatcgcagttttgtttttcaaagactacttacctgatcaccctgtacctcctgccagaaccttggaccctggccccaggggattcagcccacacagcccagcctcaagggccctcacgccctccctgaatgcccttccccaggcctcaagatgggagagaggagatccccaaccacagccggcagaaacttgtaagagagaatagcccatcccacagccagggcagtacagggaagagagaagttggagagaaagaggaaggggaggtggactcattgcttgtctcgggttggtttcctggagtttggtgtagagcatgggcagctgcctcttgccagcagcagctggtcccccataatctcccttattccatttaacatcatcaggagcgtcttggtggaaagaaacatccagtttgggggctccaaacaaccacaggcaaggccaggtgtcaccagcatgggagtgcgacagcgaggccttgcccagaaaccagaagcagctttcaggctaggggtgggacactttcctctctgctccctaaaatgctagctgcaggcccgtgagggctctgccagaagaggaagccacccccgtatcagctctgcttgataggccctgccaagggcaagactggacctcacccgagagaggccaaaaggccaatatggaaggttcaggacttgcctgttgttgggtgtcttgcctgcaggaagccccaacatgcttcccttttcattcagaggctcggtgtggctcagtccctatgccgtgtgtccctgtggggccctccagcagtcctctgtcccaatctggcaactccatacatttgcccacatggctctggatttcggatgggtgtgtgtgtgtgtgtgtgtgtgtgtttgattgagtgttctcttgtcccctccttcatggcccctcactatagagcaagcttgtccaacccgtggcctaagggccgcatatggcccaggatggttttaaatgcagcccaacacaaattggtaaactttcttaaaacattaagagatttttttgtgatttttttccagcttattagctatcgttagtgtgttagtgtattttacgtgtggcccaagacaattcttcttccaatgcggccagggaagcgaaaagattggccacccctgccatagaggtagtaaatagggacagaggttagtactggggctgggcgtgctacttgcaagtgattcgattgcaaatccaccaccttcccacagctgaaccatgactccccataaataccaggggaagtcgaccctcagtgatcagaggacctctgatccttttcactgatctgggtggtcagaaacccccaaaagccttgagaaacactctgagtcctttggtcatttgcagtcagcttgcagtcaccaggcctcccgttctcccttccatccttagagcactccacggctacctggctactgtcacacatgcagggtgaagggggagagcacctctcagaacccaccggtcagcactgccacagccttacgactccagagttacttctcagatctttggattatttctccatcagactcataagcctgggcttcagacttggagtatgatagaaaggaaatgaagagctggccgggcacagtggctcacacctgtaatctgagcactttgggaagctgaggcgagcagatcacttgagcttaggagttctagaccagcctgggcaacatggcaaaaatacaaaatttctgtccctaccaaaaatacaaaaattcgctgggtatggtggtgcatgcatgtagtccagctacttaggaggctgaggcaggaggaccattggagcctgagaagtcaaggctgcagtgagctgtgattgtgccactgcactccagtctaggtaacagagtgagaccctgcctcaaaaaaaaaaaaaagaaaaagaaaggaaggaaatgaagacctgtgcatgtaatagtcatggactggaagggatggaaggatgcaaagcagcccctccagtggctggatgctccttactcttttctttttttttttaatcacaaagcacagtaaatatatatatttgaaactacaagcctgtatacaaatgcatatatgcatcacaggaacaaaaattccacaaaacaatatatacctttatttcatttgatgaagtcagatattttctttttcacttgttatttttatttgttttcaattaaatagagatggggtctcactatgttgctcaggctggtcttgaaccgttggactcaagtgatcctcccacctcaacctctcaaatcccactgcctgggattacaggagtgagccaccactcggccctttttcactttttaaaaattctggtctacaccttctaaattgatttcaacacccatgaaagggtcagccctacatttggaaaaacacttctgtctgctgtgtccctaacgccaggcctctgcctccttcacgactttgccatactgtgccaactgtatttgtgtttacctaacagcctctttaaattaattcactttttcccaaaaagaaataagaaggaaattttgtatcatggcaaatggaaaaccagcttacttgctgtaaatacaagaatgccatttaaaaatatatggtaaaaacaaaataatgtttttgaattctggccaaatactgatgtttgccaacactctgattctgacacctgttgctatttgtctaaaaagagaaaatgtgaaaggaggagaatggcaagtatcaaaagtgtcaaagtcacactatcaccaaatgcggcgctctccctgagcagaagggaaaaaagtaaaaatccaatgtttcttaccacgtgaattcatgttatttaatatcgtgcctgtaaatcagctgtgagaccacctaaaactgtcttagctgctatcattgctttatacatgaggagcctgaggaccagagagggaaagacctggcctagggtcacacagcaggcaggtgagggacaggggccaggtttctgctcttgctctatcatcctcccggcctcaccttcctccaggctagcagggttgccaggtggccacaaagagacaaaggtaagatgggctgggaataagggtcactgcactgtgctcgatgatgccaccgcatctgtgtgctgagctgagaggaggcggcagagcactggggaggaggccccagaaggagctaaagggagccctgccggcacataacgaccgccgggctccatcacaggctccatcaacccttacccagcaccgagccaagggcaccagaacacgctgggaaggagcagtaacaggaggccctgctttggaccaaaaatcagagaggcatggcccatcactccgggggcccagctcccaaagatgcagtcccccatgagtcaccaaccatggaaactatcacccaaccccctgccccaaagccactttcaggaaagtgatctcagagagcaagggtttcctgccctggcacccaagcccagtgcttaggtgggtgggagatgccagtggagacaggagaggtctcagggagcagagacaagggtgtcagatagggtgactggcaggagttggggggctggggctgcagagccctccaggaggtgattcgggggaggatccggatgggagagtctcagggagagataggaaaggtgagtccagaggggctggtgacagagcccagggactgactgggacagaaggcagagaggtaggggaggaccttctggctcagggaggaaagagacaatctgagatgccccagtgggtgtaagaggccccagtcagcaccatgttgcccccaccaccccagaggactggccctgagacccagccgacagtcctgggcgtgtagaatagtcagttctagagtgtagtgtgattcttggtgactgcaagtccctttgcctctagcaaagcaaaaggtgcatgcgggatgttctgttcttggtagacgttacttttttaaaatgaaaaacttgtgttaatgccgtttgcttccaagttgtgacccaccctgtgtcccttacctggggatgtacctcaccgacctggccttcatcgaggaggggacgcccaattacacggaagacggcctggtcaacttctccaagatgaggatggtgcgttccccccagccaggcaggggaaggggggcgttgaagcccagatgactcaacctggggcccacccacactctgccccccaaggcccaacctgctgcatagggtgcccccatttgggagcctgggtccagcttccccaatgacagccatcactatcattgatgagcagttagaatctggcaggccctgagccatgctttcaccggcatttcctcctctagtcctgacagtctgagaggtagctgctcttcttattctgcacctttcagatgagcagactgaggctgagtgaggtcaagtgagcagcccaaggtcaccccacaagtaaagggcagagccaggtctggagcccgggtccaggtgactccaaagccccacactgtcattcacacccatccgtattgttcgtatcgacacttgcttgatgtggacaaagtaaaaccacttacacagcacctcctaaaagagtaagtttccagttttcccagaaaaatctagaacttgggataagggctgaggagacttctcccattaggaacaggattctaaccgtctccttctcccctctcacttcgccagaaagcctctacttgcaccagttttatataatgggccttgacattagatttttgttggatggaaagggttttttcaggcaccatcctgaagagcgaaagctgcttttcatcgtgtcttgtgcacagcaggcgctaaggaagtggcagatgcctttaacttttgctggagtcgtggggttttgttctagtgatgttaggtagcttatgccactaattaaaggagattttttttcttctctcagtcacatagtgtaatttacctatagagtcttgacaagtcttggaagcagatttctgtttaaaaaaaaaaaaagaaaaaaaacatgaggccgggtgtggtcgctcacacctataatcccagcactttgggagctgaggcgggtggatcacttgaggtcagaagttcaagaccagcctggtcaacatggtgaaaccccatctctactaaaaatacaaaaattagccgggcgtggtggcatgcacttgtaatcccacctactcaggaggctgaggcaggaggatcacttgaacccaggagacagaggttgcactgagccgagatcacgccactgcactccagcctgggcgacagagtgagactccatctcaaaaaataaaaataaaaacaaacacacatgatgcctccgtgggaccttccaggaggcaacatgtatggaattaagaggctgacttcagatttagttgttgatgccccttcagctctgcaaagttgggggtggaactaggagagcaaactgcattctgaaacactccttccttcccacagatatcccatattatccgagagattcgccagtttcaacaaactgcctacaaaatagagcaccaagcaaaggtaagctgtgccttttcctggtcacttgcatgctttcacagtggctctgtctaggccaccttccaccctgtcccctccatacccgtccactttcccttccagaattctcttgagcccagctcaaacgccatccctgtaaggaaggcttccctagtccctatttcttcaaattgggcctgtgttcatcttgtgactcttgtctgattttacctgccataggatggtttatattcatgtctaatctcccccagggcaagacaggcagagttgataacatctgtttctgaaaggtactatgcttacaagttacaaaatccacagatataaggagtgcacagtgaaatgtcccccagccacctagttccccttccaaaggcaacatttccgcccgtttcttgtgtctaggtccacaggcaatccataaacacaagccaactttgcataccattctctagcatactatacactgctcagtatcattcctttttttccttcataatatatcttggagatcattcctattaaaatagaagcatccttattctttcttacagctgcagagaaatctatttagccaatcctctgtattgatgaacatttaggttgttttgatcttttgctgctacagacaaggcacaaagaaatactttgtacatccagaaacaggcagggagggccatagggtatggatcccagggtctgtgctgctctgagggcctagagagccttactggaggaggagaatcctggaagagttttcctggtcggggtagacatgtctttcttgcagagagacaggcttgtgtaatgctaagtacagtgaccccctccaccaccaccaccaaatggctggctgcagagagtagcatcaggcctgccagaaacagatggaactggtgggatcctaaaaggatcagggactttgtccgtaggaccataggaagccctgaaaggaggttatataattggactagtttgcatttttaaaagatttgcaaggccatgtaagagaatggttggtctgaaaaaaaaaaaaaaaagtctcagctagccaaaaagaaaaaaaaattgtttaataaaaaagaatggttggcatgttagtctcattacattattcaaagcctgtactgtaggccccattttacagataaaataacagatttgctaacccagactcttgggctcccaatcctatgacttttcttttctttttctttttcttttttttttttttttttttttttgagacagagtctcactctgtcaccaggctggactgcagtggtacaatcttggctcgctgcaacctccacctcccgggttcaatcaattcttctgtctcagcctcccgcatagctgggatcagggactttgtccttaggaccatgggaagccctgaaaggaggttatgtaattggactagtttgcatttttgaaagattgcaaggccatgtaagagaatggctggtctggcacgccactatgccccaataatttttgtatttttagtagagacggagtttcaccatattggtcaggctggtctcagactcctgacctcaggtgatccactcacctcagcctcccaaagtgttgagattacaggcatgaaccaccacgcccagcctccaatcctatgacctttcttccctgcccagagatacagcatcttaacctcctagtgtgcagttcacaaaaacatccagctccagacacaccctcaagcacaccggaaaatcaagcttttattgtttttcccttctaatgtcctttgtgatcaatgtgttttttgagaatgtgtcaattttttgccatattctgagaactcatgatctgctttatagctgatagccgtatcgaaggagaaaaatcagtggactaactacaattagttaaactggccacttttgctttgctttccattcattctctcactccacaaatattcattgagcaagtcctacatgccaagcactatagtaggctcttggctcagcagtgaacaaaacagataaactcttggccctcacgagcttgtgttctagagggaaatagactaagaggcaaaaaatataatatgacagatgattattacaaccatggaagaaatgaagcaggggagaggaatgggaggttgggaaaggaatagggggccatagaatcctagaattttcttttcttttcttttcttttttttaagacagagtcttactctgtcacccaggctggagtgcaatggcgcgatctcagttcactgcaacctctgcctcccgggttcaagcaattctcctgcctcagcctcctgagtagctgggactacaggtgtgagccaccacgcccggctaatttttgtacgtttagtagagacggggtttcaccacgttggtcaggctggtctcaaactcctgacctcgtgatccacccgcctcagcctcccaaagtgctgggattacaggcatgacctaggattttcaatgttggacaaaacagaaataaagggcatcatgagccacaacatcacctatattatgcatccaagtgtttgaatctaatcaggaggaaccaacagacaatttcagaatatgggacattctgcgagacaactgctctgtaactcagtggtgtgctagtaaatgttaaactggtcttgggggtagaggattgagtcttgatgtgtagcatttgctgttgaagagaaaaatgattggaacgcttgttaaaaatggtaacattggaacatttgtttaaaatagtaggtttattcaaacctgatgcaatagaggccaagactgtttcttgggggagagagattgaactcaactgcaaatacaacagggacaggtggggatttgtagtcaatgggccaagaaagggggtcagtggatggaaaattactaagaggagatagcaagagtaggggaattcttgctaaaccggcctaacaggtttttattaaagtccggccaaagacttcgggtatcaggggtggagaatgaagaatttgagcagatatcaaggtggggggattcttgctaaaggcaagccaaatttgaagcctaggcatgaagagagctcagaggagcctgttaggtgatgccagcagggccactttcaaaccaccacctggacatcactgaaagcagagttgggaacagaggctaaaaattggcacatgcaggctggcatgagccagctccaacacactactgcatatagtcttcaaaaatatcaatgtcttttagcaataaaatattttcaattaaaaatatatatatatatatcagctgggagtagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacatcagtgtcatgaaaaataaaaaagactaaaacacacaggctgggctcagtggtgagcttttaatcctagcactgtgagaggcagagggaggaggctacttgagttcaggagttcaagatcagcaacatagtgagaccctgtctctataatgaaaaaaaattttttcaaaaaaaaataataaaataagactaaatcatatgacatctaaatgcaatgtgtgaatgtcggttagatctgggattttaaaaaacagctataaagattattttattcattaaaacttgaagaaatttgaatctggtctgtacatcagctaattttattttattgatattaaatgtcctaggtataatgatgttatggttatgtaagagaatgtctgtattcttaggagatgcatggctgaagtattcagtgggggaaacactacactatttaccttcaaatggttcagccctcagaaaaaggattatacgtatatgttgtatgcatagtttttatattttttaaataaaaagttggccggaaaacagacaacagtaaaagcattaaccatggaaaaacagatataaatactggaagaaatatgtaaaacaggactatccactagaaatataatgcaagctacatatgtaactttaagtatcctacagggtcacattttttaacttatttttatttatttatttattttagttttttgaaacaggatctcaccctgtcacccaggctggagtgctatagtgtgatcttggctcactgtagcctcgacctcatgaggttcaagcgatcctcctacctcaccctcctgaatagctgggactgcaggtgttcaccattacacccaactaattcttttatattttttgtagaaacagggttttgccatgttgtccagcctggtctcgaactcctggcctcaagtgatctgcctgcctcggcctcccaaagtgctgggattacaggaatgagccactgcacctggcctgtttttttgtttgtttgtttgaggcagggtctcactctgtcacccaggctcaaatgcagtgacacaatcatagctcactgcaacctcaacttccccggcttaaggtatgaccacacccagctaattttttatttttttatagagacagggtctgcccatgttgaactcctgcgctcaagtgatcctgtcgtcttggcctcccaaagagctgggattacaggtttgagccaccattcccagcctcatttttttttaaaagcaaaaagaaataggtaaaattaactataataagatattttatttaatacaatatatccaaataattgtcagttcagcatgtaatcaatttaaaaattgactgagatattttactttattttattcatactaaactttcaaaaatccagtgtgtattttacacgtcacatcttaattcagatgagccctgtttcaagtgctcagtagctacacgtggctaatggctgctgcactggatttggggggctctgtaagaactgaaaatggctatctctagagagccaggcctggtggctgagaaggggcaacaaaggattgctggttttcattatgaaccgtttaatgctacttggcttttttaattacacaaaataaggtataaattaattttatatctaaaataagatataaatcaactttaaaataaaaagaaataaaaatacaatttaaaaataaatagtcccgggcctggcacggtggctctcaactgtaatcccagcactttgggaggccaagacaggagaattgcttgaggccagaagtttgagaccagcctaggcaacagagtaaaggctcccaactctacaaaaaaataaaaacattagccaggcgtagtggctcatgcctgtagtcccagctactcaggaggctaaggcagaaagatcacttgagcccaagaggttgaggctacagtgagccatgatcgtgccactgcagggcagcctgggcaacagagtgggatcctgactctgttaaaaaaaaaaaaaaaaaaaaaaaaatttaagtcctcatggtctggtagggaaactttgagttttcgggcatggctcttagaggataaacacatggtgattttaataacaagatcaaacattgaattcatcagcttaaagcactaagggaatcaggcctaagccactgggggttcagaatggctccctggccaattaacagcagcaagccagagcctgctcagcatctctggggctcctccctctgccttattcaacaccaaccagcctccacccagcccactctcacatccttctctcagtcgaccagggaacacctgggttcaaatcccggcgaagccactcaccaactgtgttaccttctgcctcaactgtaacatgagattcttttattttatttttgagacggagtttcactctgtcacccagcctggagtgcagtggcgcgatctcggctcactgcaacttctgcctcccgggttcaagtgattctccagcctcagcctcccaagtagctgtgattacaggtgcctgccaccacgcccgattaatttttgtatttttagtagagatggggttttaccacactggccaggctagtctcaaactcctgacctcaagtgatccacctgctttggcctcccaaagtgctgggattacagacataagccactgcgcctggctggtcacatgagattcttataccagtgtgggatgggttgtttttgatgattaaatatgacaacctttgtaaaaggactttataaaaaaagcattgctgtctgatgcaagaactcatgcatacatgagtaacggttggtttctggtctccatgaatgagtgaggggattttgagggcctgttgagggggtctaatgtggctaaagaggggggttgttggcaactgcagggctagagcccctgctttgggggcaagaacctccgggaaagagcagagggatttaaaggcagtgggtctccagtgtccgtgtgcatccgaatcatgctcaccaaaaagagtgagttgtactgtatgtacctttttttaagtaaaatgatactcaatccttgacaagcctactctgctgacagtgttggccgttgtagtaagaaacccatgatccttctcctagggatttatgctttaaacacttagttgaggcaaaaggctgtattctagaagatcttcattgcaacatttattttatatataaaatatcaaaaaacctgaaaacggccgggcgcggtggctcatgcttgtaatcacagcactttgggaggccgaggagggtggatcacctgaggtcaggagttctcaaccagcctggccaacatggtgaaacctaatagtataaatgaaagcataccaagtgctgtccattccataggtacaactatggaaaagtacttttgtattctaagaacgagacgatcacacaaaaaaatgaaaacagttattttagagtggtgagattatgggcttctgtttttctccaaaaatgtattttatattgtcatgtcctttattctacaataaaaaatattaagataaaagtatcaacataactcagcagtatttgagggtctgtgtttgtgtgttcatccagcctgagaaccacagagttgccatgtggatcacacagggctcatccagaaggcaccgtggtcacactgggccctggaaagtctcagaagttaccaagaaaatttcagggttttcttccatctcctgcttttgtctccttaaactttgatgtgcaatacaaataaatattactggccagggccagtggctcatgcctgtgatcccagcactttgggaggccgaggcaggcggatcacctgaggtcagaagttcgagaccagcctggccaacatggtgaaaccctgtctttactaataatacaaaaattagccaggcatggtgacgcatgcctgtaatcccagctactcgggatgctgaggcagaagaatcgcttgaactcgggaggcggaggttgcagtgagccaagatggcgccactgtactccagcctgggtgacaagaatgaaattccccctcaaaaaaaaaaataaataaataaatattactgctcctcagacttctttcattaactgctttgcaatggtgctatatgctgccagtcttcctcgaaagtacaatgtcttaggaaaattagcctgacttagccaagtcaggtcaagagttcaacaccagcctggccaacatgacaaaaccccgtctctactaaaattgatcctgcacatgctcactacggaggaaactaatcagtttcctgatccccagggggcttgggaggtagagattcatgcattctagaaaggactgttcacatgacactactatctaggtataaaagactatttcacatggtcataaaatcgccatgtctttatcactgggtgtaggttaaacaagactgtgatatctaaagtcatcttcctagaagtgctgggaacgagctgctaatcagacatagtaatcactttatctgtgactattaatcagcatagcagacagccggttccaacctttatagtagcagagtcaattagccaagacaaaagcagcagactttatttttctcaagcagctaccaaaagattcccaaacatataataagaaaatttggccaggcacggtggctcgcacctgtaatcccagcacttcaggaggccaaggcaggtggatcacttgaggccaggaattcaagaccagcctggccaacatggcaaaaccctgtctctactaaaaatacaaaaattagccaggcatggtggtgcatgcctgggatcccaactactcaggaggctgagacaggacaattgcttgaacccgggaggcagaggttgcagtgagcccagattgcaccactgcactccagactgggcgacagagcaagatgctgtctcaaaaaaaaaaaagaaaatttttttctttctgctctggatttatgtagcggggaaaaatgtgcctttagttccaaacaactgacaagtaaataagtcttggaaagatactttttggagcagggggctgcctgtgaggttagagctcagatctctcattgcacatttaatgcgcaggcattcagcaaaatgcttcagagcaggagtggggtggggagagaggagaagacaggataacctaactcatgtgagtgcatctttctgattttccactcttaagatttctccccagggtgagaaaaagggaggctcttctctcacacagcctccatttccacttgcctctcttggagtggatctctcacagtaccatgtaatcctagcgttttaatacattttgtcccaacattttattataaaactttttattttattttattttattttaagacaaggtctgtacccaagctggggtacagtggtgtgaacacagctcactgctgccttgacctcctgggctcaagtgatcctgctgcctcagcctcacatgtaactggaaccacaggtgcacaccacaatacccagctacttttttgattttttgtagaaacagggtctcactttgttgcccaagctggtttcaaactcctgggctcaagcgatcctcctgcctcagcctcccaaagtgctgggattagaggcatgagccaccacgcccagccttatgaaacttttcaaatatacagaaacactgacagaattgtgacagacagatcaaacatacagaaacactggcagaattgtgaacacatatatctgccacctagtttctacaattgacttttttttacttttgtaccagccttaatattatgacaatattaaataataatcctaagacaatacttacgtcgactgcttaaaacttatgtcaagatggaacactactgaatgcatttttgcctcatatgcccacctgactctccacagtaagaggcttgggccctaggagataaagtgcatccacaatcagtactatggaggtcccacaaccctcccattcccttttctcttttcttttctcaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcgtctcctgcagtgcctgtttcttttaaacagctgtactcttggtccctcttccctagactcctcactcttctcagaggggaaacagcacccttgcatacaagaatcttagactccagtcctgcttccgtccctccccagcccaggctcctgggttgaggtggccacccaggcatcctcccagcatgttccatgtagttgttataactgggtggggggtggggggcggcgggagggggaaaccataccctgaagtccagtcattgacaaatcttcccgctgatggtgatgtcaatttccaaagcagcttctccagccaaaatcgcaggtctcaaaactccccatgtgtctcccagtaacctggacggaagggagtcctctctgctcagaaccacacccctcgtaccaatgctgccatctcgttcaggccccacgtcgctccttgctctaggattaacaccagatagcatgaatagcagtctcaatacaactggatgaggccctagacttcccgaggaaatggagtcacaaacaccaagccacgtcgactcttgccgaccactggcccagcatccactgaaagtcgggaacacaaaaatgtcacttttcctctttaagctgcctaacggtcactacaagcttacattgagatgctctaagtctgtataccttgtgataattagtaccacactgtagaattaggaaatcaataaccaagtgtttttattgcatatactgtagtcctgtctaaatgccttctagcaggaatatagtaatgtagtgcttattctgtgaatattaccatgtattttttacactgtacagtatagaaaacacaggttaactccgaagtggcaggcatgctccactacaacagacagacaacttttgctgtaagcaatacctagtggtatgagaattctatttcaagtcctaaaatatttcaacttacagcttgtttggaaaaaaatttccatttttgtaaaaatatatgtttcctgattacctcttgctaataaatctattctatctcagggtgaacagcgagttttgatgggtttcattcgttcagtcaaggaatatttgatgagcacttgctccttacccagcccagcctgggaccggagatccagagtgtcaaggacaccatacctgctttttaggcaccaacagtttggtggggaagactgtttcagttgcctattgcaccaagaacaagccactccaaaacataatggcttaaaaccatttttgttacctttcacagttctatgggttgactgggtccagctgtcagttcttatttggagtctctcatgaagtttcagtcactcagcaactgggactggagtcatctgaaggctcaactggaccgggtggtgctctagttggtgcaccaagatggcgctgtcacatggctggatgttgatgtctgctgggctgcactggggctgttcatgggagcatccacacgtggcctctctgtgtggcttgggctcctcacagtccggaagctgggttccaagagcgactgttccagcagcctcaggcagaagctacaaggctgcccagatgccatcctgcccagatgtgtcctcactgtcacccaggaagggaagccccggaacaccaccctcagtcacaggcatggggcccactgcaaggcacaacccactccagagctcccaaggccgcctcccctgggacctgcagccagctggctccataactgcttttccgtttcctccaggcattttcatcctagccctactttgtgctgggatctgagggggatagcaagcggagaaagaagggatctagagggagaagattctagatccttcttttgactgccagctgattttgattgccagctttacctgcttcatgagctcagccaagtcacttaacctctcagagcttcactgttctcatctgaaaaatggggatgaaaatggtatctcattacagagtagaattaaatgaattattataattaatggtattaagtactattaaacagttaatggtaaagaaggaagaatgtgttttgaggtgccaatgaagtagtataagacaagctgctttgttaagcaagacatcagctgttactcctggcaccaaaagccgtcctggggttccatgggtcagtggccttgataccaaaacaaacttgggcccacctgcccggcacagcaaagccaagcactgacattgggattgcagcgagagaaagtgaggcatttattgcaagggcaccaagcaagatgaatcacgccgctcatgcttaacacctgaacttaagtctttaccctacctgatggcttacaggtaagagtttttaaagttgggatggcaggggttacaggcaaggtcataaatcaaccacagaggctacacattggttgatgtataaaggcgggacatcttcaggggggtgccgtgcaccggtcataggtggactcaaagattttctgggccaggctcagtggctcacacctgtaatgccagcattttgggaggccgaggcgggaggattgcctgagctcaggagttcgagaccagcctgggaaacatagtgaaaccccgtctctactaaaaatacaaaaaattggccaggcacagtggctcacgcctgtaatcccagcactttgggaggccgaggtgggcagatcacaaggtcaggagatcgaaaccatcctggccaacatggtgaaactccatctctactagaaatacaaaaaaattagttggatgtggtggcaggcgcctgtaatcccagctactcgggaggctgaggcaggataatcacttgaacccagaaggcagagattgcagtgagccaagatcgcaccactgccctccagcctggtgacagagtgagactccatctcaaaaaaaaaaaaaaaaaattagctgggcatggtgttgcacacctgtaatcccagctgctggggaggctgaggcacaagaattgcttgaacctgggaggcagaggtttcagtgagccgagatagcacaactgtcctccagcctgggcgacagtgcgagactctgtctcaaaataaataaataaataataataaataaaatttttaaagatttttctgatttgtaattggttaaggaagagaagctttgtctaaaaatttgggatcagcagaaaaaaacgttagctctggcttgtgggcatgacctcccacaggcccctcaggaagaaatttagaacaaaactgcagtcagagttcagttctatgtgctagcgggtccatttggtggggtctcttcctcttcaccgaaggtgaaaagcacagttgggcggcttggccttccagcctcagcagggaggcttctgcctctgtccctacaagcagacactggggcaatggatgcatcagattggaagtcaagcatttcttcatttattcaaaataggaaggcagcgtggtggagtgattacaaattctagagcaggccgggcgtggtggcacacacctgtgatcccagccgaggcgggcggatcacttgaggtcaggagttcaagaccagactggccaacatggtcaaaccctgtctctactaaaaatacaaaaattagctgggcattgtgacgtgcctgtaatcccagctactctggaagctgaggcaggagaatcgcttgaaccccagaggtggaggttgcagtgagccaggatcgcaccactgcactccagcctaggcgacagagcgagactgtctcaaaacaaaaacaaactctagagcagcgattaccaacggggtgattttactcctcgcctcagagtctggagacatttttggtggtcacagttggggaggccaggtgatacatctactaggtagagaccagagatgctgctaaatagcctacaatgcacaggacagcccccaccacaaagaactatccagcccaaaatgtcaatcatgccgaggttgagaatccctgctctagagccagactgctcaggttcaaatcccggcttcactgcttactagccatacgaccttaggcaagttacgagaccactctatgcctcagttttcccacctgtgcaatggagacaagcatagtacctgccttgcaaagttgttgtattaaatgagctgctacaggtgaggtgatcagcacatggcaagtgcttgagaaccatcagctgttgttcattcatgaactatttctagagcacttactttgtatcaggccccattccaggcattgctgacttaatgaacaaagcaaacaagatccctgcccacacaaggcctatgttctagtgggcggtggacagtgagcaattttttaaaatacccaaggaggctgggcacggtggctcatgcctgtaatcccagcactatgggaggccagaggtgggtggatcacctgagatcgggagttcgagaccagcctgatcaatatggagaaacaccatctctactaaaaatacaaaattagctgggcatggtggcctgtgcctgtaatcccagctactcaggaggctgaggcaggagaatcacttgaacccaggaggtggaggttgcggtgagccgagatcgcaccattgcactccagcctgggcaacaagggcaaaactccatctcaaaaaaaaaaattaaataaataaataaataaaatgaaatacccaaggtagggcaataaagaccacgaggacaaccattaggggaacactgaggctgggacatctagcctgaaacttggataatgcaaagccagacacctattgttaaggaagctgtgaggtcatcactcactcaccttgagaggactcctcttataggcctgctgggcaccccccagggatggaaataaaggaaaatcttgagttccttcaagggaaattccaggcacctagctctccctgagaagcaaatgagaaacttgataagcaagaaggtaacagtagcctgaaacaatagccaaggaagttagagtgttgggatgtttcctatggaaaccaaagataacctcttaatatatgttatttttcagaaacccagatgaccctggcacatagacctcaggtaagggggaaccaggactaaccgctgtcccctactctttgctcttcctgaggggcctggaggaggtcatgcccacgagccagagctaacattcttttctgctgatcccaaatgtttagacagagcttctcttccttaaccaattacaaatcagaaaatctttgaatccacctatgacccatgcccccctccccaagatgtctagactttttaggtccaaccaaatatatagcctccatgttttggaggtttgttggtggtgtttttttgtttgtttgtttttgtttttgtttttgagacagagtctcactctgtcacccaggctggagtgcagtggcgcgatctcgctcactgcaagctccgcctcctgggttcatgccattctcctgcctcagcctccagactagctgggactacaggcgcccaccaccacgcctggctaattttttgtatttttagtagagacagggtttcactgtgttagccgggatggtctcgatctcctgacctcatgatccacccgcctcggcctcccaaagtgctaggattacaagcgtgagccaccgcgcccagcctgttggtggtggtggtgttgttgttgttgttggtggtggtggtggtggtggtggtggtggtggtggtggtggtgtttatttgagacagggtctcactctgttgcccaggctggtgtgcagtggcatgatcatagctcattgcagcctcaacctgctaggctcaggtgatcctcttgcctccgcctcccaagtaggtaggcccacaggtgtgtgccaccttgcccagcctgcctccatgtattgatttatgacattgcctgtaacctctgcctctccatctttaaaagcccttgctgtaagccatgagggaattcagtcttaagtatgagctgcccaattccccttgctgggtgccctgcaatcattgcctccctttctcttactgcaatcccaatgccagtgcttggctttgctgtaccaggtgggcagacccaagttctgtttggtaacaacctgctgcagatggtcagtgttctgatccggcaggaggcactgggcaattctcaggggctttctcaggacctacactaggatgaggcaagagaagcacccacccaggcataacatttaaggggccaccaaaaaaaaaaacagtattattattgaaatgaataacattttacggcaatattttaaaaagtcaaaatttacaataaaatccacaatgaccaaaataccaaaatcatcaaagacaggatcaatatttctggtgttcttcttttgcctcactcttcaaaatggcagacactgggcttcttggcccttggtcaatgaatcataaaatacttctagtgtcacgaaaggaaatagcactccaggctctaggctagttcctggggagagaggcagcggatttggttagcttctctgtttactggcggatgtacgtggttggttggatttttagggtctcccctcccaaatctgtgaaggagttttttaaagtcagcacaaaagaaagtttgtacctggcctattagcattctttggtgtaagtgggtttcacaatggcagatggtgtcacctgttgatgtatgactgcccctcagcaggcttcatgctcttgcctggtgtttagtgattacagtctctttcccaagagtggccctgtggaggcttccctggctgccaggccaataacaagctgaagaggcaggttgttattgtcaggggagtatgaaggtgccacccaaaaccacccagccttcaagtattcatgaagcgcctgtgtgtgcatacctaggtaacaagcatctaaccagctcctgacctccccgagcccatgacccagctgaagagtggaaaaccacaagtcaaataacatgtgtctagctcccagcccacacatcactccagactccagatccttatagccaaccacctagacgccgtctcgatttgggggccctatttccacctccaattcacctggaccaaactgacctcattttctccatcatatctcagttccttcaacccccaactcagttgtgcaggccagaaccaaagttaataataaatgtcagagcaagggtctcctgtcaggttcaccttcccttcccacttccctgccttcgtcaaagctcttccctccaccctgagcaccatttttgctctgtcttttctgcctttccaaatcccatccttcttcaaatgtccttccctccaggaagcctttcctgattttctcccagccaagggcttcatctgtacccatctcaggtcaataggctctatctgatggcacagacccatgtcacttccctcacacgagattctacatgggccagggaagtctgacttggctattgtctcatgcagcaaactgatccatgtctgacccatgggagatgctcaggagtcaggtctgattcaaagtggggctccacaaaaaaggagataaagtggacttcacccaaattataacttctgtgcatcaaaggacatcattaagaaaatgaaaggacaacctatagaagggcagaaaatatttgcaaatcaagtatctcacaatggtttagtattcagaatacacagagaacacctataactcaacaacaaaaaccagacaagccaattaaagatcaattagccaagcatggtgatgggcacctataatcccagatacttggggtgctgaggcagaagaatcgcttgaacccaggaggcggatgtttcagtgagccaagatcgggccattgcactccagcctgggcaatagagcaaaaacttcatctaaaaaaaaaaaatagacaagagattcgaatagatatttctccagagaaaatgcacaaatggccaacaagcacatgtaaagatgttcaataccactggtcattagggaaatacatatcaaaaccacaatgagataccacttcatgcccactagaagagttatgatctaaaaaaaatggaaaataataagtgtcagtgagaatatggaaaaataagaaccctcatacattgctgatggaaatgttaaatggttcggctgctgtgaaaaaatagtctggcagtttctcaaaaaataaagagagtcaccatatgacccagcaagtccactcctaggtttatatccaagagaaacaaaaatgtgtctacacagaaactggtacacaaatgtttatagcagcattattcataatagccaaaaggtgaaaacaagccaaatgtccatcaacagatgagtggattttaaaaacgtagtataggccaggtgcggggtggctcacacctgcaatcctagcactttgggaggctgagtctgaggatgaattgcttgagctcaggagttccagatcagcctgggcaacatagtgaaaccttgtctctacaaaaaaaaatacaaaaattagctgggcatggtggggagtgcctgtggtcccagctactcaggagagtaaggtgggaggatcgcctgagcctgggagatggaggattcagtgagctatgatcacgccaacgcactccagcctgggcaacagagggagactctgtctcaaaaacaaaaacaggtcccgtcgctactaaaaatacaaaaattagctggacgtggtggcatgcacctgtaatcccagctactcagggtggctgacacaggagaatcacttgaacccgaggcagaggttgcagtgagccaagattgcaccactgcactccagcctgggtgacagagcgagactccatctcaaaacacacccacacatacacaaacacacacacaaaacatagtatagccatacaataaaatattactcagctttaaaaagaaataagtactaacgcatgctataacttggaagaacctagaaaacattacgctgagagaagagagacacaaaaggtctcttatcatatgattcctcttacatgaagtgtccagaataggcaaatccatagacacagaaagccgagtagtgggtgccaggggaatggggtggggagaggggaatgaggaataattagttcatgggtatggggtgttctttgcaggtgatgaaaaagtttggaaactagagagaggtgatagttgcacaacattataaatgcactaaacacctctgaattatacacttcaaaatggcctatttcatgttatgtgaattttgcctcaacaaaacaagaggaaaactggctgtaactgctcattcacaaagcacttcagatgtgatcaggagattatgtagattaatgggataactgaattgcataccttaaaatggctgagtatatgatatatgaatttcactttaattttttaaaagttaaaaaaaaagaaagaaaaagggattggcaaggcagagcttctcagaggaagggtcttaaacttgttcttgaaggaatagaagaagcccagggtttctggagagaagaggggctggggtgacccagataaggtagacgtaagtgatgggttgagctgcaatggggtgaggagtccagggagagagggaccctgggggcggcagggaggtagaggcaggtggcgggtgggtgggcctgggtatggggctgggtgggtggctggtcccggaagtgtgcagaggcaccacaatagggctttggtgctgaaatcttgcaggctcagttcctacctggcctgattccattttcattcagtcaagcccttatcagcccttgtttgcttgtttactatgcaattattacccaaatcagaccaagtgactcatgacccagaaatagtcaaggcccttctcatcgccaggaaggggagttaggaatgttctgctcacgtcgggcaggtccaagcaaacttgcaatcctctctggtcactgcctcttctgggtctctccatggccccaactgtgcctttctatttctttgttccctctaaaccttgcacccacct

SEQ ID NO: 389 - DNA, 2952 bp, Homo sapiens
gaggaggggaaggaggacagaaggagagagggagagggagaaagaaaaataaagggagagaggaaggaaggaagggagggagggagggagggagggaaaatgatggagccctttttggcctacttggggtgagtcaacataaggagtgcaggccaccttagcctttgcttctcaaaagtcatggggcaatgaaggacttggccaaggctgtccagcagtaggccaagttcagggattggctcaggcccctaatggacttcactgcatccaggaatggtaggtgattatcttttccgagaggccacctacccagatcccagttgtggacagcccatcccagccctcagaggctcagaggctctctgagtgccctgccccaaaacaccctaggcaagacattatgccagagcctcagctctagggctgcctggagcagagctcctgaatcacactggctccccagggctccccaggaacctcaccattcctcccccaatccacacctctgctgccagagcaacgcaacgacccagaatacacccgttccctcttctgttccctcctcctgcccccacctcaggcctcactggggcagggtacatcttgcctctctgccctgaacttctgaaacctcaatgatcagattcccagggctctgagaaaacagaagcaaacatcccatccaggatggatttaccccctaaaagtcactgagatcattcccaggggcccagcagacagtgtccttcctttcccagcagcagtgccctgcagaacaaagaggctggttcagagccagctctcagccctatggccttggctgagtcccttaacctttctgagactcagtttcctacctgtgacattcctgcagttatcctgtaggaataagagtgcctacgtcctggggcaacagtgagggttaaaagatcaatcctatcctgtgtgcaacgtggagcagacagcctcgatgagacaagctatggtttgcaatgttctggatgtataacctgtttccagcctggcctgaggtggaaccctgtcatgaggatggtcgctggagctcctgtttgccagtggccagaacaataagctcctgtacggtgaaccccccaagtccccgcgcgccacccgcaagttctcctcgccgccacctctgtccatcaccaagacatcgtcaccgagccgccggcggaagctctccctgaacatccccatcatcactggcggcaaggccctggacctggccgccctcagctgcaactccaatggctacaccagcatgtactcggccatgtcacccttcagcaaggccacgctggacaccagcaagctctatgtgtccagcagcttcaccaacaagattccagatgagggcgatacgacccctgagaagcccgaagacccttcagcgctcagcaagcagagctcagaagtctccatgagagaggagtcagatattgatcaaaaccagagtgatgatggtgatactgaaacatcaccaactaaatctccaacaacacccaaatcagtcaaaaacaaaaattcttcagagttcccactcttttcctataacaatggagtcgtcatgacctcctgtcgtgaactggacaataaccgcagtgccttgtcggccgcctctgcctttgccatagcaaccgccggggccaacgagggcaccccaaacaaggagaagtaccggaggatgtccttagccagtgcagggtttcccccagaccagaggaatggagacaaggagtttgtgatccgcagagcagccaccaatcgtgtcttgaacgtgctccgccactgggtgtccaagcactctcaggactttgagaccaacgatgagctcaaatgcaaggtgatcggcttcctggaagaagtcatgcacgacccggagctcctgacccaggagcggaaggctgcagccaacatcatcaggactctgacccaggaggacccaggtgacaaccagatcacgctggaggagatcacgcagatggctgaaggcgtgaaggctgagccctttgaaaaccactcagccctggagatcgcggagcagctgaccctgctagatcacctcgtcttcaagaagattccttatgaggagttcttcggacaaggatggatgaaactggaaaagaatgaaaggaccccttatatcatgaaaaccactaagcacttcaatgacatcagtaacttgattgcttcagaaatcatccgcaatgaggacatcaacgccagggtgagcgccatcgagaagtgggtggccgtagctgacatatgccgctgcctccacaactacaatgccgtactggagatcacctcgtccatgaaccgcagtgcaatcttccggctcaaaaagacgtggctcaaagtctctaagcagactaaagctttgattgataagctccaaaagcttgtgtcatctgagggcagatttaagaatctcagagaagctctgaaaaattgtgacccaccctgtgtcccttacctggggatgtacctcaccgacctggccttcatcgaggaggggacgcccaattacacggaagacggcctggtcaacttctccaagatgaggatgatatcccatattatccgagagattcgccagtttcaacaaactgcctacaaaatagagcaccaagcaaaggtaacgcaatatttactggaccaatcttttgtaatggatgaagaaagcctctacgagtcttctctccgaatagaaccaaaactccccacctgaagctgagcccagcccagacccagctgctcccggggacatgtgctagatgatactgtacatattcgtttggtttcactggattttcttcttcagtatgtgcttctccaagaatacaaatcgtccttgttcttagattcctgtagaaccggaatatgaatttctgcaccgtttcagacttcgcccacccatccctcccctcg

SEQ ID NO: 390 - protein, 567 aa, Homo sapiens
GWSLELLFASGQNNKLLYGEPPKSPRATRKFSSPPPLSITKTSSPSRRRKLSLNIPIITGGKALDLAALSCNSNGYTSMYSAMSPFSKATLDTSKLYVSSSFTNKIPDEGDTTPEKPEDPSALSKQSSEVSMREESDIDQNQSDDGDTETSPTKSPTTPKSVKNKNSSEFPLFSYNNGVVMTSCRELDNNRSALSAASAFAIATAGANEGTPNKEKYRRMSLASAGFPPDQRNGDKEFVIRRAATNRVLNVLRHWVSKHSQDFETNDELKCKVIGFLEEVMHDPELLTQERKAAANIIRTLTQEDPGDNQITLEEITQMAEGVKAEPFENHSALEIAEQLTLLDHLVFKKIPYEEFFGQGWMKLEKNERTPYIMKTTKHFNDISNLIASEIIRNEDINARVSAIEKWVAVADICRCLHNYNAVLEITSSMNRSAIFRLKKTWLKVSKQTKALIDKLQKLVSSEGRFKNLREALKNCDPPCVPYLGMYLTDLAFIEEGTPNYTEDGLVNFSKMRMISHIIREIRQFQQTAYKIEHQAKVTQYLLDQSFVMDEESLYESSLRIEPKLPT

SEQ ID NO: 391 - DNA, 165554 bp, Mus musculus
  misc_feature (1)...(165554): n = A,T,C or G
agagggagggagagagagagaaatagagagagagagaggaggctcacaaatttggggttgttaaagaccatgggacttttaaagttagaccgaatttcttttgaatgataagattctggccatggccctgtgagggattatagtggaaccttatggtttaaaaattacatgatgggctggtaagatgacttagtggataaagtaattggtgtgcaagttcaccaacctaaagtagatttacctgaacctacagtggaaatagagaactgatgccttggtctggctcccaaatgtataacacggcaagcttgtgctcacacagatggtgaacataggtgtgtgagcacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctgcttagttttactttattgtttgtttttttttttttgagacagggcctcacactgcattgcacttgttatgtagtagggataattcctgaacctccctcttccaagtacaggcctgtaccagcatgcccttctaattaatatatgtattattaatatatatatatatacacacacacacatatatatataatgtgtatatatgtatatgtgtgtatatatagtatgtgtatatatgtatgtgtgtgtgtgtatatatatatatatatttttttttttgagacagagtcttactgtctagcccagatggccttaaactcagggcaattcctttcttcagcatcctgaatactgggatgaaaggcatgtgccatcatgcccggcataagcttctgtttgaaaaaaaaattagtatttgtgactttgcacatttgcaagcatacatcccaactgacacagtgacccagtttaggtttcttcagagcctttttttctcacctgtgtaacagggtgacaataaccacggggcagggaggcaaatctgatgcattcttagtaatgcctgttgcataactgagagcaggaacactggagttgggcccggggtcccagtgtgaagaaggggctggggacaatcttagcacagccaaaaagaagggggaaaaaggtaattatgtccttaagctactccattctctttacaacaaaggctccaggaatagggtttgccttcaaaatttgggaggcagctgctacagcgttaagtggcatttggagagggtgtgggctgtttctgtgggggaaaactgttggccttcgttggagctgccacggggcactgctgggaatctgggtttggattttggcagtcctaattttcaagctttagatccaggagtcaaactggggggtggggtggggggagccagacttgtaaacgtgtgtccctacatctgtggaagccattgacaggctcattgcagaattcaagatgcacacaggtcagccagctactggggaaagtggaatgctgggaccacacccctgtgggatgtctgtgttctctaagagaagtagagagggaggggtgtggctcagtagacagagagcctgcttagcatgctcagagcctcaggttctagccccaacattgcatacatgaggagtggggatacacgcctataatcctagcacccaggaagtggaggcagaaggatcagaagtttaagggtcatccttaggtacatagtgagtttgaggctagcctggggtatatgagatcttgtttcagaaacaaaaagagggggagggcggggatgatgacagtggccatatggctcaaactggtgtgttattaataactgtgctgatacagcagacctggcctggggttgactcctgtaaaccctagctcaagctcctccagggatagaggaatcagcttctctaagggagcactgattgggggagggaacagtcatcaactaaagtactgtacctggaggtaaaggctctgcactggattagcttaagtcatgaaggcatttaatttttttttttttttaataatacaagaactccagagactctacttctgtggtttgttaactcaggaagtcagtgacatcaaagataagaggtactttcccatctgtcattttgcatctgaccattgcacattcagcagtgaccttcctcatggtctccagagggctgccaggcctccaggcatcacagcctcacccaattagaacacttcagagttaaggggaggactgggcagcaatgtaacactttggatacaccaagcattttaatctacacattagctctgtggagtaagactttcctaatggttcagataagaaccttgaagctcattaagacatctgcacaaagtcaaacagttggggagtggcagtgctagggtttgaacccaggtagctggtctctagatcaagcatctccaaaggccacaaaggaaggcaggtgtgaatggatgcgctaagcacctcctcttttcccccagcctgtgtttgcactagcaggatttgacagatcatggagcccagacttaatctggtatctatggttgttgtgtgacaaaacttttcctggtgagatgcaacacactggtctactcactgcagctggaaaaaaaaatatagataccactgaggtccagtttggtcaatcaatgagctttgttgggctttttacaggaatatggtggtggtggtggtggaggggagttacttacaggagcagaaatgactcaaagacagctgcatcatcaaagcccatcccagcctgaatgacagctcacaaaagctgggaacctggagcacactgcacaacctgcaggttgctcagcaggttggagggtgtcctttcctggtgtctcaactgtctaaatctcttccaggcagctctgctggtttctgcttctcccaggctgctggtctgatctcaagattctttgtagcttttctcctctaagagttttctttgaagctcagcttctgttactctctgagggactcccagctcttattgtttactgtggccaggagaatccagtgaatccggtcagtttcagggacttcctgaagctacgtggaagagcctctttgtaggatagaatgtttcaatttcaaggagactgttacacagcaatgatgctcctcccatcagagctttaaagagccttgccatggacacagtgttcatcctgtaggcttcttccaagcagtttttactgagaccgtgggagtagcctagtgaggactctgggacagaatcaagctttagtctgaagtagtgaagctgagcgtgtgttcagcacccacctgcgtggggcagctctctgtcccgttcccaggtcagagatgaatgcgaaagagccccaacttactcggcacatggccaggcttaggaaatgaccagccctaattcagaaaccagtggtttcctccttgcccgtttgggatggggtaaaaggctcagtcagccctggttttcctttcttccttaaaacttatcatcattatcaccatcaccaccatcatcatcatcatcatcattaagtgtgtgtgtgtgtgtgtgtgtgtgagagagagagagagagagagagatcttttccttctaccttcatgggggcttgggggtgcaaactcgggtggctaggcttggtggcgagagcctcttgagctgtccccttagctcttgttttgtttttggttttgcttgctctaaattgaaatgttcttccagacagagctgtgggagagggtctgcagaagcttgtggtgcctggtaaaggaataagctgcctgctgtcggcatctcctctggcacaggcagtgctcgtgtgacagtcacacactgggactccccagcccttgcgaggtgcatggcaacagagtctaaaattgtccccgaaaaagaagaatttccctgtcagagtatcaactcccctctccctgaggagcaccttcaccctcctccctccaggtctacctttaagaaagctcccagccacagcctgctacagatcttgcctctttaagaatcctggaggggagggcacaagaggtcacagccggactaggcagaagttggtctctccagctgactggcaacactcaagtgacatgtgacaaacttttccaggggagatgaaacagattcgtctaataaccccagacagggaacccgatatagacccaagtatggataacgccgaatctaacacgataaaccaatgtgttttactgggtttacttacaggaatatgggggagggtttactcacaggagcagaaatgactcaaagacatcatcaggtgtccaccccagcacgggtgacagctcatgaagctgagaacctggagcacacttgcacagcctgcaggcagctcagcgggccggagagtgtcccttctagctgtcccagctggcttaaaactcttccagcagctgggctggtttctgcttcttctgggtggctagtctggtctcagagtcttccttgctgctcaacttcctgctgtctgagagggactcttaactttgattgcttactctggcggcagggcagggcctagtgagtctgctcagcttcagggagctcttgaagtctctttggttgttcacctccccgcttaaagagtttccctgctggatgggacgttttcatcttggaagagatcgttatacaacctttggcttagtaagtcactctcagccagtagtagctaatctgagagtctcaccagacagggtacagagggtgcccccactgatcccaccaactgtggacaaagttgtctctgtcgggggtatggagtcatcagaggcctgcaggcccctcagctgtgtattcttggcttttgctttgcttgcctctgggaagcagaaagaactgtgaccatcatgtttgggacctctccttgctctggacatctgtcctgacctttgccaacccccagtagctacatattaggctctcgctaccatcggttgaatgaaagggcaggaacttgctattacctctattcctgtcctcacagctcacttctgtaacctgtatcctgctcagcatgtccttcaaggccaggtgcttagtaggtgcttgttgctttacctttagggccccctaggcttgttaacagaaccccacgtgtttaggggtgcagtgtcccaggatatgaaataggcctctcctaagtcaatgctgtgatccttggtcttggtcagggactattaggggagtggccacgcgacccagctctgacctgctgggtcttaacttttatcctttcaataagagaggcacagaagagacagggtcccctttgtcctctttctgccacgggacagttgtgtgagaggaggtgatgtctcttctcagcagccatcttgtgacttggaggccaaacaccgtgacagagacagcaaggtcagaggtgctctgacgacgttactacattttgagtcagcctcaggaacccagctctgggcctcttctgagaaaatgatgcccttagcttttaagctcttgttagcccgtgtttccttctctttactgcaaatcaaccctaaaagacacaggcacctctagcatcagactgtgagcggaattagtaaaggctggcacttattggctgcttactgtatgctcaaagtcttacaacaccaggttgaagaaagtcccattactcacagaggaaaagcccacacagaactagatttggtgatgcaggcctgtaaccctagcgttctggggactggggcgggaggatcaggagttcagggctgtcctgggctacataaatccaacaaaccagcaacaaagagctccacaagaaatccagacacgtgtgctaggcagtgtcactgttccagggtgggagatgatgtgaggggcccgtccacagatgtggaagtgctcggtcattctttctgacagtcagttcttgtttggagggtgggacccatgtgtaaatgtgaggctaacctccagccttggtcacaggctgagaaggggactagtgtttacttagcactacctaacccagctagctgtgttgtgtgtgtcagaggttctctggctaccttagaaggcaccgacggctcacaactgtggacggggtgctcctgggacatcccgggtactgtgtgctgctatgctcttacaatggagaactaacctgaccctagatgtcactaatcctgggtttgttccctcagactctcatcttacagattaaaaaaatggagcttcagaaaggtgaagtgtcttggccaaggtcacccagtcagctggatttggctggctcgtgactgctaccagctagcgagtaatgatttcaagacagggcccactgaaacccaaaaaggtgctggatctaaggacagaagcagtgttatgtctggaaagctcaggaacaagaagataatgattctttggaaacactcactccatgaccaatacctgatgggctcacccttttacatccatttacctaggataccttgcccacatcaaatgtcacggtgccctaggccccaaaggaacagggccaggggtagcaggagctaccacagtctctcctctatccttgtgcaaaagactgttttacttcaaggccccagagaactattctaggcatcttgaagggaagtaaatagaggacagtgctcctgccccagagatgatgacactccacagaggctattttgtgaaacagggactgactccataggagataatagatctgaggcggggcaggtagggattgaacaagcagttcagaggcccggtcaagagggcagttgacaaaggcaggaataattaagaacgaagataagactttctagggtgttaaaatcactttccagggactatggcccagccgtatgctggtccctaagagttaggtgttactgttcttccccttgtactgtgaggcaaacggaggagctttaggtgggatgggggtgctgaccaaggtcatcaatgaggggctgaaccccagaggctgactcgggtcccaatgcctctcgagggtaaaggggggttagcacgttaactgaacgtttgaaagatcaaggtcacacagaacagcctgtcggctggcagcaaaattcccattttggctttatctctggtgggtacgagggcggcttcctgcaacggtctcgtccaagtgggcacctttgcttagggatggggagcgctgggacagtaggcgcagagctccgacggaaagagaaacagaagtaaggacaaagatgcagctagagttcttccaaggtcaccgtaagccgagggcatgagcggccgtgttggtgggggcgtcgagctgctcttccgggcgtcaggagatgcgcgtggtggtcactgatccggctccagcagatcacccacggggcactccttacgggtggatggcgcgagctgctcttgcagaactgctgaatgggtcttggcctacagactcagcagaaccacgacctgactggggtctggggcgacgcatttccagccccaaactctgactgtgcggcgcgcgcacgaaccggctcttggccgacgctccctggaagccgggagggggctccgcccaatccccgcccaatcccaccagactccgccccagctcagtccattctccattagtccccgcccagtttccgcatgaggtgccgccccaccccgtccattttctacaaagatccccgcccactagcagattgaccccgcctccttccccgcccatcgctcagccctctctaccaaggccccgcccatacaccatgaccccgcccaggtcccgcccccgctccgcctgccccgggcccgctgagcggcgcctgtccgggatgcggagcccggacgcctaagccgcggcgcgacctcggcgcgggaagttcgggcgccgcgcggctatggaggcacccggcagcggtggtggtgacggcggcggggacccaggcggggacggtgcgcatcccgatgctcgcggccccgtctccgggccgtgcgcggccgcccgcgactcggagcgccagctgcgcctccgtctgtgcgtactcaacgagatcctgggcaccgagcgcgactacgtgggcaccttgcgtttcctgcagtcggtgagctcccgccacctgtggccggccggcccgcgttgcgcttttgtctgtggctccccgccttgtgcatagtttgaaatggttacatccgcgcggccgctgcccggggccgccccgctggggggccagtgtagggagaagcccgggtaggggctccttagctgcaccggggaccctgggctccgtagccttgccccagctcgaattgcacagtcaaagccttagactgcaaaacagcgtccgagtgcgtctgtgtaccacgcaccttacactggtatcagcagactgtgccgttaccgggctcatcagtaggttatattttctgatccttaagaccagggaagagttcggctccagagaggttgagtcccttgctctggatagttctgcaggctacgtcgtagggttggatgcagggcggtgacccagggcagccctgcgggggctttaaactccggtacgtagttgccctggtgtctctagtgagaatgaggaaggggccacttccctaccctcctaggaagtgagaaaactggagggggtgggaagggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtgatattgcttaccctgtgacatcgcttaccctgtgacactgcatgctggacatatgttacttggtttttacttttacaggggctaacagttaaaagtctgtcttgaggagctggagagatggctcagtggttaagagtactgactgcttttccagaggtcctgagttctattcccagcacccacatggtggctctcacctatcagtaatggaatctgatgacctcttctggtgtgtgtgaagacagtatatatataataaatcagagagagagagagagagagagagagagagagagaatcgggtagggcttgaagctggcagtttctaaatgaaagaggcagccactctggcattgctgagcaatgacagattctagggaactcctcacttccccctcgcagtgactgagctgctcagccttaaaaagaaacaggaaatctaaactagtttttatattaatgggggaaaaaaaaacaaaacccactcccccatgtgtgcccctggctgttgtgctaggttgactgctgttttaaatcgtccctacggagacggggccgctaggataatggaaattgattagagtccacattcttagaattaaagaaaccaggggggggaaagttttctctgactttcatgtcatcccaggacacctgtcgtttgtggacagccattgttgtgtgactggggcattctgagatgagccagacagacattattgtgtcttgggacaccgttgcttcctgtgttgacctcagtttccccacgtgtacaagagcaggggaccccaggctgcttttctgccttgcccttacttgggtccccaagccagtgccagaagtggaggattgattgtgtaacctgagtagtgtgtcttgccctgtgagccctggaggccacctctggcctctagggaatggccctcaggcaacccgagggaggccacttagtcctggaagcttggccgggagctgcatgctcttctgaccacccgggcttttctgcatgcagcagggcacagaagagcgggcagctcttctgggattctccccaccccaacttgtcagcttttgtacaccctggctggagggggttccctgggctcctggctgtctgggaggagccagtgtagttttacagtggcaaaatgggttctttaaaaagtccagagcttgagctggtgggaaggatgagagctttcgaggcacttgcctctaaacctgagaacctgagtttgatccctagggccacaccatagcatacgtgcacccctgaaaataaataaacaaataacaaacgaacaaacaaccagacagataaataatataatacaaggtccagagctccaaattcagagccagactgtgtggtgtgaggcctttggctctgtgatttaaggcaagctggcttgacatctttgggcctttattcccttataaagtgggagaggagactagaggttgtcctgttggttttataggattgtgtaacttatcttgaatactctaagcagtgcctgcaggcagtcagctatgtaaatatcaactggggttattccttatgtgataattaatcttacaggtgagtagggtagtaggttgagctcccacagaggaggctgtcatagggagctgcccggagggaatggggtctgagccttcactagagacagcctggggacttccattgagtttcctgttgatctctagattccagctacggaaaccaaagagtctgttctgttcccctcctgaggcttcagagctccttcagcgtgcccacactggatttaggcttcatccagacactgggttgtgcccttccttgtctcctaggatcctaggacctcagctgaggaagcagaaaattttgggatgcgttatggtgatgttagcgcagtcttaggccactgtagatgctactgaccgtgcaggggtggtgtgtgtgtgtgtgtggggggttgactgggaaccttgggtctctactttgagatcttggggctgttttggacagcaccagtggggatagtaacatgacaggtgccattatgtaagagctgacctttgtcatttagtgcccagcattctgcctgtggcagccacttaacccctccgagagaagggtgctgttgatagcccactgacagatgaagaaactgaggcagcaagttgaagtgagctccccggtggccccatgtcctctctgctctgggtttattggtggtgagtgtggggccaggctttcccccataggccagcttgtaccatgcctcagtttccacatctgtactttgggtgcagtggagcagctctttgacacaggtatcatggaacttgaatgagcctgaagttaatgcctactgtctgacacacagtaggtggttgcagaccgatgatggtgttttggggtaaccgttggtagataggatgtccctttagagttagactggctgagtccttcactccctgttccttggttgggttggttagagtgctggcaaggaagaagatactgcatggtgggcagaaaaccctggggtttggggtgggggggaggtcctgtcagccttgccctgaggactcctcttgagtgaggacagagaccttgtcatttccaggcatccggagggtcttctcaggcctaccccaagggatcatgggtacacagctcccagaatgcatctcatgcttctgctttttgggggaggagactaataaagattttctctccagagcctgctcaccaaaacaagaaattgtggtttgcagagtcactccttgttttgttttgtttttgctttttttttttttttttttttagcccctatgttcctagccctaccctagggagaagggcctgggctgggtgtgcagggcacactttgggttctgcagtcttccggtcagaatgagtacctagtggctttgggcatctttgtgggcttgtgtttggaaaagcagggtgctgcgaagtgtgggcacagcagttctgccttggggacgtaaacagtaatcatgggggcggggagacagctcagtgggtaaagcactggccttgcaagtgtgaagacaagagttcagctctctagagcccagggaaaagctaggcaggtgtggctgtccgtttttaatctctgcacttgctatgtagagatgggacccttggggcaatgtgaccagccagtgggaaagctaggggctcagtcagagaccctgcctcagtatagatagagaggagagcagctggcatcaacgttgggtctcccgattaatgtgcacacatgcacatatacacatacatgtacacctacacacgtgaacatgcacatgcacagcacagacagcttggaccagagctgatgaaaacctttaaaaccttattacattattcatgtgtgtgtgtgtgtgttgtgtgtatgtgtatgtgtgtgtcaatgcatcaggtcaggggaccataccagatgaatcccagggaccaaactcaggtcgttaatcctggaagcctatccctgcccactgaaccatcttgccagctccccagttttaatttattttttgatattagatctcctgtagtccaaactggcagtggacctgccatgcagcctaggatgaccttgtgtcacatgacagaacttttcctgggaagaggaatctactccagttaaggatcccacaacagaccaaagtatagataccaccaaagctttattggggtcacttatatgggggaggggttggctactcacgggagcagaaatgactccacgacagttgcctcatcaaagcccacacagcacagattgcagctcaggaagctgagaacctggagcacacaccaccacctgcagcagctcagggggccggagagtgtcccttccaggtggctcagctggtctaaacctcttccagcagctgggctggtttttgcttcatccaggcagctcatctggcaggaaggggcctggtgagtctgctcagcttcagggagttccggaagctaccttttggttgttcacctccttgcttaagaagctccctgtaggatggaatgttttaatcttgaaggagactgttatacaacaccctaccacttcctcctgctcttacatatatcctgcccccctcctccccagtgatccccaagctttggaaggagtgaccatagatgtccacttatgactaagaaaaaggccaccacgcaacggtgacagtcacttgttctcagaagcttcacagggggttatgagttgaggctgataaatgatctatgggcgtaaacacatctatgggacaggcacgacacgtccgtctagtgacttagcacctcccagccacaagtttttgtcctggcttacagtaccagatgtaaaccctttcttgtggtgtaggccttaaatctgattggaaggctgtactcacgacaatcgaaccactattgtgcaagcacgcacagcctgccttgcctgtcagtgtttcagctcccagggtctgtagcctggcaggaatgttggtgacagttctctaccagtgccctgcaggccatctctgggattctaaaggccagctgtcagactggcacttcccagttcagtctagcttagtttctccatgtcctgcagtcagatcatgtacacacacatgcatgcacgtgtagtatcttcagcattagggtcttgccgtatgattggcatgtgaccagcatctgtggcagtagcctttatggtttgtggagcctctggggctttcctggctaacaattcacaaggaggtggctcatccccctccccaccccgggactagggttgtcacttagcagccttttcaaatcacccagccccagcagggtttcagggtaggtagaagtatcattggctttccagatttgcaaaacacccaaccttatgtcatctatataacaagaactttttgcaggtgacaaggagacatcccaagccacccgtggcataacaaattgtggcgttacatagcctaggcaaagccctgagagtctgttgtggtcctttctcagtagacgtcaggtcatcccagaggttcacaactgagataataaaacgtaacacaagcaaggtctaagatagcccgggaagagcccatgaatttgcatcaattgcttcctccagagatcaagattggttacaaagcatggagagggggcgctaacttcattagctccctgtgatccttagtcattctctcgaagccatttccatatcccgcagttctcccacagagcctcccttcagttccccacacctgatgaactcagtgggcctgactgaatttgctcagaccgactcagggcctaggggtgtggggatgaggccctgctctcgccagctacccgctggcttcctgggtcagagccccccaagctggcaatgaggatgtagctgtacctgttgctactccgtccaccatacctggctgttcggggaattcctcactgggaaaactctctctgcccctagtataaccttttgctggaggtaaatataccctccttagttttgggataatgacccaccctgggacaggtttgactgtcttcccttgtattgttctgtaacagtttctgtaaactgctcccaggttttaaggccacccagaaaccccttggcggacacagttggactttctatcagctcttccttagaattccagcttgatacacacagatcttgccacagttacccaggaacccagacagacctttttactgtctcctacaggatgctctcacacttgacagactcttcttctacgtgttgctcaagccttccctactttataaagatcttgccccaccaaccaactcagcagatgctaaaggttcaaaccaacctccaggtccctgttagctcagctttaaacaaacaaacaaacaaacaaacaacaaacaacaaaaatctctttggtgaacagagttctacctggcccagtgaactctgggtcaaacacagctcctcttattcctttcctagctcctttaagagtgcctgcccctcctctatggtctgccagctcctggtctttgtggggacctcagatggagataaccatgtgttcctaatggctctgataagccagtctgggagggactggtttccctcacaccgtctcaggcttgtcttaaggagggatggcaagtcacatcactcagtttttttgctgcctcctcagcagccagacttggtcccatctgctttcacgtccccccagcttcacaagccagagctgtaacaggctctttcactgatggtttaaaagtcttccctaattccagcagtttaaatgctgaatattgcccgatcacacgagtttcttccattggaccgtggttaatggccctgtcttagtcagggtttctattcctgcacaaacatcatgaccagaagcagttggggaggaaagggtttattcggcttacacttccatactgctgttcatcaccaaggaagtcaggactggaactcaggcaggtcaggaagcaggagctgatgcagaggccatggagggatgctctttactggcttgcttcccctggcttgctcagcttgctctcttatagaacccaagactaccagcccagagatggtcccacccacaagaggcctttcccccttgctcactaattgagaaaatgccccacagctggatctcatggaggcatttccccaactgaagctcctttctctgttataactccagctgtgtcaagttgacacactaaaccagccagtacaacccccatctgaatgctgtattgcagatcttccctctttttctactggaggttggacttgagggagatcttttattgcttttaccacctttctcatccacttgtttgccttgtagttaccaaatcagcagctaacatggctagctgcatctcccttttgttgtggtggctctgaaaccagctccttctacagtgccatgtcagcctctcagcgtaagcatgtccaaccacgtacagcagaggccaggcgacctctgccactgcttgctgacttccatgtacccatttcaaagatcgcaagatttcttccaactgtgttcagttcttgtttacacagtggatcccactcatcaagcaggcttgcgatcaagactgccatcctgcggttcttcccacagactctcctaatcctgacggctcagcctcagttgcatgtatgtcttactaccaagaagcacgcaattgccattgtaacacaaaggcacattaacacactagcacactccatacaggaaagaacatctctgttgcagtttcctctgtagatgctcttctcgggctcctcagcctcacttacatcccttgatacccacagccaggaccatgtactcacgcctccccatctcatctttgcttctgccgtgtccctgtttgggtgccaatcgtgttgtgtggcaaaactttttcctggggagacagaatacactcatccactcgttccagctaggagacccaagatagaccaaagtacagacaaagtccaacttggtgagccatgagttttattgggttattgacaggaatatgggtaaggggtgactcacaggagcacaaatgactcaaagacagctgcatcaccaaagcccacctagcatgggtgacagctcacagagctgtaaacatggagctcactgcacagccagaaggcagctcaacaggttggagagtgtcttttccagatgcctcagttggtcctcgtccagacagcccggctggttgttgttctttgcaggcagctgccctggtctgggttgtctttgtggttagtctctgcttactctggaggggcggggcctagtgactctactcagcttcagggagttcctgaattgctttttgttgttgacctccctgcaggatggaatgttttaatcttggagaagagtgttctctaatttctggttcttcatctcctcttctaagtgctgagattacagacacgtgcagccacaacccatttctatattgctgggaattgaacttgggacttcttgtatgtcaggcgagtgttttaccagctgagatactggatagtttatggtgttggggatggaacccaaggccttgcacatactaagcaagctttctaccgctaaaccatatccctggccccagtgagaacccttgatgataacatctcagatgtctgggtttggtggccctattttcgtgtttgtggcaagcagagccccagacagatggaaatttgggcactgattacatctctcagcgcacaggtatttatgggacacttgctgccccttccagactgtgagccaggcccagggaattcagtcgccaacagggcacgtgaggctcttgtcctgtgaatgaacggctttttctcagacacaggaaggtcattcaccattattctcacactcctcctgactgccacagatcctgtcactccaggagagatggatggtgcaggagttcctggcctgggagacctcagggcaggagtactaactagaaagtactcccttgattaggtcaaggagtcaggtcctgctgggcaggtcctttctcaggctcttccttcaagaggatgtctttggagtaggcagctcctgccggtgtcaaatttcatttgcttattgctttttgctttcctggaaaatagctctctgggtagaatcctgacatagggggcttaccctaatccaacgtgtgtcctctgacctccccacctaactactgagacagggtagaacgggccgtcaccctggtcttcagatggctctgccagctacagagcaagtcatgggtcatgggctgagtcttttgtttccaggtgagaagctgcggtccttgtgagggacactggccctgcaattagacagagtcctgtccccagagccttggggactgtcaccctataatccagtgtcccagaagtgagtcctggaggagccagctgcttgtcaggatatgctgggcttgcagttctacagagtggggctactctgtgcattgtggaacaatttcagtgtcatctgtcaccagctagatgccaggatcagcctctgcccagtgggactgactatcaggaaagtctcagaagtcaccagatgtcccgtgaggggcggtgtgagcagagccttctgataagaaccactgggctgggctctctctggcttccagctttgggttccaacctttgggtgctcatgtgcactggtagcaatgtggggacccactgtgtgtgtgtgtgtgtgtttcggggaggacctggtgtgttgtgcttctcacccagcagtgtggcccctgtgttctctctcctcttacaggtaagagcaccaactctggctgcgctcatattttggctctgttcctgggaccttggacctgatcctttgcctctgtttgcccgcctgtgaagtgtggctgcctggagccatccaggatcccttcctgcagtgcatgcagtggtctgatctgggagaggggctcagtgctctgggttttctctggtggctgcaggttcacggtgtccctggaagttggggaggagggaccttcatcctccctgtgccggagcacgggaagtttcatctgtttcttcactttctcgggcagcagggctcttcctttgtcttgtggtcaggcgctcaatctgtgtttgtcagtggtctggttcctttccccagtgtggagctgacagtgctcccttgactctgggcggaggaggccagggtgtcatagactggtgttggtaggtggctggcagcctctggggcctgggtgtcttctgcctggaggacagagcagagtgccttcaccgagagcttttattcatgaattcacttcccatttggtcgggggacacaagtatgtactaggttctgagtgtcttgttgtgtctcacagagtcctcagataccacagaaagagtccttgaaaatgatgaattgttgtagtaatgatacaaggtcctactgtgtgctgtgtgtctcacagagtcctcagataccacagaaagagtccttgaaaatgatgaattgttgtagtaatgatacaaggccctactgtgtgctgggcattacacagttatctctgatcctttgcacagactcctgtagatgtcaccatacatcatcattgttaccaccatcatcatcatcatctttactctcatgacaccgtttctctgtataaccctggccaacctgaaccaggctgaccttgaactcagagacccacctgcttctgcctctccagtgctgggattaaaggcatgggccaccaccaggctcagagtggtttgggaatgtgctcaagtctgcagtggggatgatgacacacgaaataaatgtaggtaacaggtttagtggcagctgctcatgaagagtggccaaggaaggcatctgtggaggtgggagagcttcaagacgcgttacaggcagtgagaagtgtgtgtgcaaaggccctggggcaggatggtacctggctggttgaacagatagatgctagaatgtttagaggggagaagataggatgtggttggctggggcccagtgtgtatgtgtgtgtgtgtgtggtgtgcatgtgtgaacttcaggttcactggggatgtggagagccagtgatagtgttcagcagggacatggtggaaggtggtttgtgtggagatctctggagcctcttgcctcctttgtaggtaggtgtctctttaggagacaggtgacacacctcacctccaggcagacccctgctacttacaggttgctgctgtgtgccccagggagattctccaggcaaggtcccagcttccttgtgggtctggccaggtcacagggaggggtagtttggaggcagggaggggaggagtttggactgtttgtagccagggtgtaggtgtagatgaggtgtcctggtggcttgccttctgagcccagacacaatgcacttgagggtgaccgcctcggctttcctgtgatagataaagaagaagacagccttgttttctgctcaggaagttagttacctgattaaaaacaaaaagccaaaaaaaaaaaaaaaaaaaaaaaagaaaagaaaagaaaagaaaagaaaaaaaaaacggtttggtgacacctcggccccaccctgcgctcagccgtcctaaagtcagagcgagccctttatgtgtgctctgaactctcacacacccacctgtgctggtgtgttcagaaccacttcatggggagggactctggggacaggaggctgggccagggccgcagctgtcttctcgtcacacgtcacgtcatgtcaccgaggtgttatcctgcacgaacacaggcttctgtgtggcctcagcctccctcctttctcaagccgttctctttaattgagatgtgatttatgtatcgtgaccctcacccttcccaagtgtgcagcacgtggcttcgagctcattggtgacattgtgcaattcccgtcttccccgttaccccttcaggtctcatttgttttttctctaacgtgccgagggtcgcccactgtctgagccttttcccttgctctcttgtgcagtgttctcctcctcggtccccctccacccccaactccagcccacttctttcaggcctttgctcaagtctcatctctcctgggtcttgtctgacctctcgccacccaacctcactacttcctgtctcttctttccccagtgtgatttcccagtagccgacgctcctggtgttttatttaaggagtgatgtctttaccttcccccaggatgtcagctggactaggacaggaatattcattcctgtttcattcactcccttctctggcttcaagaacgccacctggcgcagagtagatgctcattaaagatttgttgaatgggaagccttgctgctgtgtatacatgcctgcgccgttacataatgtgacgggtgtggattatgtaacagctagtgttttttgtgtagactttgggaacctgagattagaacagtctagtgttttctaatgtagctgaagttatgtgagtgggtgtgggccgagcagagtgttctcctggacggcatcctacttacgagcccagggttcgggtcggtccgtcatagtcaggatgtcggggtaaacgtttatctctgcctctggtccttggcttccttgcctgtgaaatactttgggatgcttagttctctgcctcgaggcggttctttcctctgggttgttttctgtcccccttctctttgcacaaggacagaggactgaggacggcaggacccatcctaagcaggtgggctctgatccttcatgtttggctctgcactctgcacactgagagcaggtacctggcaggtatggctgccaacagaaccagaagcggctattccccagttgctgctgcaagggaaccccaagactgaaaggaaggatcttttcctaaagcacgcagcaaaactgctcccttcccatgctgtgccacccaaagaaatgggaggctgctgttgtgggcggggctgctgttgtgggcggagcaggtgcactgcttcttgagctgagagctgaggtcacttgtcaggtcctgcagatgttgtgtcttcgttgttaatgagttatagtaagttaagtggcttacgactgcttctgtgtatttcctagggtttctgtggatcggaggttcggtgcagcatattgaagctgcagtacaggtcccagccagggctgggatgccatctgagggtggggagggaggggcttagctccttcgttgttactttgttcctttactttgtgaggggatggcagtgaacacagggtttgcatgtgaggcaagtgttctactacaaacgcagccatacccctactggcagaatctaggcaggtggtctaccactgagtcaggagcatgcacacatgcatgcccatgcaaatgcctgaaggaaccctagtggattctagtcatgtgttttaccagtgagccagtccccaggtcctcactgagagattttgggcaagtactgtactgctgagccacacctctaggctattactgggagggctccgggctatgccatggcctcaggctgcgctctgtgatagacttctgtgggcagaattcacgttcctattttataggtctgagcttcccctttccctgctgactgcagtggacattgtagcactttcttcctctgtacagcctggcctctctgacatggtacaaaatactcagtattttaactatcggctgattgcgttgtaggatgagcctggagcccagcccatggtgcccttccactggggactttaggatcagccttgagggtagtaggatggctgtctatcctctctgatgccatctgttctcttctgtggattgataagggctgagaaagccattttggttgcattggtgtctcaatgttgggactttcccaggcaacttatcccgcagtgacctccgactgaattctaaagtgctcagagagcgctctagggactctcaaccctttgcactagcttgaaacttgtattgtgacccagcaaaggctctgactgattaaccaacccttctaactacatccaaaaagaacgtgtatcccgccatgttgggctgatgatctgaggaggtcatgagagtgaagtggcattctcggctactatagccttcctggtttcggtacctcctgctccgttgatcatccagaaggctgtggtcaccactgaggatggagatgtgtccttcagctttcaccatgtgcattttgttctgtgggatgtgacattacagttctgtcttcccaaggaagtgatgacccttctgtcatggtggaacacatctctgacccccttctctactccttgtttggaagcctgctgtctgtccccatttttctttgttttctacacctttcttccagcatcttcctgtctttttatctccagcacatctctgaccggcaccttacagttgagcctgctttttcaaatctattccggcagcctctactttttaattctacagtttagctcacgtatgtttatttcagtgattgacaaggttggttttagatctagtgtcttgccacatccttctggtttggaaaaggggcctcttcccctctcatacccactcctctggaggtagaaggagtgttacgtggaggaggtcagtcatcttatctcctcagagtggctaaggcattattatttggctccccttgcctcgaagcttcactctgcagctggtcccattaactttctttctaccgatgaccttgttccacccggcccagcctgagtcttttttgctgttcctcctgcacagagcaatgccacctgctctgccttgagtgtccccaccttggctcacacagctccaggtctcatcttgatgccctcctgtcgttttccccacaggactgcactcttagggacccacatagccaggagccacctgcctgcttgctcctcagaatctgcaacaagcccttgtctgctgcggcaggtcatgggcatactcctggtgtctggcacagagtaggcaccctgttgatgttagaggaaggcggatacatgggaatggttggaaatggaacacagtgtgatagagccaccctgccctgatgtgtgggggtgtgcaccctgggtgaggagtcaccctgcccctgatgtgtgtgtgggtgcaccctgggtgaggagtcaccctgcccctgatgtgtggggttgtgtaccctgggtgaggagtcaccctgcccctgatgtgtgggagtgtgcaccctgggtaaggagccaccctgcccctgatgtgtgtggggtgtgcaccctgggtaaggaggagtcacccattgggcttcttggccctcactttaccacaccagggtttcagaaggatctgagctctgtgtgatcctggccaccggctaaggttggcagctgttgtcagggtggctcatagaatcacaaaggagtactgcagcaaagaaatgcttggcagaggcctgctccctacacctgcccagctcggcaggcacacacgtgtcattgtctatgagcataggtactaggacttgagccgtgtttgtgggcctgcacacagggcctcagcttaagctttaaggtcattttcttccttattcttccagccagcccctcccccatcctcattattgcttgggtccatttgcgagtgactgtggactcaaaatatataagccggagccccacaaacaggaattattattcccaggtaaccgcagcttggtacacaaagtcaggaaatttaatcttgatactgaactgtccactctgcagttagtaccccaaattcccccatttccttgagttccccaaatgtcctttttgcctatttcctctgttctggtagctttaatggcagcttgatacaacctagagtagatttctcaattgaggaattgcctagactagattgacctatggatgtgtctgtgggcgttatgttgattgttagttgatataggggggcatagcccactgtgggcagcaccatgccctaggcaggtgtttctgagctgggtaggaaaggtaactgaggataaacctgtctgccagccagctagcagcccatgggaacagacagacaggcttccaaacaaggagcagagaaggggtcagagatgtgtcccaccatgatagaagggtcatcacagaactgtcacatcccacagaacaaaatgtacatggtgaaaactgaaggacacatctccatcctcactggtgaccacatccttctaggaaggctacagtagcccagaatgccacttcaccctcatgacctcccagcatggtgggacatacgttcttttcggatacacctgggagggttggtcaatcagtcagagcctttgcagggtcagaatacaagtttcaagccagtgcaaagggttgagagtccccagcgtgttctctgagcacttcaggattcagtcggaggtcactgcaggataagttgcctggaaaaccccagagcagttcctattctgcttctttggctgtgaagtgagctccctggttagaggcaatggaatagcaagcaggcctgcattcaacttcctgctgttgacctctctaagtgatagagtgtgacctggaatgtaagtcacataaaccccttctcctcaaagttgcttttgtgagtagttcagacgatgctaagacacctccccactgcatccccgtccaccatccgggatgttgtttctttctctccctttggtgaggtttttctttgcaatgctgggatgagacctaggtcctcacacttctgcccttgagccctactttagagagttggggacagcagcatgtagctgagtgccagatctgaagcaggacttgaatgggcatcctgcacttattactgtactcaagattggcaggcctgtagtagatagagtgtttgatgaatgaatatgggtaggaggtcaccatgttcccatagccaggaccccggcacctttgcttgctctcttcttccccttcctatgtccaatcatctgtacatgttggtgtatcttgcctcttctgtcctaggcaaaatcctgtgtgttgctatgaagcactctttgtccccagggccgttggtgtcacctagtgaaggacagaggactctggatcctcacagtccagttcagatcctggccatttacagactatgtgaccagtgttggttgctgctgtaccgggttctaatgatgtcttggacggatggggtggggcagaccagggaggttctgcaagtctcttaggacagtgtctggcacataatgagcattctgaatatgagctataaattatcatagcaataagaccagactgctaataaaacacttaattatgctggtatatgataccatgctaatcaagtttctattgtttattcagccattactcttatattgggggtatgggtacctttcagttattcagagttagaagctatgtgtatctttgtttgagtgtgtatgcatgcgtgtatgtctgtgcacatgtgtgtatgcataggccagaggacatctcaggtattttctacttttttttttttttttttttttttacagagtatctccccgacctggaacttgccaggtaggctaggctgactatccatccagtaagctctagggattctcctctttggctcatggtacaaacttggccaccacacctaggtatctgtctgtctatctgtctgtctgcttacttacctgtccatccatctatccacctacccaccacacccagataggtatgtatgtttgcatatgtgtttgtttgtttgtttgtttgagacagggcctttctatgtagctctggctgtcctggaactcactctgtagaccaggctggcctctgactcagaatctgccagcctctgcttcctgagtgctgggcttagtggtctgtgctaccactcactgcctggtcccatatttagcttttaaagcatagcttttggggattaatctcaggccccagtgtatgcaaggcaagcttgttaccaactgggccacctccccagcccatgccagtgctttgccccttcgttaggacactctggcataaaacacattggcaccagaacactagaatcttagaacgaggtcagggccagccaaggcagagacagcacattatccatgatctcatttttccaggaagggaaaccgaggcacagagctgcccagtgtctgccttgggatttcattgctgcgaagagacactatgaccatggcaactcttacaaagggaagcatttaattggggctggcttacagtttcagaggttcagtccattatcatcatgttgggggagcatggcagcgtgctggcagacatggtgctggaggaggagtcaagagctctccatctggatccaaaggcagcttaaggagactgtgcagcatactgggcatagcttgaggatagaaacctcaaagcctgcccccatagtgatatacttccttgaacaaggccacacccactccaagaaggcaacacccactctgataaaagccacacccacccccaaaaggccacacccactccaagaaggagtagtcaaatacatgagtctggaggccattcttattgaaatcaccacagtgacccagggttaccagttggttgctgagatggcactggagctcacgtttccatatggtgacatcacatggtgacagtcagctttaaccctactgacaagggcctttgagcaccaaggaaatggagaaggagactgggattgagccctctctggatgcggtggatcaactgtgtgcctgggaacagtgtcttttatttcagtgtccatgacaggagagggtgggctgtgtgtttcttgtaggaagtcacagttgggttgacactgtgggtcaggtctcagtgtgattggggagctgtgatcaagttagagcaccttccccatccttcatggttagaacacaggctacaaattggggctcttcaggccagatcaggcccctaagtgggttctgttggcctgcacagtattttagatttttcttattagttgtcaacattgagaaagaattttttgagcctggcagtggtggtacaggcctttagtcccaacacttgggaggcagaggcaggctgatctctgggttcgagaccagccttgtctgtacagtgagttccaggaaagccagggctacatggaaaaaccctttctaaaaaaccccaaaaaggaaaaaaccttttgattaaaaaattatttcttgcatgaaaatctatttttatggcttgcatatccagctgaggttcctgcaggcagccctgactacttgaattttggttgtcagtgcactatctctggttttgttttataattgaatagttaagaggataaaggaatatttcttccaacttgtttttgtctttttgtcagacacataaggaatgcatgttccttacaggagagaggagttattttgaaggaccatcctttggtctcctctgttcctactggggcatgggcatttgaagtggaggtgccagccagctcttgggtggtccttctctgtctctgtgtggagaagagggagaaggttgtctccagaggggctgattctgtggcccagcctctatttcctgtagcctgtgggcagtctcttttgcagtgtcagctgtggtacaggatgctctcacgtccatctgtcctacagactgctccatgtccctttgggaggtccctacagtgaagaagcaaggggtttcccccacagtgtgatgaaccgctcaggtgctgtcaggtcttcctgcccttacatctagagccgttgtccttggctcgccctagtctgtgtttttgaaacagtagtcaccagcaagagctgtctgtctgtcaggattctttgtgacaagtgacagaaaaacccaccccaacagcctccagtaagaacaagaactggcagctagcaagatggctaagcaggtaagggtgatcactaccaagcctgatgacttgagttgatttcttggacctatgtgttgggaggagagaactgattgctgcaagtgtgtgcacacatgtatacacacactcacccacacacactctctaaatacagttaaaaatattaaaaacagggcgtagtggctagcctggtatacatagtgagttccaggatagccagggctacatagaacctgtctcatacaaacaagcaagcaacaaacaaacatataaacagcagcagcagcagcaacaaaaaccaggaacagagaggcctgggttacaagagagtccatcatgtcctgggtgggctccgatttgctatcacaggccctgtgcccatgtctgatccttcactgagactcggggcgggacttccctgcacccattggaggtgggggggaggggtggttcctagaaagaagaccccagagcattgggaccataaagggacggatgctggatgctgggtggactgtttcttctctcagctggggcttcttcccttgcctctcctttgccttctcgccacccgcctgcttgctttaaaaaccacagtcacactgcctcttcccctgctgttctagctctttccaccgatctcctaagagcaccggtggttacaggtctgaagtgctgtgcttcgagcacagtggccttcccaggaactaagtgggaaggtgttctccagtcacttcgttgtaagagaaaggttttgtttgtaacctgtccaggctcacaccagctgtgtgtttgcatctgcaaatggtgggaattcttgggtcagaggatgaagtgtggagccaggcttccagtgctgggcccagcctgagctcacagctagtgtttgtggagcgaaccagcaaaaccagcaggggcttggagcccgctccaggtctgctgaggcgtctgggcctgaggtcagccccagtgggaagcatcctgttctgctgtgccctcccctccccacacagggagatctgaatgaacagaacccagaatgttccggcagcgctggctcccgcagcaagtgacaaaggcatctttgtccggtcccgggtgtgaaatcattccacaggggggatagtgtaggctctggagtcagcttgccagggagggaggggctgggctaaggtgtccccatcccatgcccgttcctgtaatggggtagcgtttcccctacctactctcactttcatctgggccagaatgcttttttgtccccttgccctaggaggagaagataggtcctaagtctttgaacagtctagagaagtgctcacccactgaactaccccctccttgcagtgccccatccctttatttcgtgagagagtctttcggggtagcccaggctggcctcaaatgaacagactcaggtttgcaagcctgtgtcccagtacccagccagtatgctccagactccgcagatcttgtgggctgagaacgatgcggggctgccattctgctgagaaggcgcgtgtcaacgtcaaccttctgtcctttataccacagtgtgcacagcagctgtgaaaccaggctggcatggctgcaggggacaggcaggggacaggcagagcggcagagtgttaaaatagcttggcggtgactttaacacccttggctcagttcccttgggaatctctcaagggggaagaaaaaaagcccgtgggtgcgcaggggagatgctcaatgggtaagagcgcttgctttgaaagtgggaggccctgagtttgaatcccctatactcatgtgagaagctacacagggttagaggtggggccagagggaggcacattccaagagcttgctggccagcctgcctagctgaaatggtgagtgtctggttcaggagagaccctgcctcagagcaccgaggtggaggagagtgagggaagataccagaggccctgatctgtcttctgcatgcgcacttattggtgcacacacgtacacactcacacactcacacacacacacacacatacacacacacacacacacacacacacacactcacatatacatgtgcacacacacatgcgcacacacagtgcatatgaaagatgtaaagctgtggagatttttttccagctgcatttctaatgacacagtaaaatgataaccaacaggtaaaccgcagaggtgggcattagcaaatagcttgttagaccatcaagcgtgctttgcaaagaatgttcttgacctctgacctctctgtggataggaaggcagctagagtaagtgagaaaggcaatcccagtgtttagggggaaaacaacaacaacaacaacaactactactactactactactactactactactactactactaaacaataatagcacagaagctgggcttaatgtaatcctggcaaaggaggcaaaggcaggaggatcaggcaggctttcaaagtcgtcctcatctacatagcatatttgagtccagcctgggctacattggattctatcttaaatagaagaggaagaaggaaaaggggaaaaaaaaaagcactaaaaggctctttgggtgggcatgtcagttggctttctgttgtggtgacaaagcatccgagaacgtcagttcatggtatttgaggtctcggacttggggttggtccagtcacctgtgataagggcagtacgccacggctgtgggaacaggtccatgagacccgctcacctcagggctgcgtccccaatatccatgaagtagtatctctccagagagctggcttcctttctgcaggccatgcctccttaacggttctgccacttctgggtagcatnnnnnnnnnnnnnnnnnnnnggggtgcgggtgggggtggagggacacttgagatctaacttactgtctgtggtggcacgggcgggtcattcaggaactggagctggggcaccaggcatgtgagctcaaggacagctcttagaaaagaacaccctcatcacagagaaaactactgcagggcaccaggctgcccaccacagggggcctcaggcagagaatggggagagatactttgtatattttggtgcattgctgccttaattataattaacagatttgcaaatgaatgcagaatacattaataataactcaagctgtatcatacatactgtagtctgtgcataccaggctcttctttgaaatgaggcaggctgggattttctgcactgctgtttggtacacatgtgttggtaggtagtgtgcaggacgccccctgggccctctgtgagcccctagtcttgtggggtcagggacagagaagacaattgcattataattgttgtatgcggggatcaaggttgtcctcaccctgtggccgcctctgcctggtgttttccattgctctctctcatcccttccctgtacccagtgtggccctttgtactgctggccctgacagatcccaacacagcgcagctctgtttttggccccactctgctgggatgttgctgcctagggaggtcccttccctgaccatcctgcccgtgtgttgataggagttggtccattgggtcctcacaggctctgaatgtcctgagacctgcacatgtgtggccctcctcgctcctgtcacttcactccgtttttatggaacctttgtgcggtacaccttgaccttggcattgcagatagagccggtggcttggttcagagtgggtcttgaggtccgtgatcccttgtcagagaactttccagactgaaggctcaaagtatggaaacttggttttatctttctcctcatacccggctatgtgacttggaagcaaggtacatctgtgtgtctgcctgcctgcctatttgtctgtctgtctatgcatctgtgtatctgtcatctatctttctatgtatctgtcatctgtgtactcatctatcaatcttctatcttttgggttgtcatggtaattgctgaccaagccatctcttcaacccccatttctcactttgagccttagctttatattcataaagtgggaaccccagtagctctcccctcctctgatccttgtcccacccgaatcaaggcaggttgtagcagctgtatagtatgctgctgggtgtgtggcaggcgactcagtaatgataggtgttactaaggataacacaggcccagccatgagttgaaaataaacaggataagcaaggttaaaccaggaaaaaagagaggggtcctttacagaacacccagaatatagcctcggttccataaaccactcactgatgggccttggtaaccatggtgatggatgcacaatcgtggttcttgagggagacctgttttgccggccaggggacctacagaaatgcagtggcactgggctgtcaggactaggaaggaatgatactacttccattggatacccagcataggggtgctgggaggtatctggggctgaggaggtggcttagcaggtaaagtgcatgccaagcaagcatgaaatccagaatccagatccccagaacccacaaaaaacccagacaggtacagtggcagctgccatacagagacaggatcttgggaccagtgggcgagctaggctcccgtcagtgggctctgggaccagagagcacttgcctcggtggatgaagtggagcagttgaggaagagcaatgataatcagcttctccttctggccagttttctgttagcctgacccaagctacaatcgcttgagagaaggctagcctggtctacagagtttcaggacagccagggctacgcagagaaaccctctctcaaaaaacaaccaaccaaacaaccaaacaacctaaaaaagagagttagggactctcaattgagaaaatacctacaaaagattgctctgtgggacattttctagattaacgatagatatgggaaggccaagctcactgtagatggtgccttcctggtggtcctgggttctctaagaaagcaggctgagcaagccacggggagcaaggcagtaagcagcacccctccgtggcttctgctctgttcttgcctccaggttcctgccctgacttccctcagtgatggattctgatggggaagtgtaagcaaaataatctcttcctcactttacttctggtcatggttttgtcacggcaatagaaagcaaaccgagacaacacgcgtgattgtgtagatgcatacaagttcgtcccacgtctgagtacgcatgcatcagacaaacttctgatggccccacagagaagggtctggtctgcaagactggccctttttgtttgtttgagacaaggtcatgcaatttagctttggttggcctaggactccttctgtagatcaggctagccttgactcacagagaactacctgcctctgcctgtaagagcgctagatttaaaggcctgccccaccatgctcttagcagtacatgggatgctgacagatgtcacttactaagtactttgagagggagggagggcctgaagctgagaggacttggaagcccctggcctgtttttgtcatagcactttatcaggatgcatagctgcctgccgagacaccttcccatcctgcactgtgagtcaggtctttggtaactctggaaggtggtgggaagggtctctgtgactcctggcagatagtgtctgcagcctctgctagcccagctagctgctcactgtcttggtttggtgtctgagccatgcactagggttgggagagagcctagagccaccccgcttctctctgtggggctgagcggagatggctgcaaatcccatgtctgtagaaagtcctgtgggagcagggtccttgctactgccctcccccagtacaggaggatgggagttctgaaggtccagtggagggaggagggacaacagttccctcaggttttcctcgctgtggcagtctgtggctgacggtgtcctttggtaacctttgctcacattgcattcccacactgacttctgcgcagacctgggcggctctgtctagatgacaccagatatctctgtcgtcggactgctcagcagacccccgagaacccaccatcttcccactgttcctaaagcccctgtggcctcggcatagcttggtgtcctctgttcaatcttcctccccaactgccccagccaccaggatatcctgccgtcccatctccacagtaggcagagtctggcctctccttgcttcttttcctcttgcctcagccacaccccatggtgatggtctcagcctcctttgtccccaccaggaaggttgcccttcccctggccccctgcttccatcctggctcttgcacgtggctctccccagggaccttgttagtcagctcactcctctctgctctgaataaaagcctcagctgtcccgttctcacctccactctgtttccactgctcagacctcatctgcacacatctaaacacctccagccccagggctggtctgaaatgctccccaggtatctgcaggcttgcaggcctctgccaggcatcttacctgtgggcaccccgctctctgacctgggggtaccctgacctgtctgacgtgtcagctcctctgtgttctctctctgctctttcagttgctcctggtggttgtgtcagtggaacaaaaggtcttgaagttcagaggtcttgtcttttctgtctcctggctgagggaagattctcctggccattgtcacttgtccccttcccaggtcagacagaggcaatccatggggtgtgtgtttcatccagaggagagatagtggacatgtaggttatgacactttggggtgtctgatgacatcctaatgtttgaacacctgggtatctgagcctgtttgcagaaatcccgactcagtctttaaataaacgaaggctttgtgtgtttgcttgactcatgcttgggcttcaggcacagctggatcaaggagctcctttgcctgcttacctgagttcctccattgtagaacccttgtggggaggagccctgctgctgattgaccagactgggccatggacttcctccccaaacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgctctgaatagcccgcccgtccttcttaacttgtggtccaaactgggacacctcagttttactgtctgtactagtgtgacttcttcttcttcttctttttttttaaaagacatttatttttatatgcatacactgtatgctgtcttcagacacaccagaagttatcggatcccgttacagatggttgtgagccaccatgtggttgctgggatttgaactcaggacctctggaagagcagtcagtgctcttaaccactgagccatcttgccagccccctagtgtgggttcttgaccacctaaggccagatgagatgccactcactggtctgtgacacactgctgttctcagggaaggcccccttggttctctcccttccttagcctgtcagagcctgggtgacacctcaggatgcctgtcttctctcagggccctgtcacagagaggcctggtgatccgtgttttaactgcagcaaccttggtttctgtgtcctgattttaaaactcaagagttccacatgttgggcagcagagctggctcagggggctaagtaagagtgctcgctatgttagcctggggacctgcgttcgagtccccccacacccacataaaaagccaggcatagctgtacatgtctccgaaaccctggtactgtgagggttagagatggggttgctgtaactcgttggctgccagcctaacttcaggttcagtgagagaccctgtcttgacaagtttggatttgggtctagccttaggaagctgtgtgactcagagcagattactaagcctctctgtgccttggtttctctacccataaatgggggagagacaggtgttctcagctccaggggtcactgggtggtttccataagatgatgatatgagggtttgagggatagttctattctagttgccctggtcacattctttagtccttatttccatcccactgttggctagacccctgagtcaggcaggttcctcctctaccacatcaaagcagctctctcccacctgtctctttttgtggcacttggtccagatgcagattagagggaggcgttgtccaccactggaggtgaccggcaggagcgagggctcagcaagtatagcccagggcgagcccccacctccccagaggattagacaagccccacctcccccacccctctccacctctctgtagctccacccaagggtgcatggggtgccagggccccctctgtatttgggtacacgtgggaaaggagtggtccttagaataaaaagcttccgtttggagcaggtgacactatgtgcagacacctgggcaggacaactgcagctcagcgtgtctcctgtggtctgcaggagtacagggctcaggcatacagggcagaggacctcacctctctctgctttgtcattgctgtgtgatatgaggtagctccatgcctgtgaccctaactggggttcttgagaaatacaggaaatactatagatagggcagtgatcgcttgccacagggacacacctatttgctgcagtttcagggtcctgtaaggagcggaggaggttcctagtcagtccccgaaaacaaagagatgtttccatttccccaatcctggcaaatgtttatggatcacctgctgggagcccctgctctcccaggtgcttgctggagattgtagcctaggagtctgttttgacccctcactctctacagatgctccgccccccataggccccacctccgaggacacgtggtcaggccggaaaggcttgaatctgagatgaggcaagtgatttggccagcagttcagggcccgctacggagacgagcaggacttctggcagggtgggtgggggtggggagtagggaataggggtgagaacagatgcttatgagatgagggctttaagcgggcagaagtttgtgtgtgtgtgggtctatcctgtgcttctctgggtcccgtgggtcaattgaggctgagctagaaaagcagtaagaggtgctgtatacggctggtggcagcctggaccaggaggtgtcctagtgaagcaaaactggtctcctgggattggaagggaaaggaggggggcgtgatgaggcatctcagtgtcgaggagtcacccgggggacttcgtgaacaagatggagacttctaggacgtgtgcagagggcttaacctcctggaggtgggaaacctgggagtcggggtggaggagcatccttgaaggatgggacgttttctcagccctgttaggccaccaggcactgccctaagtgctgctctgagatgagcaagaggtgatccaaggcttggccacctgctgaggcgggaactagaagctggcctagggaaggcaaagccaggcaggcaagagatgctgatgctctgagcctgggttctgctgccaggcaggatgttagttttccctgggagtcagtggggcaacagaaagnnnnnnnnnnnnnnnnnnnncaggggtggggaggacaggagcagcctggctggctaggtgagaaaacagtctggggacctacgtgggtttttgggattgctgttttctcatctctaggcagaaatccctgggaagaccacagaggggctgggaacagaggccacgctgtgccactctttttggggggatggggctgggagagggagctaggtcagctgtgtgagctacttaatacccatgaacttgcaattaaatgcggaagtaggagacaagaagggtggtaaaagggaatattgttcccagctccctggggaaatggccagcctccaatgtgaatgggcttcagtgtcttggggggctggggtccccccctctgctcgtcatttggctctttgtcctgctgtgttggatccaaccacaaaggccagcttgattctcacttgctgctttcttggggagcagtagggggctttgcctccagcagagagctctctctgggaaagggaggtgatggaatttggggaccatccatatatatgcggtccactatgatcaacgtgctagctcccttgccatccacagcatttaaatgcttggctccttcagcaaagtcttatgtgtaaaacatacagtgttaagtcaggcttgtggacttgcgtgtgatatgatgtctgtgtaactagttcccattttccagagggagggccaccagcacccacaggctggcccttctctttgttactaccacatacccacaattctgatttgttgtttcaagacagcatcatctcatgtagcctaggttgaccttgggttcactaggtagctcatgatggccttgacccttgcttctgctgggattacagatcctgagacaccacacctgtttgatgggggtgctggggacctcctggatgttaggtaggggctctgccaaccgaggcacatccccagccctgatttctgtcattgaatattagcttcaacgggttttggactttagactaggatcctgttgcatatggtctttgtttcttgagagcttgtctgcaagttctttccggggaccaaagctacctgggtacccttgaccgaaggaaggctagtcctctgtctgggcaggttttccttccttataagtgcgtagctttgggagggatgcacatggagaggtaagaaagagagggaagcctagcagactgaggttgtcagccagattaaccctggtgatcagtggggtgacagacatcaccactagatcgccacacatccctttgtgtcttttaaattaacttaaaaaccattatagccaatttttttataagatatgtgcatatagagctggagaggtggctcagccattaaaggctaggctcgcaaccaaaaatataagatatgcgtatataaaactagatggcatagctgggcatctagcacttggtagactgaagcaggaggattaccatgggtttcaggccagcttagtgtacacagtgaaactgtttcaaaacaacagcaacagcaacaacagcaacaacaccccccagcctgtctgggagatggcccagaaaaataaaaggtgtataaacctgaagacctgagtttagttcattagaagggacacacacagagacacaaacacactcacaaacaaaattaaaaaaaaaaaaacccaaccaaaatcacccctatgtagtatgtatactaaacatctatgtgtaaaatgtacatatgtgattcatatgtggcagaggtagccatgtatccctgtatgtgagtttaggtgacacgtaccttgtcctttgctatggaagatatcacacagtggtctcatctgccagtagcatttgcatgggtctccatcaggtgtcaggtgatgctctgtgcattgtttagactaatcccctgttgttggatattggggctgtgcccatcagagccatttagcagtaattcatgctctctctctctttctctctctctctctctctctctctctaactcacacacacacacacacacacacacacacacacacacacgcatttatctatctatctttgcaacaggggtctcactaagtagccctggctatcctggagcttaactacgtagatcaggctagccttgagttcacagagatcctcctgcctctgcctctagagtgctggaactaaaggtgtgcgccacctctcttggccacatttcattgcttccactgacagacgtggatgtgttctgatagaaaatgcaccacagacgagcagctccctagccctcagtatccttccagtgtgttcatgtcgctgacagtcaaagtgacgactttcgtatgcatgcatttgggtcaagtccacaggccagcggtgactccgagtgccctggactctagctcttttgttggacctaatgtctctgaaagctgtgagcacctagcatctgtgctggcttcgaggaccgcctgggggatggttttacattgctttatgtagtgctagcacatttctgtcttctgcctaccatcactcagtgtggctgctggagttcaccagcttgtcccctctttctggacaccccttgtgtcaggaactgttctgtccttgactttacccactagctggggccagcaccctctccagttgtgacagtccaaaacatcatgtgtccccctggggatgccacctggcccaggtggaagtctctggtctgtactgagctgctctgcaggggagtccccccccccttcccacccctccacacatggacaaggctggcacgactgtattcttagtctataggtaaggagatggaggctcagggaggttgagtcattttcttgaggtaacacagcaagtatgtagtagaactgggttctaactcgcactccctcctacttgttgggcacccatcttgtaccagagcctagatgtaggcgagctgggctgtatttgggttgttaggatagaccctcacccctgctgacataggcctaacattctaggtggagttgaggcaggatgccagacaccagacgtccacatgatgcatcagatggtgaccagtgagtgagggtcaggggatgggaaagtcatagctgtggtaccacctgacatttgatggtgttttacaatgacagtgggtgtgggagggtttcagtgtgtcgggtggcacccgcgagatgctgctcatgtgattccttcgttgctcatagggaaactgaggcacggagatgttaatttatttgccaggagatcacagagcccagaggtttgagagtcctgtgtcaggctgcctcgaggccagtggttctcgacctgtggtcatgagccctttgggggaggggggcacatctcagatatcctgtctatcaggtatttacatcatgattcataacagtagcaaaatgaacagttataaaggagcaatgaaataacgttgtgcctgggggtcacctcgacatgaggaactgtgttaaatggtcgcagcattgcgaaagttgagaaccattgctctaggcccattgtcctgtcctgggacgctctgagagtctcctgctcaggcgaccactggacattgttggcagcaagaagtcagagccagagcttaaacttttgtgctggttgcgtccaaggcttagaaaccattaattaggcttgtcgtctgtcttttgactgtatgcttctggtaattcatgtttattgcatttttacaaaagtaccagtcccaaacggatgtggtattaaagagagaaagctgttctcgggggagatggaacacgagtgtctcaggagggggagtgtacctgcaacagactgcagccaagtcctcctaatgagaggctcagttgatcggaaggatggttgttcccttccccctatccccaccctgcgctctttgtccccgaggggctgggatagctgaggggctccacccactgaacagatggagaagctgaggctcaggcaggtgagcagcataggaggtcctggcacctggatagagctgaacctgctggccctcccgaaaggctgccttgtctgtctgtccatcgacaactctgagctcctgtccaggagggagagcggggcttccccagggaccaccagcagctggggcccctagtgggcctctgccccagcctcttctcagcccctctctttgtctctgtggccatggcaacctggctggccgcttggcacttccagccccagcccccagtctggagctgtcctggtagctctggcctggagcctcctcccatcctcactgctgggggctgccgggtagagcctccagggaaggctgctgcaggccttccacccttctggtctcttccttccctctgaggttgcttcttggtttcagtcactggcttgtctgtttcccttgcgcagtctcctgtgttctggggctctgccagtccacactggtcttccttacctgcctcccctctctatgcctccccatctctggctggatcccaatacttcacatatggccccttcatctgaggatgggcgggctggctcagagacttgccctcaggacatgtaggcccctttcttggctcagaggcaggcccttgctttagagaggttcatctatggccctacaccagtgcagggatctccacctgtctttaaggggaaggggtgtctcttgggagtcttcttgccccatggagactccttctggtgagtgaaggacactctgagctttgagagggtcctctagtttagaaggatacttattgagagagaacacctcctgggaaagccctgggcggacccttcttggggaggtgggctgcagattctgtgttctgacatccgacccggtcacgtggaaagcttaatctcttaggaaaacctacacgctttcttcccgtcctctgtgacaagggcagcccccaccgtgggatgtttgggtcatttatgagtggcctcagctgttctgcatctacagcaagtagcccttctacccagggggctacactcggagggtccttggagaccttggtgggatggaggttaagaggtgccctagtgtggcctttgacccaagcatgagacaaagtgacttgcctgagcaaaggtcactaaccctaatgcccacagctgggcagctcaggtggccagctgcaggaagaaaaaaaatcagattttgttgttttgattttacacagggtttctctgtgtaagccctggaattcactctgtagactaggctggccttgaactcacagagatctgacgacctctgtctcccaaggtccaccaccaccacctggctcaatgccagaacattttaatcactttggaaatacgcctaaagcctgttagtggtcactcccattttttctcctcacttacggaaaccacagacacaccttttcctctatgcagtttgaacatcacatgttaatggtatctcacaagatgtggcccttgtgcctggcttctttcacttagcgtgatatgttcaggggtcattatcacaatcgttataatttcattcctttttcctggctcagtcatattatagtgaatggacgtaccacattttgttagttcactcatctattgatatttgggtttctactgttgggctgttgtgaggagtgctgcggggagtgtttgtgtgtggtgttttacacacatgtgtttccattgttccgagttcacgcttgggtgtggtttggggtttattaggtggactgagtttggacagtgtgtttgtcaaatgagacgtcctagctcttgatattacagaagaattgagccagggttctctttaacacagactgcttactggatacaaccaccaggccactgttttgtagatgagaaaccctaggtttagaagggtgaagtaacttgcccaggatcacgtggccaggaggcagcagaggttaattagacccaagtgaggccttgctgcagagctcgcttccctgacggactcgtgtctgaggtggatgcgcatctgaggcatctgtagaaccagtgtgcgtgagttccatgcaagggaatgagcggctgcttcctaagccagagccatggctcccaccaccgttcccagccgtggttccggccacagttcacaagtctagcattgcgagagatttccaacagccggacatgcggactttttggtatgaaatcatttgctttgtaaaagctggcaagtcagtcacatttgcaacaaaacaatccaggagccaaacacaacacatctgtggtccacacaggctgccagctcacactctgccctctggcgatttgctggcaagagggaggtgccctgctggacgaggccttgaatgaaccagggactcttctcttgggctgtgccacatggttctgggtcaggcttgttcctgttctaacgggggccctcactgagcggggaggggttagaggttattttggggtccctcatcacctttttgggccctaaaatcatgaatgctccctgaatggcttacagcagccatatgatcctgggctaccgactgcgtggtgcctcagtgtccccgtctgttgttggtgccccactggagttgcctgacatgcagacttggttattagcatgcacgtgtgcacatgttctcccatcaggcagaacgggtgccagggtggctatcctcccacgtgcaccaccgtcattgtcgttgtcatcatgtttctgcagaagtggggttccctcgtgcacgtgacgctgcacagttggagttgtttgctgtatgtgagcgtgtggtttattcacacccactccccccccccacttgctttcccacatttccagaaataaatgcaagctggggtccttgggccgccgaggctgcagcatcagggatgttccagcggatggtggagggacagggcgggtggtgtgaggagccctgagctgggctagttgtgaccccacagtgtgggtgtgaatctctggtgggacccctgcctgcagagtggctgtaggaaagtgctgggctctgcatcactgtcttgacctgggctccctttggatggaagataatcagtttctcccggtcctgcccaacaggcctgcggagcttttctctgctacccacacctcctgtttcttctccccagcatatggctcacacacatttggtcctaagctccgtggagattgatataaaccaaagcgggcagagtcagcgcagcagagacctggccagcttcttgtcttcctgctcacctccccagttcctttcctccaccctccaacccatcctccatcttacattaccttggccctcgccctctttccctgagcacctgtggccacagaggcctttgctcccacagccccaccccactccatttttggttgcagggcacggtgggggtggggggttgaatccattgcctcgccacaccccagtctcccttttactttttattttgagataggatctcactaagttgcccagaactggcccagaactcacttaccctggagtcttagcttagtgtcctcctgcctcagtatttggtgtagctggggtttacagacccaagtcagtgggcttggctttgtgtagcttcgaaggaggcgtgtctagcctgggaggcgtgtctagcctggagctttcccctgtcccagtctggcttctgccactgtcaggtcgtcaggttgtcagatccttctgacccatgtctgttgtgagagctatgactctgtcctagcattgtgtacttctgcgcttgtatttttcctaccgccttcctggcaaggagccttaggctttgtgtcatgttcacagggtctctcaatgaggaagagactgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtaatggttgggaggggacagtaagtaaacctggtaagattccctggggtctggaatccaagctgagtgacttttggatgtcagggagggacaggagttgagggaatgactcctacgaccgaccgaccggttacacttgtcccagtctgaggctgagccctctcctttctaccctgtcctcacccccaggtcacagctttgtgagctgagcccagggctacaactctgaggtggagccaaggcttttgcagctccagcccctggcaggaggcttccccaaccgcccccgccccctgccggctggccccgcccctgccggctggccccgcctcctgccctcctggcgctgtgcacggtgggtcatggtgggtcagcagatctacttctgagtgctgagcttgccttggtcctgtttctcctgaggatcagagttagcaactgagacagatccctgaatgaaggagactgagtttagaatagccttgagtggatcgagagaccccagcactcactcattcatttgttcattcattcattcaccactcagatttgctcactcttacttgcttagtcatgcattctcacattcattcatttattcagctatgcagtaatttgcctgttcattcatgcatttgttcattcacttatctacttttcactcattcattcacctactcattcacattcatgttcacacattcattcattcattcattcacgcatttgcttaccgactcgcttacttattcattcacgaatatgttttgaacacctgccttgaggggctgtggtcactaggtgccaggacagtgaagaagcctgaaggtgctgtgtgagggcagacagccaacaagtaagaagatgaagagcaagacggtcagtggggaagagaacaggagagcagagcggagtgagccacgccctttcggctgaggggtgtgtggctgtacagagcgatgtaggaatggagtctttaggaagactggggctgctgcagggtctggggaggaggagagcagtacaggaagccggaagagcaaagactggtgttagccgtgttgtgctgagtgactgaaggaccggatggaggctggggaggctggcgtggccagggtgactgtgaagtctgagggcgagaacaccgtgtttcaggcccagtggaatagaagcatctagagtagacggagtggagagggagacacttctggtaccaggatatttaaacacagaccctgaacaattaagctctccccaggactctcacactgagagaagggacaggctgaggactgataccggccagaagagaaacttgcctctcaggagggtatttctaagtcaggacaaagatgggtcagtgacaggcagggccacccctcttccagcatggctgcattctgtaggcctcttgtcctttaagcccaaactgaatcagctctttctcatcttttcactgtcacttgtaccttctaagaacaggtgactgagcatgttttaggacctgtgcagcccaagtttagaccttattctggcaacagctagatagcggagaagtggttggtgagcaagagttggggttattgaggtcgaagcaggctgaatagggaaggtgtagataccagcattgtgggtgactggggagggctgactggtagactagccaggagaggttgtgtgatcctgggcaggccactttattgtttcttcatggcctggaagctctcgatggccctgtgaacataggcagaatcgtcattgtcatcatcaacatcagcaccaccatcatcagcatcagtgtcagtatcaccgtccacaacattagcatcggcagcagcagcagcatcaccaacatcaccgtcatcgtcaccaccatcaccaccaccaccaccactaccactaccacgagtcacagcatcattcacgcagccctgctgagtggagcagagtgggcctggagcttattgtcccagagtggagtgggtgaaggagcagttccatgagatttgtaggtgtggacccttacccatgctgaatgggtgggcacagctggacctcactccctaaagaccccatttagtccttggctggtggctttctgtgtaagggactgatgaccgtccagaccagacaggctaaaacagaggggacttggtatccctgaagccagaacgtgagccacgggtgcagttgatctgggggtgctcggtggttccggggggcagtattaggtgcctcacctggaggaaggagagaagtgggtgatgaaaggtagggtggcctctgtcatagccaggctggggcttctgggacctaggagttctttgggttcagtccctggggtcgcagctgagattccagaggacacttgacggtggctttcatgatgtttctgtgggtggacttgcgtcacagcctgacacgtgccctgtgccctgaagcaagctctttgggctccggtgttaggttcttggctcccagagactttcccacgacgactcagatgcaggaggttgatcaaaagttctgtttgggttcttctcctctggtgctgctggcttcaggtgtgtctgccatcaagtctgtggaggtctgagagggggcatccctccctccctaccctcaaaaaagaaaacccaccgtttctactttttttatttggcctggattttttttttttaaatggcatcactaatttttgaaaacaaagaaaataaaccacaaccgtatttcctgtccccagcatctggtggccacttgtcatctgtgatgtttggggaaaaagatgtgttttgatcattcttcaaaatcggactgtagcagtgtagccgtgtaccattaggtgatgatagccttgccgggcctttctcatttctaaaacattttgcaagtagctctctccaggggcctcttcagatcttcccccagattccagacctgcctgtaagattccttataattacagattttacaatttgttttcctgtgaggtagagtctctagcccaggctggcttcaggcttgccatatgtgtggaccttgaacagccgacatttctgctgtatctgcttgcttttgggcaagcacccttttcactgaggcaaatccctcagccccatcccctttcaaggttagtctttctctgtctgtctctgttttttgagacagcgtttctctgtgtagctcttggtggcccggcatttgctctgtagaccaggctggcctcaaactcatagacccacctgcctctgcctcccaaatgctggggttaaaggagagcttgcctctgcctccccgctcccccgccccctccccagcctgcagtttgttctcttgtataaatttgtaatctggagcagcaggaagaggatgtggctagaaggggcaaggcctgtggatggcagtgatggctgccagctgccctcaggcacccttgcttttttaggacattctttggacccactttgcgtctcctgttttattttcaggcttttttgatgcgcgcgcgcgtgtgtgtgtgtgtgtgtgtgtgtgtgtgtgcgcgcgcgtgcacaaacatgagtgtgcacatacacatgtatgtgcatgcacgtggaggccagagggtgaactcggtgtcaaactgttttgctttcatgtgttggatggagccagggttttctccatcaaccctgagttctctctctccttcccttctgtgggattgaactcaggctgtcaggcctggcagtcagtgcctttacctgctgagccacctcactggtccttcaaacacgtgtgaaataaaaaccattgccaagtgtagacccagatccctggacacacagaactggctgtcactggattggcagacggatgatgttcacagggttctgaatagcagggggcggggcttaggagtcggtagggaaggtagggacatgggggtctgtctccagggtgagcaggaaggaggaatgtgctcagacgctcagatggtgccactgccgtccatcaccatggtgaggaaggaggccatgggaacggcctcctgccagcgctgtgcagcgtttcctgagcatttctggaccccagtgaggcctcagaggccaactgcatccaggactcagttcaccactgaggtttaatgagtctgtgtgggagaggggttaggaaggctcagggtcagtgagctgcttttctacgcctcacctgtcaaattccctgccccatcttcctcttctccctccttcacacctacctccctccttcacacctccctacctccctactttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggccagggagatggcacatgagtcaaagcatttactgtgcaaacatgaggaccttcgattcaaagcccaaggacccaacgccagccagatgaaggagtgtctgcgaacccagcactcttactgggggatgagaggtagaggcaggagaagctctggaagctgggggacggggcagcaaacctggcatcagcaacagcaaaacagccaagaggcctgcctcaaatagagtggagagtgaggactcacacctgaggttgtgtgcctgcacgcacgagggtcattgtccagtgagaaggagttggttggtgaacttgaagatcagcaataaaagctgagggaagacagccagccaagggaatgagtgcttcttggctggagggagggaggctcagaagtctgagccaaacgacctggcttgtgctctccgaaggactgggtgttggtggtgagcttgatgcctggagccaagccttgcaccaccaaatggggcacctcaaagccaggttcttgggcagagtagacagcagtgcagtttttatgaatgagtctagtggagttttgcctggtatcgtcactctgacccagagatagggacagggctagcatgtccctgccttctgtcttcagctggctagtttcaggagaccctgggtgagtggttgattgacaggcaaagcaggcatcactttttagaagtatgaactccgctgagatggatttatatgtcattaatatctaagtgtacaccgaacggctttgccagcatcgtagcggctgcaggcagggagctgagagccaaccccactcagccaaggttgctggggacaggtgacagaggggccaggtagcaaagagacatgcttcacggctctgtccatccagtcagatttttctggtggagccccacggcctgagggaagccagggctttgtcctcagggaggggcttctgggggggggcttgaggtctgggtgggagggggcccagtgaggccttcaccttgaggaagagagctgagggcctgagagcagctggttctctggctgtcatcagtggtggttaggagatttaatgctgattagtgtctacttggggaatgcatgatttctctgataacactgcaggagtgctggaggcaccctaatgtggagttgcccttcacagggccttgataagagttatttcatgaaggcctcttctttttatcacatgtgtctgtccatccatccatccatccatccatccatccatctannnnnnnnnnnnnnnnnnnnaactcaggttgtgggtttggcagcaagcgtctttcccctctgggccatctcactggcccctagtgagggctctgatggtcacctcttcaagggcttttattttttgtctttatttttttctcgtcaagagcagcaaatgctcttaaccgctgagccatctgttcatccctcacaacttcttttggaagtggcctataggagtttgggaagccagactcatgggatggaggcattctcagctgggtacatcgtcgctaccccctcttcagtcccgtgccaccgcctcccctgggttctttccacccgtgtcaagcacatgcctggattctgtgttcatttgtggaggacacgggtttgcaaaaggcaggggcagtggctagcgacgtcgcctccttcctgctgaggtatcttcaaggtagccaggctcagccagctttcccagcaaatgtgactttgattcaccgaaagctcttgaaattctgtcagctggaaggagcgctggcagcgacatagcgtttttttttttttttttgtcaccacattcatgggcagcctgttcgctgatgtcttccacagacctgctgggaaagtggaccactgcgattttattggcagcaccttgcagaaactcgatcctcagccgccacttgtagtctgtgcagagccactggctcctaaagtgtttttacagcaggtccccggcaccctgattaacataggaacaagctgataagttctgcaatttgagagccaccagggtaggtatggcttgtgttggataaagtgtgagcagttttcacagtgccatccagggcgcttgcagagcccgagctggtgcctgtgagttgggctctgtggtgggtgccaagcattgtctttccagtcacatgcctgccccagacagctcactgaggatggagtttgtcactctggaggaaggtctgagtcagccagagcgtttgctccaaagagtgcctgagctcctggtgtttcttttattcttggatgaagggtgtttttcgtgagggatgggggtggggggcactggactatggaagaacatggcagccttattgtaacagtccagaacttactaaccggtctgattcatccctccctagctccctgtcccccctctccccctctgccttgttttgagacaaggtgttgggtaggtcctgtgatggcctctgacttccctttcagccagtactcagcatcccttcctccctggcctgctcctgcctgcacaggtaactccttccttgcccttgctcacaccagggatttggggtcgctctggctgctttctccccagcatcccagctagaccccaatcttgtcccagacacctctgccttcgaaccttccctataccttgtttaacgggaatgaattggccttgtgtgctcttctgtgtcttcggcattccccgcccccacgagccctctgaccccagggctcttgggcctgctcagggttctcctctcatgtcccttctgtgtttgttaggcacaccttgagcttttcctgccctagtgcagtaccagctcatccccaagggacttagcacccaaggtcaggtgacctgtgtgcttgtggctcactgagtgccctgcatagagggctccttgtactcacttcatcttcccttcaagttgtagctctgtttggaaaagcccagagtgaggtatgttaaacagatttaacatttagaatttgaaaatagtaaagatggatgttttgggttaagtgtgtgtgtgtgtgtgtgtgtgtgtgtgtgtgtgtgtacatgtatggtgtgtatgcacattacgtcacatgtgtggagttctttcccaccgcagcccacgtagagagcaactctatcctccacagaccttctgtggcctctgaggagccatgctttcaggtctgttcctcctccacagccactcactcatctatttcccatggcccatagttttgtcttttctagaaaattaaaaatatatgcttcactgtagacaatgtcgtggggacataaaggaggctgtgcactgcacacaggggactcacatggtatacagctttctgagtcccagcaggtagcacttggggttcagccggggtctccgtgtgtcaagtgtgttccttttagagcttacaccatcccacggttcaacattcacccaaggacacagagtccctcctcattggctgacctggacatccgctgttaagagtgtatgcactgtttgcttgtgaacatgagttctcgtgtatccagaataaacaccaggagtggcgttgttaggctgtgtgggctctgagtgcttagcagcgcgtgaagttgcaggcggctttgcaaaggcgccgggtcgcttaaatttctcaccagtgggatctgagagattggtggttcacatccctgacaacacttggtattgtcgatttgccttttaagccattctggcagatgtacgtacatacgtgtggaagtggcaggttgtggttttcctcagcctctccctcactgatggcgctggatagcttttcctgtgccttccttccactcgtatatcttctttgcacagctgtgtgttcaaggttgactttttatgattttcatgtttctgcttatgtagaacctctgggcctgatactcacagccggtgtcgtcttgagaccagagtagccggggctggtgaactggctcagtggacagaggcgcttgtctctaagccttgtgactggagttgaagccccaagcttctgccagctgtcccctgacttccacaggagcatcattgcaggcattgaaggcatgctccctccaaatgaaactaatcagcaagataaaaaagttacactagccgtgtgaccccctggataaggccatcatgagatcagagagggtcctcaaacccacctccaagattctagctgtggttccctccccctctgctgctgcacatgatcttggggtgctacaatgcacagagaagagagagtggttgggatggggactcctgtggtctagtttgtgtgagtcaccatgccggctggggtggggttttagtatcctctggctgctcaggagtcacccgtgctcttggaaggaaccctgataaggccattggttcaccaagctgggcttgggatgggaggggtttctttggtctgtggctgcctatctggagtgatagacatttctgtgtgaatccccaggagtcacatgagaaactagtttaaaggttggtttgcttggtttcttttttggggttagggttatagcctgggcacacttcccttgccagaatgtcattcatgcatagtccccaagccctcgcttgtttgtccattgtcttactgggcctttcgcagaacagaacatggcttctgtgctgatttagcgcttgtcttcctctgtgcttttgagcgtcaattataagtgatgttgatgtcactttgcttaacctcaagccaaaaggtattttccccttgttttctccctcaagtttcatagttttgagatttgtatttaaatgtgtgtatgtattgtgtgtgtgtatgtgtgtgtatgtattgtgtgtatgtgtgagtatgtatgtatgcagtgtgagcatatattgtgtgccatgtgtatgtgtgtagtgggtgtggggtatgtgtacatgtgtgtgctgtatgtacatgtatttgggggcatgcctgcctgtgtgttacctatggaggtcagaggtcaactttgattatcttagtttatttctcaccacctcactttttcagagagaatcttgtcactgaatgtgaaccttgccattgtggatagctggcttggtcatcgagcccctgggacctgcctgtctacgcaccacagtgctagggtgatgggtgtgtgctcccaggcctggtattttacctgagcaccgtggatctgaactcgagtcctcactcttgtgtaggaattgcttcactcgctgagtcacgcccctcgcctgtgggatctgtctagagctttgttttgtgtgaagcctgtctttgcaggaggcttgagactctgtactttgtgtttgactgctggggtactgtcggctgaagactgcctttctctgctgactttccttcgcatcctttgctttagctgcatcctgccctcgtgagaggcgcttgcacgtctgttcatgttcacagacccacgcccttcccctcgcaccgggcgccggcataattattatgacttcgcagtcattctgaagattgggccgtgggagtcccaatgttctttctccaaaccgtttcagctcttctagtttctttgccttcttctcttaggcatttttataatatcaagcagcaagggggtgggggttgcagttggaaagtcctctgaagaagctgcatgtttgatttctccggtggaagcccagctgccgatggattggagatcggtggccaccctttcagattagtgtctgctgtccccactggtccttctccttgtccttagcctggctggcttctttctatctccaaacacacggcttcagtaggcattggtgtccaagttctggaactcttcgggtgcctggctttggggtctggcatgcagacagccgagaggaagaagaaggggaagaagaaggggatggtgggagctgtcagtgccagccaggactcatctgtggcctcgtggaatccttggaagatggcctctctgagagcactaaagttaccatgtctgtagtttggagggtatgtggtatgagagtccagtctgaggcattttgcagtctggtggtagagacagactccctgtcagcgaatgcttgcacaagatccatttggctgcaagcatgcttggaagaggtctgcgcaagggggccctggcacctcctgtctttcccctcttcctcctcttcttcctcttggccatctgcattccagaccccacagccagagacactcaaagagtctcaggacttagctggtaccactggaagttttggggggaattaaatgagctctggcttctcagaatccacagtctgtgcttgccagtgttatttttatatactactagggagattgcacatgtctctgtgtttggaggcgttggtctccattccagagaggaggcgtcaggtgggcatgcaggtccatggtgcacagctctgagatgagacacgcaacccagtcaggtcccatgctctgtgctctgcagttcgggacccgctaggcttgtaaggcccctgtgggtcattttgccttagagttgagtctgtgaaccccttcccgtgccctccaaaagccacatgtggcctctgggggcccagctgcagttgccatggagtccagctgtcatcccatcacactgttgctaggcaggtgtctggttgccaggtgctacctcctcagaccccttgactgccagaaagcctgtatggggctgctgtggcgtggggcccacatggttctcttagtagatgctgtagccagggaagcttttgggtggttgtgtctgagcagccctgagcttagggtctgaatgagtcagctctggcattcctcattagatacgctgacccaaggctggacaggtctcaagccttcatttcgtagatggagacagggaagtctcatgatatgagagaaggagggctgtggccctggttcctgcccaaggtgtgtgtaggtgctttgtcttgcacactgaaggctctgagaaggcctgggggcatctttccttgctgggggcctttccatggtacttggtgcatagccctccttccttagggctggcctggcctgcttagcatagacttctctttccttcccacgtgatcacgcgtctgttcatctctcaactgcatccctgatgccctctattgccccatggttctgctttccagccttgctcatgcatggagcaggcccttgccacagagcttctgcacccgctctggacttgcttggcctgggctccccactgctgccatggggtttcttcccttctttggcctctttgtctgaggtccttcctggccacggcactgaaagcagcctcccctcccccttctgctcttgtctctcttctgctctgtaccagtctatagagaggaggttttgtgtcttgttcaagctctgtccccagggctgagaccacagtgccacccttttgagtagtagcaggcggttgtatacttgtcttgagtcctactctgatcgcatggaaaataccagcagggcagcctggcctgggacctgggctggcctgttgtgttagccattggctaacccactcctgggtctctagctctccatgtgaagctggcatgggaagaggcgacactggcttaaataccctttgtcttgggcatgagctaaggcagagagctagcagctcagggtcctttagcataaaagagacagctctgggatttgaacctagttctgtgctgtgcagagctgtgaaccctggaagcacctatactcaattgagggtctcatccatagtggatagagcatggggagtggctcaatggggaaggcagaggacacccccaaatagcatctatcatccctgctccccatgtgcccagcctacctcttggtctcttggcttcagctgccagttggctctttcacacagcctgctttgaaggtgtgcctgctgggccttgctcagacctcttccaaacgcttgctgccaaatccatctcgtgcaagcatttgctgacagggggcctgtctccaccaccagactgcaaaatgcctcagattggactctcataccacacattcgccaaactacagcctgccctgtttttgtaaaagtgactctggccttaaccatgttggagaccagagccagccttcatcttctcctctccactccaccttagtaaatcacagggactctgccttcagaatactagaacctatttttcagtttaccattgcctcctgcttcctctcagtctctcctctacactcagcctgctccctcacctgcttagaacttctctgactcccacggtacccagaggagaatcagagaccccagggtgctgtatgctgggctcctgctgggtctctgggttcatttcctcttcccatcattcttactcctgtgattcagcctcacggtacttggaacacgggtgggttgctgccgcctggagcctttgcgcgaacgaatgagcagcttgttctgtggcgagaacactctccctcgctccccacagctgattctccagctccctttaggaatcagcttggatgtccctgcttttgtctcctgttgtccttgcttagccacatcacacctacttgttaaggttacttccagggtctgtctgtctgtctctctctctctctctctctctctctctctctctccctccctctgtggctttctacacacagtctctcactgaacctggaacttgcctcttccgtttgactgggtggtcagcaagtctgtcttccataacctcagcactggggctacacagaccatcgttgaatccagccttttaagtaggtcctggggatttgaactcaggtccttacatttgcatggcagacacttttcctgctgagctatcaagccagcctttaattattttataaatggaaaagagaatagtgggtggtggtggcacacgtgcgcgagcgcttgtatacacacacacacacacacacacacacacacacacacacacacacgaagaaatgaatgcgtgaatgaaggaaagagcatacatccttcatagaaaactgaaaggattccagaaactgtgagagccagtgttatgataagcgttaggtttatggttctacgcggcagcacccgccattgattccaggactcagatggaagatgcagggggatctctgtgagttcaaggccagcttgattcacatagtgagctggaggccagccagggctgtatggggagactgtgtctgcaaacaaacaagaaacagtaacagcggcaaagcagagcccctggggggtcactccctcggcctgcagggtgtggggatgcagtgatgggtgccaggaagatggagcaggcagggcctcatggtgagctgatacctgagctgacactgagttctgtgggtgcctagaatcggtcggaggggctggtgggtgcagaagacccgtgatgtgaggggctagcctgtgcagaaggcctgtgatgggtgcctgctgggttatgtttctaggcatgctcacataggttggggggggggagggaagagacacagagagagagagagagagagagagagagagagagtagaacaagaatgaacatgaaggcttcggaggtgttggtagccattgttggagggaagcaagcgatgcacattagcagtgtctttattctgtggggtttgtctcctgcaaggctctcacagaggatcctggttatatccatcaactgtaaagctaatgttgtggcaagtgggagatgtatattataaccagagattccccagctatcaccaacactctggtctcactctgccgagtccctgtctctgccttcacctctctgtcaccccagtcttttccttgtttgcttcagactctaagagcagacagacttcctgttccccttcttcacagaggtgacccatgagaaaggtggcttgtctctcaacaaaggaccctaagtcagagtccccatgggggccagctccaggcatggctcagcccataccgctgtatgggagtaggccggtgacacaggaaccagtcccttctcttaaagccccttcatgcgaatgagtgcgtacgtctggttgctcagtgctgcatggttcttgtatgcacatcagtgaggatcaagaatctctccagcggtcagaggccaggagcagcttcctaggcccatggagaggctatggccagccatgttcaggaaccaggacagcagaacttgaataatgattgtggtagtgtccatgttgggcagatggggaaaccaagtctcaaagagaaaggttgggccactccaaatcactagccctctatgggtcttggaattgatgctgtgtatgggggaggcaggcccagggaaaggggctctggccttctctccctcattcctttcttccttccctcatcttatttatgtacccaccttttatctatatgtctacctatccatcaatcaatttgtccacttatcgttatattcactcactcatctgtccatctttctatccatccgtccatctatccgtccatccttctatccattcatctatccatccattgatctgtccatttatctatacacccactcatccatccatcatccatccacccatccattcatttatccaacatctatccatccatctatctgtccatccatcatccatctttctatccacccatccatccatccatccatccatccatctccccatcctacccacccacccatcaactcatcaaaatgtattatgccaagtgccaactgccaattgtaaatcaaaatgtaaatggggggagagtgaacctgggccttcctgtggctcccgaagggctgggcttggggagcaacccttgactgatcaaggagctcaaggcgcagtttcagctttggtggcgtgttaagcatgtatgcaggatgtgggagcggaggagatcgtccctgcccagagttgtactaggaggagtgggtgactgactaagggagaacaggggtgctgcaggtagagagggtgtgctgcaggccttggaggagcagctgggcctgtggtctcagggaaagatcggtgctgtgtccagtgcatctctgtgggtgagcggagtggtaagagtgggcctcttggccttgctggccactgtgttttatttatttatttattttgagacaaggtttctctgtatggccttgactgtcctagaactcactctgtagaccaggctggactcggaactcacagagctctgtctgagattaaaggctcgcattgctgcgccagctcttctggccactgtttcccggcagcctccttgcttttccttccccaggactgtaagaagtcaccaccatcaagttcaggcttaaaacaacaggaatgtatcacacagttctagaggtcagaagtctgaactgggccctgggagctaaaggcaggttgtcagtaggctggttcccctggagcctctggggtaggcgggatccctcgacctgcctttccagctttcagaagctgctcacagtccacagtttgtctctttagtctgactcagcatctgacccttgatctcatgtctgcctcattccttcaggtccttgaatgaccttcggtccactgacagtccagttgcactcccatttcaaggtcatttcctccatcccataatttgggactatcagtctgctttagtggcccaaggctggtggacctaccccatgctgcagcctgcctctgggccccttgatcttccctgaagggtggccttctcttcactggtatagaccctgaggacaaagaatctgttacagagcctagggaggggatggcttttatgctgctgccatcaggagccaggggtgggaaatgagtgacagttgggaccaagagactgggccagagtggatgcctggatgctggatagcccagaggttggagctcagctaagtccacttggcaggatgcttcagcccatggaaacctcagtcttcttatctgtgcagtggggtgaggctggcggaacaaggcaatgccaggcaatgctaggaagctatggcagatttgcgctcacaccccgagggcagcagcgcaatcctgtccctgggaatcccttccccagggtcacagctgctgcagtaaaagcaaacagggaaacttccagccgtgtgggcgccaccccctcccgtcctgtttggagccacactgttgtcatcctctgtcttgagcactgtttcctggttctccacagcccctgtagataaagtctggactggactgaagcctgtacagggacaattgtttggggagatgggggaaaaaaaaggctaacccttggacctgggtgtggggggctcccagagcaattgtctcagatgtcaagtgtcagcgccattgagagcagcaatcccattgtcccaaagtgcagaaggagtgggacccagaaggccacccgcccagccctgggctctggggctttagagtggctggccctgctttgtcctcgcattccggcaggaaatgccacctaaatcaggcctgttcccggacactgctggcttgtgagtttgatgcttttgctcctagccacctgccacacaggcttctgtggtgtgtgctggaggctctccgggcgcttttgtcccctctaggcagcaagcgggtcttggttttgcttcggtagtgtgtcgctctattctgcatgtcacagtcccctggactcaaggggagtgtgctactcgtgggtttgagcagtcagagtttggtcatcatcacctcggccagatgcaaggatatttcatcaccagaaaagaagtcacgggagccatcctgtgcccctgcttcccagaggaaggacctgagacagagagagggtattgttccttgttccaattcctcagagaaggaaggcaaggcccagaaaggctactgggacacacagcaggctagggtacaggtagtacttaaaccccagatgctcattctagtagcagttttgttagctcagtcagctggctgtggctgaccaaggcaatatctggaggcagatctggttgtctggctagagggaggaagccagggaagttatccgacagcctccatagctgagatctgtatgcctgcatatcacgccccacatgtgggttccaccatgtctcttcagaaactccaggcaatcacatgttgaagacctgtggtggagaaccccagtcttaatctaactgcggtgaccccattgttcacaggaaaaagaaaccaaagggctcaaaggaaaagggaggagttggggtctgagtgggagggactccagagcaggttatagatctacaggataacaatgaggagactcagcaagaatagctctgtgctccattagtgatgtctgacttgggtgtggatttccattagccgtgtctttgtgtaggagagggtctcacactcacatttacaacctcagtcaggccagggaaggcagcagtgactgtgtcagatgggaaaactcaggatgcttgccctgggggaaggtggtagccacaggggcttcaggtacttcaagcctatatgcccattatccccaaagaagctagggttggggtattcatattcaaaccgagacacaaagccttttgcaggctcaactaaagagggtgtgagttgcccagggtggctgggtatccactgagtgggccttggcaggggagggatgggtggggctctgtggggagaggtttgcttcccttctgcggcctcccctcccccactgttgagtggctcacagtaggtggtagcaacttgggttttgcttcaagttcctctttggtggatcccagggtgggtgttcctcatcagggtctggaaggggagctggggtaaagggtatgggggttagatgatcatctggtgggcctgacacgtgtgtactgagggcttctttctagactctggctctccacaacacgctaaatggacaaatcgataagttgataggcaaacacaagtagcgtccctgggtgtaactgcctgccagcatgggtgtgaaggaggtggaggggcaggtgcttcagacgggaagggctaggaaagccgagggcctctgccccagaatgccctttcccccagatacttgcagagctccccatctgtcacagtgcttgctcaaacaccagcccctcagacagcctgtctctcatctgagcaactgtcggctcccacagccagcccactggttccaggaagtcttggtagtgagcggtcacctttactaaaaagacagcgttgagtcagaggtgctgggtgtttcccaaggcctgggggtggggatagtctgctcggcatgggcagggggtgccgggggtggcaggtggctttgttgttgatgacaggccacactgtcctctgtctctgcaggagatacaggtattttaagttcaggctggaaaacacaagacttcaaatggtaccactaatccaggcctggtggtatgggccgattatccctgctatttgagaggctgaggcaggagaattataagttctaagcctgtgtggcctacacatggtaagttcaagggtagcctaggcaacctgatgaaaccttgctgtatcagttacccaactgttgctatggcaacataccttgataacagcaaccttaaggaagggaaatactctggctcacaattccagggtacagtcagtcatggcggagagggcatggcggcagaggcatgaggcagccactcacgttgtgtctgttgtcaggccacttggagaggaactctgccctcagcatgctttctcctttttatgcagtctgagacccccagcctgtgggatggtgcctgccccccacattcaggatgggtcttcccacctcaccctaacctaacctaatccctcactgggtgtgcttagcgacttgtctcctgaggtgactctagatcttgtcaagttgacaatgatagtatatatctatggccataccaccctgaacatgctctatctcgtctgatctcagaagctaagcagggtcgggcttggttagtatttggatgggagacagtgatagtatagtagtcttatattgccacaagacaagaactgaactgagagcctgggatgtagctcattggtagagcacttacttgtctggtgtgctgaggtcctgggctcagtctcttaacactgcaaataagcccaagcccacacaagtacaaacaggatggggtacgtgtggccatgctggtggtgtggtcacgctgggtgtctggctccttagtggtggctggcaggtgtccgaagctttcttaggaagcacggtgcccggagcctgtggatacccagctcccattcccagagacccctgtaatctgcagatgggattatgatggggctagatgctcacctacagtctcaagtattttatgtgcctgcatcactcctgtgtatcacatgtgttacgtgatggcctctgacgtgctccctgcaggcagagctctcactctttctttgattcatagaggaggaaactgaggcctgggggtgggggtagtcactgctcatctgcatattcccccccccccccccatcaatggcagagctagacctttacagcctgctctgcactgttagcatttgttcctggccctgccaggcccttttcacacatgtgtgaggcccaggtaatttattgagccaaaactgagatgtggccccgtgtgccccccactcaatgacaggcctcccccccgccccggccctggtcattgccctggctaaggggtcatcagtggctcttctccaggtcattaaatggacttctgtatcatgaacttgtcattgcagggctgtcctgggctggggtgggggaaggaggcgtcactctcccatgactgatgggatggcatgtcatttgtggaagcaagatctttgtgctatgcctgaggttcctgatccctgtaggatccaaaccaggtttgtaagccggtgggatataggactggggtctttgcagggctttctgggtgcttagggggacctccccatgtctggctgtgggggtttgctgggagcaggccatggtgtcttatagggctggtttattattgttgaaggcgtggcttattctgactttgtggccagggtgctgctggtccatgaatctctgcagatcacagtggggattgagtcccatgggcatcctgctttgtacttggtgtgatctgggggtgcccccaccacccctctcaggtttcaccatatgtcgagtgaggtcaccccagctgaggtgtgggtatccctggggacagcagtccctgtccccgagccgctcagattgccattgtctctctccaggaatgagtgcagggctctgctctgttctgcatctccagggagagctgtatcctccccaagctgcgactgtggttccagacagatggcctgggtctccaggcagctgccggctgcttaaaaagccagggccatctgtggcccacagttactcacttgagatgcacatttgggctgggattctccatatcaggccagaccaccacatcctagctctgtggctctaagtgaacacttcacagctgggcatccctgtcctgtaaaatgggcacacaggagggggcctccctcctggagctgcagggttcagagacatgttgttcttgatggcaaagccctgaagttccagctgcttaggaggctgaggcaggagcatcgcttgagcccaggagttattattgtttttttaaaattttttcccaagacagggtttctctgtatagccctggctgtcctggaactcactctgtagaccaggctggcctcgaactcagaaattcgtctgtctctgcttcccaagtgctgggattaaaggcatgtgccaccactgcctggtgagcccaggagtttgaagtcaacccatgtaacaaagaaagacccaagaactgctctcaaaagaaaaacaaaaataaaatcagaacaaaccgaaaccacgctggccggccatagggttccaggtgtgagactctgtggagctcccagctctctcagttgtttctcaccctccctcccaggcctcctccacaggccataccaggggctaggcacactgcaggcagagacagccactggtgagcctgtgcccgtgcctccctcaagtgaaggaggagtgtggaactcaggtgctctgtgatagcctcaggcaccagcagtcctgctggggtgtgtgtctcgaagaatatgcccctgctgggtgggagtaacagcactctttattgtgtgttcagggaagatcgctttaagggctgtcttccatacatggggtggggaggtacgggggtggtggggtggggtggggtggggtgtagagggggaaggttgtgtgtcttaaaggcaggacacaaggacagtgagtgcaaaggccctggggaggacaggcttgaaggaagctgtgaagctggggctgagtgggtggcctgggggcagtgcagtctcattttcccagggtcctgtgcactggtcaggcttctgtctgggctgtgatgggtgccttctctgagaaagactctttaagccctgcagcagtggcagacatcttatcttcctgctgggtacagctatggggaccctgaagccatgtgtactgtgtgtcccaatggtccatgggggcttctgtccctgttcaggtttgtgatctgtggttttgggttgggtgtcatgctggctctttgtccctggggctcagtctacctacctcatctgtagaatggacagacaggaatgcctcccttggtgtgtgaaccattgagagcctacggacttcttcctcctctccctcctcctcctctttcctttccccctccctcctcttcctcttcctcctcccccttctctccttcccccctccccccatgtgtggagtcagaagagcgctctcccactgcttgatcctggctcagtaggtctacctgatggtcattagtcaggagtctgtgttcctaatctttgtctagccagttccccctggagcaggttgcacacctgactcaggcagcctctctgtccccaaagggactcacacaccagagcctggcaggtggagccactctcctagaagaaccttgggggtatgctcttggcaaggggacacttgaccctggtacagtataggtggcgtggcagtcactcatgtttgtgattagaccaggaaaggagcagcaggagtccccagtaagcacacatgactcattcagagaagtgggctggctaggaagacacaccagaacgcttgggtgtgtgaggagagacagctgtggcacaagtcaccttgtggagtcacctacaactcgtgccatgtggggaggtggacccttaccttctgggcgataggacgagaagtggaggctctaggaagcagagctcttgatgcacaagtattcaaggtccctagagctatggcagaacaggaaaaataggtgattgagtagtgatgtttgctacagccacaggaaggcaggcgatagactgtgggcttagtgtctccagcaagcgattccagcacctcctgctgctagagtgtggcctgctcaggctcttcatctgtctgagggccagctcctgccagctagggccgacacctgttcccagtctgtcctgcacgtcgaggaggcctctgggcctagagatgtcacctgacattgcttataggcacatatgtgcacaggcagggactgaagagtgtggtgtctgtgtgatgggtgcctggtggcacctgctaggcactcattcacttctgcagcaggtccatgctttgctgctctgggaccccatgttctcagttactcatgtctgcagctcagaccaggatgtatatagttcctagtgccccaggtccctaagtatagttggttggcctgttgcaccacacctggctccgtggttggcctttcaagagcccttgcctggctagagtttgtttgcccaagccatggagcgatgagcttactgtttcctgcatccttgatgtatgtcataattgctcgtattactgggatgagggaacttgatggatgctgagggactaggtggtccagcagtggacagggccccggggagccacaggtagcatcgcaggatggtgtcttgtttcagggaagtctctaagatgtgtactgcagtcatcttaagtattctgctgccagcaggccctagacagagtcacttagagggtccctcagcagccccacagtacagatgatactgggacctgcagggtggaggccactgtggggctgctgtgtctgcgcccagaacccctcctggcacattctttccgggtcacgagctgttcttggtgcccatggctcgtcatgttggcttgtgtgcatgtcctctgtgggtggcccgagcctctcattgtccctgcacaatagcagtagcccagctcgtgtgaagaaaccaggacaggaagttgcatctaggtcagcccagtggtactcaagcttcctgcccgaccgcctgggcgcctgtgctgggcggggccacctttgtctgcctgtctgggtggctggaaatgggcacaccaggcctagctgctctatcctctaggaaactttgctcccagccattcctactgtgtccttttaaaaagcaagttcaactgtctcaggggcttgagttgaggctccttccctgtgtcagggccctcgcggctatgtttgacttcccagtgtctgtggtggaccacattctgctctcggccgtgagggtccaattgtaagaagagatgtgacatccctccttactgacttactgtcagtatcctgttacattgacaagacacacacacacaaacacatatacacatgtgcacacatgtacacacatgtatgcacacataccaacacacacacacacaggcgcatacacatgctcacacagacatacacactgatatacatcacacagatacacacacacacacacacacatatatatacacacacacataaatacacaccacacacataatacccactatgcacacactcacacatatacacactgatacacacacacatacacacacacacacacacacacacacacagaaacacatatacacagatacgtgcacacacatactgacacatactgatgcacacacactctcacacatagatacatactgatacacagcatacatacatacatacatacacacacacacacaaacacagatacattcacatgcatacacacggatacacacattctcagactcactctgatccccatatttggggagagtaaactaagattcagagaatctggttcgctttcctgaggtcacacagcgggatagaggaagagctgtggtttaaaccaatacccagtggtttccaaacttgacctctgtagagattaagattcctagcctcactcctgtttttatcatagtggtttgactcttaaaagctggtgtatgttgtttgagctaatttttaaaaaataattcaaactcagggggcagggagggcttcttggaagaggtgagtcgtgtttaaggcctgaaaataagatggaactggctcagggcagaatcagaggggaaacatggcgacaggaagaacatatgcaaaggtcctggggcaggcttgagagtatggttccagtgtgggaggatggaggacataggagactggattttaaaacaaacaaacaaaaacccaagggtattggatgcttttcttctgcttgagacacaagactcgaccagagttacttaaggcaggaggagtttgctgcggttcacagttcaagggtgcaaccattatggggtgtgtgtgtgtgtgtgtgtgtgtgtgtgtgtatgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagccagtgctgttaaccaataaaccatctctccagcccctcaagtcaagatcttaagcttcataacggggaggcatggagaattaagtggagcattgactggtttgctcatcttgagggatcttgaagggtgaagaggctgaactctcaggaggcagaggtgtcattgtccaggcagtctgggactctggggggccatggggagctaggactgagagcaccatggttagggggcatatgggcctggtagatgggggggtttcttgatgcctgtactccctggaccagatggaccagtaaaccaggctcaccagtaaagtgatagcattcaagtccatcactacccatggttacctggggcttgtaggcggagacaaggggggcctggctgagtgtaccagcctgtgcgctgcatggagaccctgtttatttggggttactgtgggtgtcagtccaggtgacagaaaaagatctgacagcagacttgaagggccagcaacccctctgccacctgcttctgcctcccccacaccagcatctctgagacatccctgagacatctccttagacaggcatgataggatggggcacactctgaattaacccaaggtagggagaccacactcagtccccttgggtccttgctataaccacatgcgagacaggttgctagctgactggtcccctgtgccgggacaggcccatggacttattttctcaagagtctctatgtgaccagtgcccagttaacctgggccagacttgcttcacattctgagctggaagtctttgtgggagactggcttcagtttcccttaggtactggcttgggtctctctctttccctccatgccctttgtattttaagccacctctgcagcttcccctctggccgctcggccccacccaagctctccagccatctactctctcctaatatgaggatctctctctagtacttcgaaggacatagctataatcccagcccagggattggaggcaggactgaatttaggccaggcaaaaatataaggaaggatggaagggagggaggaaggaaaagtgacttttgttttcctcaaaaaggaggggtggtctagagatgcagcccagtggtagggtacctgtctggcatgcacaagagccttgaatttcaggctcttcaggtcctggcactcccaaaacctatcatcctatctggtgacattggctggccatcttcttacctggccccacatgcaaggggacaggccagtgtctctgcacccatgtgggtgctaagttgctcggtgcgggcagagctggggcacagaagagatgagtcatgttcgtcacagtttgtggatatctcttttgagtcatataaatgtcttaaagcttaaaaggaaaacaccagggaaaggtggtcgctgctgcaacggtctgggaggtatttgggtaaggaagtgagtctgagtgtgtctctttgggctgtagattcctgggggcctggggcaccgtgtggttagttccacacagggtcaggcattgtagatgctctgtgagcctttggctgagcaagcagttgggggcgggcagcccaggaaaaaagtctgtcagcaggggagcttttaagtccttgcccctgtacctgactgcgcaacctttcaggtcctggccagcatttgaaccctgtcctgctggcaggggcgaccaggatgggagatgtggccactcatctctgcttgtttttgtttccgtaggccttcctacagcggatccggcagaatgtggccgactctgtggagaagggcctcacagaagagaatgtcaaggtgaggactcccgttgctgctttctgctgtttcctgtttctcctgctgctgctgttgctgctgccgctgggcctacttcttctaggtgtctctgaactaactccttagtactgcctgcatctggcccccagcctgctctcagcagccctggcactgcctgcctcctccgggaggggggaagggaggctgtgccccaggccccattctccagttcagcctcagtgtggccattctgccttctctcttcctcctgcccagcttggtgcctctgttctgggagcctgatgtctcctgctgcctgcctactcctgcagtgggcatgggttatcaagacaggcccacgagtcattgggccagcttcattctggctggcgctggggagtctgggcggtatcaatggaccgtctgtgtgcctctgaggcccatgctggccagcactctgacctcatgtttctaaaaacctttgactttgtgctctgattggcctggtccagggaaatggatgcgaggggctatgtgtatctgaagtactcaacatttaccatacatgtggtcatatatgtggtcaaggatggccccccacccagtgtcctggcttgtgtcagtcacatgcatgtttgtaattctaagcccactctttcgctctgttggaaggcagtgccactacacagcaggtcctgtggtatgggatggcggggatggtgaaagtatgctcctttgctggaacctatgtgcttgcttcattcattcattcattcattcaacagataattactgagcacctataattcattatattgatttattacacagttagagcttagaagcccttatttatcacttaaacttaagccttgttagtttttaagaaattgcctttttgtcgggtcttaatctccatccaacaagggatcggagtcccgaggatgtggttgtaccacacctgggttctctgtgaagacagggagcatccatggcctgcccactgcctctcccagctgtgaaacttcactgctgtgattgttttcgtcttttttttttttttttttcgagacaggggttctctgtgtagccttggctatcctggaacttactctgtagaccaggctggccttgaactcagagatctacctgcctctgcccccgaagcacagggttcaaacgtgtacgctgccacgcccagcactgtctctgtctgtccttacactttatgacaatgagctctcttgtgtctggtgtcttttgtgatcctacatctgtgggatttgtttgtattaaagtgcgcagtcctggcctgtgcttctccctgactctgtaatattccacacaggggccacgccacagtctcttctcctgtgaatgaatatttgatccatttccgctttggccctgttctcatttctgagtacgccttcttggtgtgcgtttcttgttgcttttgggtgtacactcaagggacagacagtattggagccctttcacaaagtcagtacaatggctagttctagaacattaccttcaacataaccaggttcaacctcgcaagtaggtggaatgaaaggtgaacagaggtgacaagcagccccactggggaagaggagggagtgggcttctgggtgctctaggcccggcaggaactgaggagtaggctctgggccctggccctcccctttcaccttgcactgttgtgggaacaggaccatgtgagctttgcttattggtgcaccttgccctgtggccacggctgcctggagcttccgagtggctgtgtttgcatacaaggtgatgctctgatactctgcatcagagctggctgggatgtcaactcttgctcttcgagcctccggttctcaggggtaaatcggggtgaggaacggcttcttgctcgtggagattgaatgagtgtggcaatccagccatggtctgccactggcctgcacagctgctgctgctggtgggacggcagccaacagcagcacggcagcctggcccaggggaacctcaccctttgatgcctgctcatgccccctggggtgcagctcttctgggaatggccctgctccgtgctcctgactgacgctggctttttggtccgttctaggtcctcttctccaacattgaggacatcctggaagtccataaggattttctggctgccctggagtactgcttacaccccgagcctcagtctcagcacgaacttgggaatgttttcttgaaatttgtaagtatggggcccgccgagagatgggtccgtgggtgaggataaggaccggagtttgagccttcagtcagcactgcctctgtcgtggtctttgtgtgcccactcctgtggtctggttctcccaaccacctcccaagagtctgtggggcatggtcttgtacacagatccctggcctcagcctgctaggtctcattctaggctcttggtgacttactctgagcccctgggcctcagtagcccctgttctttcaccctggcggaagagtttggaaaccatctcctctgagctgctagagaccccctagaaacacaaacttgattgtttctcccttcttctataattctcatggctccaccccatcagagacaaaaaaaaaaaaagtccccacatccctgcaggcctgccacttctcagaacgtaacccctcgtccagccacaccagtccctttgttggtctagaaaagccattctcaacgtgtgggttgtaacccaaagatcaaccctttcacaggggtcacctaagactgttggaaaacacagatatttacttacgagcaaaataacagtatgaagtcgcaacaaaaataactttatggttgggggtcaccacaacatggggagctgtaaagggtcacagcatgaggactgttaagaacctagaacattctaagctgtccccttggcaggcctccctttataatactggtcacatgggagtagagaccttatggcttgatggtctgtccctgtggggcaggtgagatggctcagcagattaaaacacttgttgtggggcctggtaactgtcatttggtccccaggacccatgtggtaggaggagggacctgactccagcaaattgttttctgagctccacagacatgctatggtactctcatgcccagacaaatacataagaattttcctcctcctcctcctcctcctcttcctcctcttcctcttcttcttcctcttcttcctcctctttctcctcctcttcttcctccttcttttgtattttctttttttctcttatttattagatattttctttatttacatttccaatgttatctcctttcctgctttcccctctgaaattcccctcccccttcattttcctttttgagataggctctccctgtgtagctctgcctggctggaatgcactatgtatctcaggctggttttgaactcagtgatctgtccgctttagcctcttaagtgctgggattgaaggtgtggaccaccacacccagctatacatacaatttcttaaaaaaataaaaataaaaataaaaaaaaaggagaaaagaaagattaacccatgctcacctgcccaccccatggaccagcaaatggcagtaggataagcccaaggttgtgccaacagatctagacttagaaacggccacccagagctcttcaggtttcagattcatgctctgaggttgaggcctctgctgcatctgcctgctggctggggttactgtgaagtcctttaagattatttcatctcaatacttgaataaatatacttagcaaggtgtgtggtgtccctgctggaggggacagtgcccctgcagacagaaggtgctcaggtggcactgtgtgtacttggaagctcctgttcacgcatcctaccagatactcatcacctgcctcaggccaaggccacccgaaggttctgtgtgaggtgcagggtctgtaatctcagtgtctaggaggctgaggtcgggggagtgggaagttcttggccagcctgggctatgtctcgggaagtagagggtgtgggatggaggagacactggcattacccacacacctggcggaacccctcctccaggcagtgccagcatcggagaaagcagcctccaggctgcccgggatgagtcagtgtttttaatttcaaatcatgttttaatttaaaatgtagctccatcaccctctctgcccccatgctcagggagggagggcgtgagtcaccgtggctcaggagttttacagtagctggaggcaggtgtgcaggtggcttcatgggggtggggcagctggtgaggttgatctgtctggtcccagctgggagggtggcagaatgggggcggccttggggcctgtgcacagtggcagcgaagaggtcccaccttggtgcaggcagccagtctcttagacctggggctcttagcagggatttggttgccagcgtgaaggaatggtgctattactggtggccccacaggatcaacacggtgtccactccagcccaaaggccaaatccagctttgttcctcatccttatgtctctggagacgccaggcagcatctaggctgagggagtaggaatggacaaggctacccatcccctgccacctactcagtctttagaaagaacccacaccctgcaagctaaccgctgtatattgaatttacataatcaagctccaagtgtcctctttcctgttcagggtgctgttctaagtgtttcacgcacaccagctccatatatactaaaactgcagggtggctagggatgtgccacacacctgtcttcccaacactgggaaagctgaggtaggtggattacctcaagtacaaggccagcctggtctgcgaagtaagtaaggctagcctgggctaaagagtgggcccctatgtctcaaaacttgacagtagccttagaaggtagttaatgtcaccacctagtttacaaatggggaaactgagactcagagagactaagttatagtttgagtttaagtaacaagtcaatatcacaactgggattaggcctgagaagacattctgacactggaatctgtcaccatcgaaagtgacactgactcttgaagtacaggaggagtctgagtgccaggcacgatggtgtgagtttgcagcaataggcagggcagccctacttccttctgctggcaccctattaagtcattggcatgaagagcgacggagatcaattcagatggccgtgtagatggtggctatgagatgttggggtcatcaggtaactaggacccttctgggggccactcagggtcagacttggtggatgtcataaacaagaacacaggacgtaagagtggcttttcaggtaagtatccagatatagtgactcatgcagtattagggatgtgcattgtatagtggccagttgggcatgtgaagttggtgtttatatgggcaccctgagtggccctcttccaggatggaggttgggcacccttgagagaaggtgttcctcttccaggatggaggtagggcacccttgagggaaggtgttctggttgaccaaaggcagagggaggtcctaatgctgccatttagcaagctgtgggggagagatggaatgacataggaccaggccctgtggggcttctagccgaggccaggacgttgggttttgttctgagagttgtggttagctcaggggcggtgagtttgagtcctaaggaggctttctgcttacagaatgtgtgaacaggtgacaggttggggacacttgcaggtgcagctggccgttctccatctttatggcccagctgctccctacccttctccaggcccttcttcctggctgtggtttggagctgatggtaccttctctggggtattctcatagctgtgacaatgtgcctggctcccccggtggctggatctttctcttagcccgctgctgtatgtccccgtccaccacatgtgtgtacagccatgtgtctgttcattctctgtccaccgcatctgtgtgtacagccatgtgtctgtttgttctttcctggcagagaagacttagctcttctgctccttgggaagaaataagccacacatggagacttgatacttcgagcaaggtttctgaatctgcagaccaaggcttgggctggggcctgagcatcttgatgtgaggacagtgggtgactgagcttgctgggtttatggaggggagcatggctgctgtcttaatcagtgttctattgctctgaagagacccatgaccacgcagctcttacagaggaaggtgttcaattggggctggcttacagtttcagaggtttaatctatttccattatggcggcaagcatggaagcatgtgggcagacgtggggctagagaaggagctgagagttctacatccagatccacagccagcaggaagggagcaacacaggggctggcttgtgctcctgaaacctaagagcccatccccagcaacacacttcctccatcaaggccacacctcctaaccctttcaagtagtgccactcaaatttaatatttgattaaatattcaaatcttgtgagcctgtgggaggccattcttagtcaaaccaccacagtgctactggctactcctacctgctccaggcagcaagtttgaggcctcctcttctggaaggctgaggcaggggtgaccttgtagaccatcagatgtagagtatccggtccttccctctctacgcctgtggcagacattattaatcaatcacagttgttctatatcttgaatccttaggggtcctcagagtacttgccagcaagctctagtttcgttgccattggctggggtcggcatgtcttctggcctggctccttgtggtgtaggtgtaggtcggcagggaggtgttacttcattatatttgagccttgtgctttgcattttcttcttgggatatgatgggttgtacccagtcggcagctcttggccagccctgttctttacagttttaaatttcttatttctgaatgtgtgtggtgattcattctctgtgtagcacatgagagccacactcatccagatcccccaaagctgaaactacaggtggctgtgagcatttggttccacagtctccaaaaacaccagccagagaccaagtatctaaacacactatcctgtcggggatattttccattaaaccttcctgacccttgcttctcagtgggcagcgtacgttgcaggtagaggttgggtttcctgaaatccacgtagttctgtgcacagtagctgctttgagtatgtagcttgactgttgtaatacccagatggtccaggttcaccccatgatgtatgtacgaatgcatgctgggtaatcatgccatttttttttttttatgtttgtactttcccaacagtgtgtatttattgcttgctatcatggccacgccttggagggcacccgagtgcccggcagtgtttcccacgtgctaggttgttctctgcccacacaggtgttgggaacctgttattcatagaaaccaaggtttatggaaatggagctccctggccagggtccctactgctcaggcagtgtgtgctgggtgtgcctcgctggccagtgctcggcccgtgcctggtgtggccgttagcgctctcaggctgtaggtgctgttcctcaggatatgcgctcagatctgtggagcgcagtgtgaatgtggcaggctggagctcctgttgattggaaacccccgtcctttccttcatttcccttttctgtttccctcccaggcgtctgtggaggaaacggtccccctcttgctccttcttttgtctccctcccccgtcttcctcctctggcttcctctttcctgtcccctctgtaggaagcatggactgtggagccgctttagacacaggatgagcgcttgccctgcagacccacctcttccttccttagtttcctggggtctctggtccatccttcatctgaggtctaggctctgcaggccccaggccctgagaggcctcctcaggacatcctggtttggggtttgaccgattctgggaccctttggagtggggaatgcttagccgaaagcttcctgctgagagctctcttttgtccaagtgtgaaatatgacagatgcatagcgacctggtgaccttcaggtgacctctgggctggaaggagtccactttggggctcagagtcacccagaggtcaacagaggtagcctcctgttgtggcaaatccctaacatttattagcaccaccttggctgttgaggacactgaggtcctgtggggacctcagattcacagcaggaaatgcagagctggtgtccaggtctgggtccccttgctcagctcatgtctgggacgggcttctccctattgctagaaggtcacaggtcacacaggctgccagagacagacagacccggacctgaagcaggttagagcttctggatctcttcatcgcgaggcccgagcctggatcctctgcaagaccccagggagccccatctgccttctctgcctgcctctgcctgtgcccagcggctcacagctctgcccttgtcttgcagaaggacaagttctgtgtgtatgaggagtactgcagcaaccacgagaaggccctgcgcctgttggtggagctcaacaaggtccctgctgtgcgtgccttcctcctggtgagtgcccgccctgcccactctatccatctctgacctccggagcagcccacagttcctatctggggatctccccgggctatttacagaaacaggcagtggccaggttagggtcagtttccaacttctggcctgaagtaaagggaagggaaggatcaaagtggattctggggatggaactcaggtcctcaggctggtacacacccttcacctgctgagccatctcgcttgcccatctctcacttactgatacagatcttattctgtagcccacactgtgataattcccatagcctctgtggtgttggggtaacagatacgtgccataatgcttggtagagtgtaggctttattctggtcagccctgtgaccatctaaaatgtctaagaaggcatgagggtaccaccccatcctttgtcaacagtagatttgaggacttcgtgatgccagatgtctctcaggatctgtgcttgaagagagcttgtcagggcaccagtcctggactctgacctttgagtccctgcacatttggccagggaaacctcggggactccatggtccatgctgccgttttcccatgagaagagagctctggctcatggaatcgaatggttcagtggtgtagctggggaggctttagccaggctcacaggcatctaacctgcaccacagcattccccccaccctctaccctctgagccatcatctccactctgcacagcctcctgccaagcatccccaggcctttgatgccagcatcacatgggattccctcactggcactcactggcatgttcatacgcctccagggccagtgagcatcccagggcggagaattgccccgctcttatcccatttttgtctccactctgtcaagctttcgtggccagttctcccttactcctgccgtctggacctttgaactttgctctttgttcttgtgctcataaaacagtctgggcagaacacaaagacagggaggtccctctgccctggtctcagagcaacattgtccttctctagtccctgctgcctaggacccacccctggactctgcagggatcctgggggcggcgggagcaagaagaagtcagtgaaatgaagggggcactataaaggaagagtcccccacttccttctcacgcaggcacgcagcctttctggtgggctgggctgccacgctctggtggcagctgcccgggggctgtgtagacagggcggcgtgtggggtgttgtactgtaccatctgtctccctcctggctggcatctcatagcttctggccacctgcaaaagagctgtcatggatgccatgggaggtgactgtgctgggaacagacaagctggctctctgttggagatggctgttcacttgtggaaggcctcggagactttggctttcagtgtttctgtgtctgttaaatggtcgatttatgagttcacttggtggctttgtgtggagagcctgtcatcgtgagaggatcaatattgggtaggtacagtagtggacaaagcagatgtccctgtcctcatggaggctgaccaggtataccttaaagatgtattatgtagccttaagttctctgaatgagacatggtgctgaggttggcaggatcataccacccagctcatggccactcttagacattccggggcacagtccagggagtggtgctgcccaccccgggctgggtctttccacatcaattagcatagccaagacgatccccacagatgcccatgggctgtttggatctaagtctccacaggtgattctaggctgtgccaagttgacaattagaagtgtcatgagaccccaccaatggactgactggagtagtttgtcctcagatggtgggggagcaggcaggccaagcaggaatgcccttttaggtgaaagcaaggcgtgcagaggagtctggagcctggactgcaggaaggagcagtgctggaggagggagctggaggctcttcagtcaaggtgctctctaaagccatgggtctaagtgtgatctatacccagagagtgaacgtggatatcacagggctagggtcgccatggggcggcactcatctgagggtcgtgtgtcaacaggggttttgaggaattctgtctccaggcctggaagaggcaggagagcagtgaacagtctgagtgtttgcttgctctcctttcaaatgaaagagagccagccagggatgtagctcagttggtagagcgctcgcccagtgtgcgttcatccccgagttccctacctagccccacagaaactgggcatattgttgggtgcctgtaatcccaggtctcaggaggtagggacaggagaatcagaaagctcacagtgatcccttcctgactgagttcacagcttgcctggagtacatgagaccctgtcgcaaagaagaaaaggaatagcaagacaatgtgggtgtcggagcattgggaccggtggtggctgtggtcatcccgtttgaatctaaaggacttctggcaagtcctctcatcctcagctctctgttctcctttgcctggaactgacatcatccaggcagcttgtggtgaggacaaaggcccaagtgtgcgcagtgtggggtctggcatcacccagctgccgcagccaggacccctctcctgtgccaggggcagatgcagaggctaaggatgtgtgggcagctacagtcaggatccagaattgtgcctctcagagatgggagcctatgatgatgcccaaagggctgttgggcatccctccctggtcctaaggccaactctgggtgcgtagtaaccccatgggaattaggggtcagcaggcacactcgtttctgaggctgtatgcctgtatctttaaccacgccgggatcatggtaaaccataggaggaggtcctgtttctgggaggccaggctaatttctttctgcagagggggaaggctgaggtgctggtgatgctgtctctgtgtatatacgctatacttggtaccaagaccgccaacctcagacgtgaaattcatgcttcctgtatctaccagatgagttctcgtgtctgagtccctcataaagggaagacattgcctgtgacatggaataaattgccttctgtgttagcactaggtggaggagtcttgagagggactgaggagatagtaaaggaagtcaggaccagagtttgacccctgaacctgtgtgaaaagccaggcatggtggtacacacctgtaatctcagtgctggagggcagaggcaggtggatccccgaggctcattggccagccagcctcatgtaattactgagctccaggctcagccaggtgtgatggtgtgggcccttaatcctagactttaggaggcagaggcagaggcagaagcagatggatctctaagttcaaggccagcctggtccagaatagccaggggcacatagtgaaattctgactcagaaataagtagatacaacagaggacaacttgatgttgacccctggcctccatacccacaagcgggagcatgcacacctgtaactccccacgccaccgtctgtggcttactggttctgaaaaccccaaactccagtgcctgagctgtgcactgaaatagtaacagttcccagttcttggctggttggaggtcaggctctggccgttgtcacatgctggggcaggagaaggctttgtgggccgggcccaggatgagcagaggcgagggcattgctgggaggcagggctgctgctgctgctggtggtactggtactgggtagctcagtctacccagtggtactggtactgggctgggtgtatatgggggctctgctaaccactgcagagtcctggttctggactttcccagcttctaggcatccccaggccaccacataccctcattttagaagtaagattctcggttcctagcctgttgaaatctggggtgactctgcttaatgttcgttttttttttttttttcctcgtacattgggatggaggcacagttgagagttcttactggtcttctagaggaccagggcttgggactctcactgcctgtgattctagatccaggggacctgaggtttttttctggcctccgtggcatccacgtggagtatcgtcatgcagacagacgtagatacacacgaaaataaacaaacagaacagcaaaacccaaacacttgggtttctttttctcgacgcctttaaaaggtttatgaatggggttgtcctgtccataactttctgtttttctttcttgttccagtaggtttgggggtttatctgtgttgctgtatgtgaccctggttctcccatgttccctgatgtctgaggtgctgatgtatgaatctgctacaaaccaatttaagcgaaaatgctttccttctctgccgaaggttattcagggcttctcaggtttggtcagcctaaataaggttgtttgcttgctctctctgtctctctgtttctgtttctctctgtgtctctgtctctctctctctgtgagtgtgtgtgtgtgtgtgtgtgtgagagagagagagagagagagagagagagagagagagagagagatttctccgaccagaatggtgaaattgtctgtaaaatcttcattgtcaaagtctttggatctgcagttctatggtccatcttaactgctgaggcactgtgtgtggggtgactccgtgcagcaacaccggctatggcatgggtgagatcaggccccaggccccagtatgcggcaccataaaggcttctgcagagtttcagaattcctgagcactacgtcctgagagttcccacactcccgtgtcgttcttcaagtctattaatgatggtctctcatgtcctttgtagagctgcatgcttctggggggccggaagaccactgacatccctctggagggctacctgctgtccccgatccagagaatctgcaagtacccgctcctgctcaaggtgagactcccgtggacctgtcccccaggcaaaaatggcgggctctgccggcctgccactgataagagaagctgttagcttttaggatccgtggtgtctggtggcagagctggccctaggccaggcgtgcccagcttctgcctctttctctgctgttctccgggcttccacaaccaacttcatctctagcgaggcagcagatggctgtaggcatctggactcacaccctgtcaagtttaaagtcagcagaagacagtgagtttctctcttggagttctgacggacagcccgagagtcactccggctgtggccagccatctgcggctgagggaatggtgtattccaaatggtttggatttgagtcatgtggtttgacgttagccaatcatgggaaactttggcttagccctctgatcttcttccaacctccttagaccattgcttttcccttggtcattagccactgggtagtgctatgctctgattggctgagatgggacccacattctgctctagtccaatagtagtgtgcagagcaggactgtgttctgattggctgagatctgggtcaggtgctctgcccctgaacctattaccttttactcagacttgagccttaagccagttactgaaacccatatgccacagccccaaggagggacagacaggctggcaccaaaacctgggctctgctggcggggcatgggatgacttggaaagccacccatgcacctgctgtcaccttccctgctagccaccttggcctggtcttgcccgagcggtccagggcagctctgacccttgacagcttcatcctcagcttcagaaccgacaggcaggcaggtcccaggctgcgtggatggccctgtccccatctgctgcttggttctgttttcccagactttacgaatggtggctgttggctagtgccaaccctgactctgtcccgacgcctgtctgatggctggcttgtggggcttcctgccggcaggctaatctaactgactgcccatgcctcgttcttgaacctgctcgcaggggctacttctgtctttgttccatgaactgcagggagggtaaggatggtgctgagggaaatctcaaggtgaatgaccctgagcatctgagctgacagcatcctggagctgtcagcactgctggggtcatggttcttctgtgtgtgtggacaccggaggccaatcttgggtgtatgtattcttcagagccatctatctgtctttgagatagagcgccttagtgggacctggaccttagcctgcctggctgtggagctccaggagcctgccttcctgtctctgtttccccagcacagtgcttacaagcgtgtgtcaccacacctggcctttgtgtgagtgcagaggtcccagcttgcatcctgaggtcggaccctttttcttccacagcaggactgagccgtctctccagcccacgcagcgtgctgtgctaacacatgaagctgtgggagtggggctcagctctccctgtgtttcctccggccatggccgcttggacctctgagggactccccaggaagctcagctgcatcctcctgtgacttcagtgagggcccgggcagtggacagactgggctctgaagctgcaggcggatctggccatggagcctgagctgtcccttggaggtggtgccccttggtctgtcccctacccttttgttttgcattcacactagtccttagttctcagaaagacacaagttgtggggtttagagagagattggggagaccagggccagatccagcaagtagtttgctcttgtaactcatgagctgagaacttgtgcttttgcaaagctttgaaacagaggggaaaaaaaaaccctcaacctcccacccctaaggcaaaccaaagcgagcaggaggatgtgctgctgatggcaagcctggctgcccactctctggccctgtcgagcacctcgatggtcctgtgttggtgctgggcttggtagtccatggctgcccacccctcagtggtcctgccttagggctgggcttggtagtccacggctgcctgtgtgagcgagagttgcagctgtgcagtttattagtgccagctcttgagtcagtcatgccactccttatgcctcagtttctcctttgtagtgcagagcttgtaaccgtggtgcttctcagtttgttatgcagtgagggcacacccctgcagtgtagtcaggagggtgggcgaggccttagggacacagagaagggacataaatggctgtgccagagcacatgagctgctgctgctgctcagtcccattctagagtcttatccctggctctgaaatcaggggtaagaagcagcaggcccgggagctcagctgcccccatgcttgggggtgaagtttgtagggctcgtcagttccctaaacgaggcctgagaggcttcatggctcagtggtgtgtccgcttttctgggttataaaccttgatcatctgacccttgagaaagaacccttatttgcagccccagagctgagccgaactgctaaccctttggtttctgggtcctgaccaagtccggggtcacaggagcttgcaatgaagcaggtttatcgatacatatcagtaacccaggtgggaagacctgtgtggcttcagagcttggtggacctggggcctgttcctttttctctagagcctggggtttagtcccatagggctcttgccccaggaagatggaggcagctggggcaaaccgctggctgcttctgcaggaagcacccacaggaagtggtggaggtctggccttgccctcttgacagctgtgcacactgctgctctctcttctgcatgtatcgggagcttggggactgctggggaccagccagcagggcccgagattcctgtggagacatgcacactccctgacagacaactgctcagtgtcccccgccttggctcctgccactggaacatttgcatcagcaagcagcagggctgagggccctttacaccctcctgggaggcctgctttgctcacagtttccagggcattctaaaagatgaccctgcgagcgcaacagctgactccaaccccagcccgtcccctcagatggcaaatatgtacccgcagatgtcctccgttttgtgaggccccttgttcccgctgaactcccggtggtacaggctgcagggttggggagcctggggtgggagaagagtaggcaagagtgaaagccttttgggaacagcccccaaagctgaacttgaacactgcctaagaatagccggaacgttctattttggctcttcagcccgggctcaggatagacagttggcattttcaagctttattgagttttccgtcaatgtttccagggagatgattcagagttggggtgacgacgccttgatatgtagcaagctggtccctaatgggaacccagcctgacactggaccttttgattgtctgccgatggtacccgacccttgctatggctctgtcctgacctggctgctgacatagccttggatccacagctggagtaacagactccagcctgagccttctgagtctcccactgatggttctataaggatcttggtgtcatgggtcttatccctgtgtgtctggcttttgtcacttgtggcctgggtttatacttcctatcccttttcatgactgagtagtattcccctgtgagctgggctgtgccttactgttcattcattgactggtggacatttaggagcaacactgctatgatcatccacagctcttaacaccccacccccaccccggtctccctgcatgctggctctcatcttccccagaatggctcccctcctatcctaccttctgtctccattccaggaatcaacacttcatgctggtggtctctcaggccaagccttgtgttatctatgtcccccaacttgctctccctccatttcagttggtgaagaagtcctgttgacttccccatggagcctgcccagggctggctgcttgctaagcctgccctctgccttgcccgaggctgtttccagttccatcaggtttccttgctttcaccccagcctctgcctcagcccctggccctcctaccctgaaagtatccccctgtgttctcatacagtgccttcgatgggagtgtgcccagatcaccccttccagggcttcattctgcttttgccttcttttagccttgtgacttcttttagtcggctgtgtttgcttcctcagtggggatggtgcttaccatcctgattctctgcatagattgaacagttttgggggacgggggacttgcactggcacctgtgtgtgcctggattggacagtggagtcggggaggcttgtgctgacacccaagcgtgccacaggcatgccaggggaggattctctgatgctgttgtgggatttttatttcctctttgagacgcaaccgaagctctgtgcctcagtgtcctcgtgttggtagtgcgttatagttactgtaagtggctggataaagaaggagtggaaggaactctgagatccttcagtgaacacaagctatcttgattgacacaggtctgcttcaaccctgattagccacacacttagtttggtccatgtttcaccctcttacagttgagctgtctttgtctttcagcttaagaaacttcaagaagcaccagaaaggccatgcctgcagtctgacatgatagcattatcctagctcagttgcttctgttattgtgtatactgatgtgaactctgtccatctgtctgtatatgtctctctctgattctctgcctttcctggggacaggacccagagcctgctgtatcctaggtaactgtatcctaggtaacctggtcactgagctgcagctcacccccttttattttgagaaaggtcccagtaaagttgcccaggttggccttgaactctccaccctccttcttccttagcctccttagtagctgggtgctgtcctgtcctgtcttctgtccatcccctgctgctgtttctccccatctctctctaggatggtttacttggtgattttgggggtaagtcactcttgtttcctgttttcctgtttttcctgctgcagctgtccaaggagagtcccaagtatctgcagttttcccgttgtctctggagcatcatgtctctagagcctgggggtggcttccttgggggcctggccctcctctgaggattgtggagatttgaccataggctgcagacctgggccacatatacagcagtgctcccccagataagttagggcagcatggatcttgacatggctggtcctgctgaggggtagccaatctgtaccccaccagtggtcatttgtaggtgaagacccaggcctgcacaggcaaagccacagctagccacaggatggtggattgggacgatgctgggtaagatcagctgtgtctgcactgagcagagcacccccactggaactgaagagccggcaccccttgcccccgcactgctggcccaggagctgcgagtccgccacatattatgggttctgtctctgctcttcttggaggcctgggtcgctggatccccacagggtagaattgctcaagatatttgcatggagtttgcatagagcatctgtgtcaaggctttctctgctgtggtggacatcttttcaagttcttctagaagttttcacttcctgttttcttacttcatttttttctttctttggtgtatgtgtgtgtgtgtgtgtgtgttgtatgggtgtatgtgtttgcacatagtgttatgtacttgtgatgtgtgtgtgtgtgtgtgtgtgtgtgtgtgtgtgtgtatgtgtgtattcacatgcttctgtgtggaggccagaggtcagtatcaaatgtcttcatctattgatctccatatttattttgtagaccaggctggcctcaaactaggagatttgcctgcctctgcctcccgagtgctggggatacaggctcgcatcaccaggctgtctctgcttttgtcacacaagtgctgaggacccaagcttacttaggtcctcacttttgtaactgaggcacttccccagcccctccttttctttgagcaatcccctgtctcagtcactgttctgttgctgtgaacagacaccatagccaaggcaaagtataaaagaaaacatctagctgggggcgggggaggaggttgctctcagcttctgagggtcagttcattgtcatggtggaaagtgtggtggcaaacatggagaagtagctgagagcattatatcctgatccagggtagcaggtggagagagaagggtgaggggcagggaagagcctgcagtgggcttttacaacctcaaagcccatcccacactgacacatctcccccaaggccacacctcctaatccttcccaaacagttctactccctggtgacttaagcattcaaacctatgagccaagtgggggccgttctcattcaaaccggacacctttagatgctctccactgttatccgcagcatcctagagggggcaccggaccctttgggctgcgctctctgagctaagtagaggagcctggtgcaggggcctttgtgagcagagcttacatagagaggtccaatctatactcagcctcagaaagtagggttgttgctttgtttggtctagcctgtggttggcaccccttcctttctgggcccctcttttctctgcggagtatgatggcatggcctcttagccttgtgttgactttcaggcatctggaaggccagggtacaggcagtgatgggtttcattgaatctcccagtaacgaatccagcgttgtctttacactagtttgatgaccacatcccactggtgactgaaaaacctaatttatcattctatgtcgttagccacctccacacccagaaaacctaacttacactcgctttttcagaaaagagtggaaaatagccaggactcccagcagggcctgcttcagccaaaaagcaaacaaacaaaaaccaaccaaccaatcaaacaaacaaacaaacaaaaagtgttatctgggtccccccaggccagtgtctccagctcagttggcccttccctcaggtggcttccccatcagtcaccagcagcatcaggcttacatcctcaggaaaaagagggcttatccctctgagccccccaacctgagtcctggctgaagcccttgctgagtgggtcttgggctcccttcctgaggtggaggtgggaagacccaggcttccgacacgaacctacgctggaagcctgcctgtagtggcatctctgggacccatagcccaggagagggtcaggaatggtgggtttagatgtcccatctgtcttccagtcttcctcttcatgttttcccataagcccttgttgggccccatggagacctagcgagcaagcagttgtgtatcacacctgaccttttcttgttgcctggctggatctggtgtcagaagctcatgttctgagttgtactctgtggctgtactgtggcaggaccacccctactttgggggcaggatggagtcgctcagagtcatacctgagggcaccaccttggtataagtgattgcaggaggtagaggcatgaggtggcttgcagaagcccaggcctgctgccctgtttccttacttcctggaaccccaggctacctgtgaaaccacacagggtagaacgacgctgtgcaggttcacaccctggcttgtgtggtggcccgctgtcccccctcacccagggctggcctcttccaaacagttttacaagagcatacataacagaaggagacctgaaactaccatctaccatgccccacttcctgtccgtggtcttgggctagaggctctgtcgatcgtgcctcagtttcctctttgggggtggcaatgcttggctatgctggtttccgtgctggtgtgcagtcagtgctcctagctgatgctgttgtgtgatccccacctgaacagctcttgtcattactctggctgtatagagacagcaagaagtgagttaccgttaccacggaaacaatagcaaccatgataaacccggtgctcactctgtttgccgagaagttcccgttcattcacttctgcatctgttgctgggtcgccaggggatgctacctggtttcgctgtgagcacattctggctcagagaggtcagttcacctgctcgcaaagggtggatgtgggctgcctctgtctcctggcagcagggtctgggaagcaagatgcacaggagacttgaacctctcatcgatgcccctagtgatggggtgcccactgctttataaggcagacctcttcctcaaggaaaactctaaccatcataaggatgtaattaactccacccagccactatccccctcgtctgcctactagacgctctgaactccagtggggcccagtggagttttttggtcatcattctcccaaggtgcttagcaaagagcttggagttcctttcagaaatacctcttggaccctgtaagttcatacagctgtcactttgggtgtgggtcccggaattttcaggctggcagtctgtctccttggaacctggttctgttctgactttacccagagaaacctgagtttagctgcgttctgaaatgaacagggaatcccacctttcaccacgtagattgtaggtcccagggatcaaagaggggtttgggtgcggaagcagcctccattgatgggccagccctctgcatggctctcttcatcaattttatttttaaagaaattgttttattttttaaaatctcgctctgtgtgtgtgtgtgtgtgtgtgtgtgtgtgtgtgtgtgtgtgtgtgcacccgtgtgcatgtgagtatggttgccagaggggccagattcctgggagatggactcagaggtagttgagctacctcgtgtgggtgttgggaagtgaactctggttttttttggaaaagcagcaagtgttaactgcccatctggacccctcccccaccccacattatttaaaaaattttttattatattattatatatttatttatttgtgtgtgtgtgtgtatgagagagagacagacagagagagagacagagatagagacagacagacagacagagagagagacagagatagagacagacagacagacagacagacagacagacagacaccctgggtgactgtcatcaggtaccttctgtcttttattcgagacagtctctcattggtcctcaccatgtaggccaggctagctggtctaccctcttctagggagccacctgtctccacctcctcccttaccatttctgggcttataggtgcctagctttttaggtggctctggggatccaaactcaggttcttacaaggcaagcactttaccaactgagctgcccccttgaccccctagccctggatcatcttttttgctgtttggttgtgatttttgtctagtttggacatggttccgtagtctcttcttcccaccttttggacgtgtcctcggggacatggtgaggacttgacgaggtagagtgtcaggatcatgagactgctttacgtgtgtgtgtgtgtgtgtgtgtgtgtgtgtgtgcctgagaacacattgcctgacctgggtcacaagggctcccttctctgttctcctctctcagttgtatggtcttggttcttccatttggaattcagcccactaggttagctcttggtgaggaagtggcctggtttgatgctgcactctgatggatgcgcggccgaggcttccctttcccaggagtgccctgcagggttgaaagtgaacaagcctgtgcattgtggggttctctctgatgctcagttctctcccacccgactcctctccctgtaagagcctgagtggcatgcctggaggaagcagcctgtacagaggggcaggggcaggggcgactctcagttcttggaacttcatggagcggagccaacactcctctgtggcccgagacaccaaagtctgcacttcccccccgcagcttgggccacttaccagcctggcctttgtgcttagtttctgttcccaccttcattgctgacctcaggcagaaatagaggcaggggcagtcagctgggaacaggaagtgtctgagtgctgggcattgactgcctggggggacccctccaaggagtggctggacttttagctcaggctgtcaggggtaggagacagctgctgtctgtgaacaagccgctgctccataatggcctcctgggacacttatcgagctgaccaaagtgtggctggtgcctggtcgatcccttgctgtcccgagcaagctggtgtccctgagttgcaatcccagcccctcctccccagtggctttggctaccacagtttcttttgtcagacagtctgggacctgtctttcaagcccagccaggggactaagggtgatgctgaggctgggatgtgggggtgggggtgtggttggcctgtgcttatccagttagtagccagagccaccctggtacccagtgcagaagtaagggacattgaccgtgaacacaggaagtagagaagtgcttggtggcaggctggtgggtgggttgtctggttcaggaaacttctttgatgccgtcctaatgccctgaccgaggaaggcgaggacctggcacaggcattgccacctcagcatcgtcagcactgctgctggcccttaggtctcttccacatctcacttaccacacctagcgagtggttggattcttgtggttgtgatcagccgggaggtgaattggtacagcgcttgagtagcatgcaggaagccctggctcctgccttcagtgctgcataaactgatcgtggtggcacacgctttaaatcccagctcttgggatgcagaggccggccgggggatcaggagtttagggttcttcaactacatagtaagcgtgaggctagcctggtctacacaaggccttgtctctggaaaccactgtccggctttgataatgtcctggcctgtgtctgagacaagagtcagctgatggcaaccgggctggatgctttatgcactctgccctgtgtcctctgagcaagaggcctgttcgtttatttacctttcagtcctggggactgaacccagggtgagccttggacatacgcataggggagtggttaccagtgagctgtgcatgagccccagtaggcgtatccccctgtccagttcactaagagagctggggtaatcagtgtctgtggtcacctttgtgacctgcccatttctgtgttctgtgaccccctcccccagtcacctgccatcccttgtcatgccctttgagcccgctcttccggctgcccgccatgttgctccctcctcacgtccccagcctccctgattggtgcttgtatgctctctattctaacttctctaagtgtttcttcctggtggtccccaatttttcttagctttctggcctctgtcttctatgatacccaccaggcaaagtgttttttgtctgtttcctggtatattgactctccctttaaagacagtcagatggcacccacagaacgaattaatgaatgagggagggaacaaatgaatgtcttcgtttccttttctgtcaatggaatgaaacatctgacaaaatcatcataagggaggatggttttattgcagttctttcaggtccggtccatcaggaaagagaggggtgtagctggtctctgtgtctgtagtcagggagcagacaggagtggatgctggtgttcagctgccgttcttctctttgttcagtctggaagcccagcctttgggattttaccacccatgttcaaggccagcctaccctgttaaacctctctggaagcgccctcattgacactcagggatttatcttctatgtgaccccaaatctagttagttctctgggaagactgacactcgtgtgaatgagccagcaagtgttagctttgctcatcctccctttggcacactggtttgtcgtgactctacctctgcccgagtctatgcccctgcactgatcaccctctgttctgccccttcccacactaggagttggccaagaggacccccggcaagcaccctgaccacaccgcggtacagagtgccctgcaggccatgaagactgtctgctccaacatcaatgagactaagaggcagatggagaagctggaggccctggagcagctgcagtctcacattgaaggctgggaggtgcgtggtcagggtcctctgctgagggggctgggcccccagttggagctgtagatcacgggctcgctcctcagtttggcctgcctcatgtggttgcttacaagtgacttagttgactcaatgaaacataaaatcccagattttacatttcggtagaaaacttggtaacactgctgtgtctcccagtagctgtcactgagacgcctgtttccttagcctctgtcactgcaggccatgctaactcccctcagtaactgtgtgtggcctcgccttcctgacacctacaagcctttgtgcttcttgtgccagcactgagggcaacatttacatatctatcagtattagtttattttcctgtcactgtgacaaaatgccagatgaaaaccacggaaggaagaaagagtttgttgtggctggcagctgggggtgcagcccaccgtgatggagaagagcagtagcttcgcacagctggtcccagcacacccacaggaagccggcagaggcgagatagctctcttctcctttgtactcagatgatgataccacccacgtttaaggtgatcttccctcctcggtaaacacagtctagacacttcctcacagccagaagtctagaaggtgattctaggtcctgacaggttgacagaatcaagctttcacacacacagtgtatgtaactgacttttctttatcacacttacgtgtgtgtgtgtgtgtgtgtgtgtgtgtgcattcatgtgtgtgagcccagtgtgccacagcatgtatgtagaagtcagaggacaactggtaagagtcagcgcttttcttccactgggtgggacctaggcgttgaactcacatcatccggtttggcagcaagccccttcacccactgagccatctcctcagcctgtaaccaacgcactttcctgacccttgcctcctacactattggaagtttcttgtctctagaaagctgacagacaggaaatgcaaccggtaggaaaggccagctccactggagtgagaggttaggagctgagatgaaagattctggggacagacgttgctgtctgacacccccagcccaagccccgcccccaaccctaccgggacctgggtgttcctggatttaatattcctttcttgtactggcgcccccccccccatggaaggtccagctgcagagaagactggggctttgttcagagactagggggtgacatgtcccctgaactctccctcactggccatcttcccaaggggagccctctagctcccagagtcccttgcagatggactttggaaggggcattgaggtttggcctcgatcaagtggatggtgggagagataaggttcccccttgtgagacgggctgccacaggagggcctggctttctgtggctttagcagtacagccctccccctttccatccagcttcccgagcttctagcttcctccctccagcttctgttaactggtctgagtaggtagggtggtgtgttcatcaggcaaggtggctggtaaggcagccaacctggcatctggctcctttgactgtaggggccacttgtggctttacccaaagcaagtgccacatggtctgccttccaactgtgtcacaggcctctgtcctcagctccttgcagtctctagacacactctggcacatcctggttgccatggggctgagggggtgactccgaggagctcacaatgcagtatagaccaggatgtgtgaccagccaggctgggtgggtgactttgcaccaacagggctctttccttcctgtgccttggacatgtctgtcaccagcgcccttccttaacccccgatggctatcttgcatctctggaaagagataaaggagcggggagaggggctgagacctatttcaagatagtgacataccaccggctccttggtgtgacttggtcctttggaccatgcttggcgccaaagaagctggggaatgtaggtcattggtcaggcagccaatgcctgtgaaactcattccccaagatgaaccaaggggagcaaggatctgggctacctgaatgagggtttctgagtttgccaggattccactcaattccctctcctcagctctcggaatctatacgacctggcccagcctacccaggactccacacagacccactacgtgttggctctgaggactcctgctagcaggactttcctagtccctgtctgtgcttgtccttaacacttctcctggtccttggccccaatcttatcattgctgctcagcacacctgctgtattagcctgtgtgacactcatcccacagagcttggtgatggatggatccagccttcactggatcaagtgctcccagaatcctgccctaacattcctacatggcatctgtcaagtccctcctgcatcacggggaaggtcgttaggtgctagaaatctccagtccttaccgaagtgcttatcttgtggggaaggctcaacaagccagattgcaaatagatcacagggaaagacagaccgcaggacacctagacaaaacccagtcccctaaagggctggatgcagccccctagggcctgttgtcagccacgtgagttggtgtatcagctccctgtacctctgagtgtctcctgtaaaaggacatgcagtccactgatggcactggcccacacagccctccatcccattgccttggcttcttgtctgctgagagctttgagtgtggaggctgatagggatgtaggggtgtggagggaaaggtgcttgatggttagtgttgtcaggctgacagggtctagaatcaccttggagacaggtacaatgtctcctagcctccaggtatattggtgagtgattatttagtgtctgggcatgcctctaagggctgtcttagatccattgatgtggaaagatccatttgagatgtgggggtaccatcacctggctgggatcctggactgtgcagatgcagagcgagctgagcagcagggggcgtccatgactctctgcttcctgattgtgaatgtgatccaggcagctgcttcaagctcccgctctgaccatccagccgtgaaggactgtacatcgaactgtggggctgaagcaaacccttctcccttgagttacttttgccggggtgttttccctctgcagtgagggaagaggcttaagatgggtgtgtccctggctgctcattgctgcccttcattgcctccccagggctccaacctcacagacatctgcaccgagctcctccttcagggcaacctgctgaagatctctgcgggcaacatccaagagagagccttcttcctctttgacaacctgcttgtctactgcaagcggaagtctaggtgagctgctgccccctcccccccatggttaccatggtgatagaaatagacaatgctaaatgcccatttcttcaggtgtcacctcaggcttgtcagtgtccctctctgggctttgttttttcttctgagtattcatggagatactctaagtcaagttctgaaaagcagcaagggggtatttttgccgtatatgttttaatgttcagcctttgaagtggttcacatattagcatgacgcgtccgtgggtcccagtcacggtctccttgtgccccgggaacactgcatcatacagggcagctctagacggttgtggaagttcaccagcatcctgagatccgaaggtccccggggtgcagagtgggaggggagaaggctctccccactggacaggcggagaaaagaccagctgggcagcatcttcgcatctctccctgagccgcttgccctctgtggggaccaggagtgagggacaggtggcaggcacgcttgtgtgtggttggaaagtgtcaagtggggcgtgggccggtgggaagggggatggagagatcgctagaggcttggatggtgaatggatagtgggtatggaagggagagagaagaatgtgacgatgtggacatggaggaggagggaggaagcgggtgatgaggaatcgttgagcctggggatgaaggagtggagtgggggggggggatgattgaataaaggagggatggagggggaggtgagggagtgggtgagtgaccttttgagcctggtgatgtgtgagtgaaggtgggagggatagacaagggaggtgggaaagggtgaagcaatgatggggagtttgttgagcctcggatgcggggagtagacgagggtgtcgagaggctggagatggaaagggaatgagaagagagggggggtgcagggatggttagaggttaggaggtggtcagctagagttgactagaggcgtgggttggtgggttgggggcaagtatggctgttgagagaaagacaggctatggaggcgaccgtaggcttgtttggtagatgatggagtgggggcctgagtatcaggtgtgttggtggctgggcagatggctgggtgggtctgctaatagggagggtatgggaaggtcaaggcttggtggatagtggtcagctgggcagcattgggttggtggctgccaaggtcattggctggttctccagatgcaccatggatggggagaggggtaatgggcagagggcggctgttctgagagtgaaatagtaacctcccagaggctcctccatgccttgatctggccaaggctgtgcacgcacagcatcgtggccttcaggactgttgtcgtagagcctcacgttcactttccttgtctgttcccggctctaaggctgtgtgagaaagcaggctgcaagggatgggtggccattccacacgttctgcgcaggctcagtttccccttctgcaaccagagccacatcagtcctctgtgtttggttcagaatttggccacttctcaagctccatagctcctcctgcccgtgcctcagtttccttgcttgtcaaacaggagacgctactgactgtacctcccagggtcattgtgaaggtgagggtagtaagtgcctggtgtgtgaagttggggctggctgctggggccatggcactcctgggttcttggtgcttcctgtgggcagccctggggcacagagcccctcctactgtctctcctctctgttctgggggttgatccttcttgccacaggcctcagtctcccttcaggtcatctcccagtgtagacatgttcagtctgcctcttttccagatgttctcttgcttgctctgtacacatccccattgctgtcttgtgtgttctgtcctgctggggccacccctagaggcctcctctgacaatcctaagagtgcttatgaaatgttactccctagcccttccccgccctggctgctagaggcagacacttttcccagagcttatgagggtttgggaaacagaatgtccctttacaactctgtggacagctcccagctgccagctaagcatgcccagcccctggcttccttgccaggcccctctttctctgtgtcacctgccctgggaggaataacagtatcttccaccatcttggcttctgtggggactgtctctagccttcctgtggccaggctatactctctgaaggccactccctcctgagtgacacagggagctgtcctgagggaaaggacacactagtctcctgagagggccaggcatgaggccagagtcctgcctctggcttagcagccagaaggctgagtgccctgtgggcagggtcagctgctggtggatggtgcctgactgactggagtggccacaggaagtacctgatgtggctaggcagctgctggctctcctggtccctgtctgggatgtgggtggagcagtctccatgaacagtagcacagcgtattcttgttgatttaagaggccaaggcctccctttggccaccaaaggaggaaaggggtgttctaaaagtcaatcttctcagttacagtaggggaaactgaggcctggaagagctaagtctcctaccctgttgctgcccgctatgttctgagaggccagagttagcaccgggccctcctgctgctgtgtgactctgggcggatgctgtttttgtatctgtaatgtgggggctgaagcactgctgtcctggagggcgcgctttacagagtgaacaagacatgttgggcgccactgtgaagtggctggggtggtgaaggctcatgagtgaggctgagaccaccattcctgttccatttcttttttttttttttaaagatttatttatttattatatgtaagtacactgtagctgtcttcagacactccagaagagggagtcagatcttgttacggatggttgtgagccaccatgtggatgctgggatttgaactccagaccttcggaagagcagtcgggtgctcttacccactgagccatctcaccagccctcctgttccattttccttggatgttttgcatgcagctcacatgcatctgagctcgtcctatcttctggtccacacttctgtcccagacttttatctcctcagttgcagtgagtttgtctcaggtagagaagagcggtctggccacagccctagccagccatgggtaaagaacacccacccattggatcaaggaggcacagagggcccttgctctgactggtgtctctttctgtgctctatgctgcctctaccaacagaagacaagttagttgcccaagactttctgtgtttccctgcggaccagcactgagcagggtgcctggcacctgccagtcacttatgggctctgaatatgtggcccctcacttgttaccctgtccataggaagccatggccagatgttttttgtttgatattttaatttgtttgggtgaccgtaacaaaattacattaactgggcatcttaaaggacacatttcttcaagttctgcaacgtgagaagctaagggtataagactccagaccagtgcccagcaaggctttcccttgtgtcctggcatggtggaaggggttgaggtctttttataaaagacactaatcccattcatgagatgccaccaacctctactgtctattcacctttcctctcaaggctgtatacctcctaactcttaacatcacagtttagaaatcggcagatagatgtgaagggtaccacgttcaggctgtaacagaatgagtgggcaacagggttcccccaagtgaaagcgtgagtaggggtaggtgggcgacagataggtgaatggatggataacatagatgggtagatagatgaatggggggttagtatatggataggtggttaatgaaatgggaaggtagatgaatgtgtttgtgggtggatgggtagaggaatggtgtttggatgggtgggtaggttatagatagtatcaggagatggttggagatggtgggtgggtgggtgagtcgtcaatggatgatggattaaggataaatggtgtgtgtgtgtgtgtgtgtgtgtgtgtgcgcgagagagcatgtgtgtgtatgagtgtgtgtgtgtgtgctctcatgtgtgatggttatatggatggtggatatatggatggtaagtagatggtatgtggatggatggtaagtggattaatggatgtaggtagatggatagatgaatagatgagtgggtggatggacgattgccttctcctattctggtttcagtttgtgaggtaccatctgttggaaatcagtctccacccacccccagcccccccacttgcctgcttgccagcccagcagactgggtttctgttcttcctgttggtcttccacgagatccccatttactgaaaaattgatctgtgaggtcaacagagctattagcctatttccagatgagaaacgatgaccagcagagactcacccaagtcgcctgcccagcagcagacaccccatgtgcttcaccctaacccagagctcccctctgccccgggcactccccactgtgacgctgtcctttgtaggggagactgacttactgttgcctttcagggtcactgggagcaagaaatctaccaaaaggaccaagtccatcaacggctccctgtacatctttaggggtcggatcaacactgaggtcatggaagtggagaatgtggaggatgggacaggtgggccctgcccctctccactaagcccctccctgcctgccctggtgctctctgtcatgcgtgtctcatgtattgttgaatgtaactaaactgaagaagagcattggaacttagcaaagtacagtcctggggctgagaactcagcatcctggccctaccgccccacaagtgacaactgtgtacattgattcccctcccccccattttattcttcttttatgtggatggatgttttgcctgcctttatgtctatgtgcaccatgtgtgcagtgcccatggaggccagaggagggcattggatcccctggaactggagttatagatggttgtgagctgccatgtgggagctgggaattgaaacccagtcctttggaagggcagtcagtgcttttaactgctgagcctcctctctagccctatactgtctgtgctttgtaatgcggtcccttttttttttttttttttttgtcctgcttaaaaatattttttaccacgtttggtatggtggtgcacacctttaatccccagcacttgaggcagaggcagcttggtttctgtgagtttgagaccagtctggtttatatagtgagttccaggccagctagggccatatacagtgtgacactgactaaaaataagccattacatccttagcttcccttaccagatatttttctttaaatgtcttggtttttaaacttatgtgtattaaagtggctttagaggcatatggcggtatgtatatgcttttgtatacatgtagttatatggtcttacgtgttatacctggctctcaggctcagggtactggctctgggatgcatccatgtctcacgtagtcgtgagtagatcctgtttcctgtaactggatcgcatgcagggcatgaactatccacaggcaagcaccaagcatagggtagtttccgccattcactactgggaccagagaagcgacatctcagcagatgttctgtgagcctgtctgggaaaggttctcatgtggctttaggccatgacacacctgtaggcccctccttaggttcagggtctggcaggatcccatattcctaggaactgtgtgacatcatgcttttagtgagggcttctttcctgagctctgggcatgaatctcccacctctatgctcaggacacctgtatcactatgctgtcagaaggggtctgtgcaggtcttctttgcctatgagagagaagccaggggggagcacttgttgggggaaaggcaggagagagcacttgtctagctccctaagcctggccctcgtggtggccatcaatccgtgggttactgagcgttgcatacctgtctgtgtactgatccgtgtttgcctcatgcccctaccagccgattaccacagcaatggctacactgtcaccaatggctggaagatccacaacaccgccaaaaacaagtggttcgtgtgtatggccaagacggcggaggagaaacagaagtggctggatgccctgatccgagagcgggagcagcgagagagtgggtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaccccacagtcactcctggtttgacacagaacagactgggtctcagactcccccctagtatatcctgctgacctgaaatcccagctggtctatgcatcacagacctcacatggttccatcaccctctgagcctgtgtctcaggctctccaccagccagtgctgaagcacatcccttggtgccacccctgaacccctcattgccgctctctgttcaggaggtcatcatggtcctgcaggcctgccctttaacacggtccaggccaaccgcctgtctccctgccccatacttcccaagtcactgttccaaacatagtgcctctgctggttttctggagaaagtggggcctttaggtagtagcacttaaatatgagccagaatgtattaaaatgctggaaggccagataggctcctggctttggcctttggatgggtaagggctgaacctctgaaacttctcaggcctggggcggggttggtcctggggtaggggcagggagttggcctgactgggtggggctgagctgtacttttgtggttagaatcttgagctgtggttagcacagggtctatgtcattaagaggtgtgtgtggtccaaggaggccgtgtccttagaagtgagtgctgtctaaagttcaaccagggcagggcacacagggctgggctcacgctgtggtctgtggtcagagtttcaggttggaatccggagcaaaacatcttgggtcaaaatttcggtaccacgtcttctatgcagacagcatgtgttccctgggccccagcttcttgtttgtaaaatgggagtgattgtgtctcttttctcaggagcatgggacgtgtgtccggagctgggaagcacttaattgctgttgctgttgttgtctagatggggtagggaccagtgcatatggcatggggggcagagctgtgtgtgtgcactgtgggtagagctaggcttcggagcttagttctgaattaaggtaccaccagttacctgggacttaacctccatgggtcctcacccagactttctgagcagtccctgacaggtgtgtgtggcgttgagcaggggtcaggaagtgctccgtggctatgcaggggtcaaggcaggggggcgtgaatgccagaacccctgactacctcctgtgtcccccatggcaatcatatccccacgcaggcctgaagctgggcatggagcgtgacgcgtacgtcatgattgcggagaagggggagaagctgtatcacatgatgatgagcaagaaggtgaacttgatcaaggaccgccggcggaagctgagcaccgtccccaagtgcttccttggcaagtgagtggcttctgtgtcctgatcccagctggccaccttcccttcctgccctgcatctgctttgccccaccctgtcccacaccccgtttctcttgcctgggacctccttatacagccacctaatgcccctcaggcctgtggagcaggcttggatgagggtcgaggctgcagggttctgctacaggtctgtccactgcgtttgctcttgactcgctgtgtgatccaattcctgtaacaaagtacactgtagaagctgagagtgtcccgactcagtgggccggccacactctacccatttctgttctgttctgccttggccaagacagaggttgctggggctatgtttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgggaataatgttgattgttctgggcaggaaaaggtgagattgaagacccatgtgtgtggcaggtcaggagactgccctgcggggcactgtgtacacagaagagtctgagccagtagtgttggggaagggacaagctgaggcctctgtggccagtggccagggaggtgggtgtccctgggtagggcataattcccagaaacgagatgacatgatagagccagtggagggtggaagccggaatgttggggacttgggtctagatgtgtgaaaacggaaggccctactgggtgtccatgccacccattggagcttttggagtgaggagataacccagggtagatcttgagacctggcattaaacaagccagggctggctgttgggggaaccagcatgtttgaactctttcatccattgtccttgggggccgacagtcttggctcagcctctctctggaaaggagagagctgggcccaggagccttgtgggagctagctggagaagttgggaaggcccctggatgtttccactgttaatccccattccaccgaaggagctgtttctctagcagcagccccgccccgattctgcccagggggatatctgagagccttcctgccggccctgccggccggatgggataacctgtctgtgattaagacttctgaggtctgactcctcaggaaggattagaggagatttctcttgctgcccatttgaaccccagccagcagcacagctcatgtaacctccaggcccagagaaactgacttcccattaagaggacgctccttcaggcttggctttcctctgcctctgcctgggcttccaaccaacaccccttcccagccattgtgcaactccgggagcccctggccccccataaggagaataaataggtggctgcaatacagactcctccagcccttaatctgatctatgacgttcacatttggccgtggctattaatctcacacagcactatgaagcaggtcactgctgttgtccccattttaagggtgaaggcagtggcacagagaggggaaagcagagtcacactgctgtagtgaggtgggattcgaactctggacagggtgactccgtagctgccgttctctctcaccacctcaatcttgattcattttaatctctcttcagcatctttagttttcctcagtcattgctttctcctcctctgtaagggactggatggcgactccctggctatggactgtctggcttatcttcatagccttttaaggccgggttttgagtcagactgggactgcgtcttactccccttaccttcttattggatgactttgggcactggtttaatgtctctgggtctcaatgaatgataattaaggaaggagaaaggctggaggatgcagtggggatgcagtggaaacacagtggggacacagtgggagcacagaggggatgcagtggcaacacaatggggttgcagtggcaacacaatggggttgcagtgggaacacagtggggatgcagtgggaacacagtggggatacagtggggatgctgtggaaacacagtggggatgctgtggaaacagtggggatgcagtggggatgcaatggcaatagtaccatgctggccagagcactgagaacatgggctggggcctccatgcacgacatcatgttacatggacaggtgtgaagaagtgacctgtttgtgtcccactcagaaacgaatagacttcacatttcagtggtaaaatctgtgtactgtgggataacatactactgtgtgtgtgtgtatgtgtgtgtgtgtgtgtgtgtgtgtgtgtgtgtgtgtgtgtgtgtatacctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctcccattgccagccagcagcagggaactgaacagacagacttcctgcccacagggagatggctgttcctacaggaatcactcggtggacaagtacacaggccaataaaggaacccactgggccagggaaccccacaaggcagttgtgcagtgatgtaaaggggggagctgcagagctgactcagccagggtgggaaaggtggcctcgtactggagatcacatttcaaccaagacctgagtgacaagcgagtgtcagccacaagaagaccagaggagcagcacgcctgggcgtggcagagtctggtggctttcgtgagctgtgatgctggggtggcaggagctgagttggcgactgttggcccgaggctcgggagtcagcagggctgcatctcgtggcactgggtcaggggtcaggctttagtccaggtgttcagggaggctcagtagggggcaaagatgaattgtgagaccccagggccactcgggatggtttcctgaggcagaggcatttgttgcctcccttgatagtgacggcgtgtcttgttgttaaacatccacacactgggggctctgaggtagaaggctgtgtgcatagctgcatgcaacagagatcaaactgggtgtagcggcacacgcctgcactctcggcagtcatgaagttgaggtatgagagtcacacggcctgacagacatgaccagggacattggcagggactttgtgcatgggactccaggtggcatctcaaccccaggctccaggcaggaagcaagtgggaagatgtccctttggggagtggtacatggagcctctgatcaggtgtcgctcatgaaaggatgtgcccacatgccctctgtgctcaaccttggccttgacctgaaacgggctgagtggtgtccattcggcagggccgaaggagaagggaagttggcacagcctgtcagaggactctgccatttgattccaccccaccttggcctccaaacctcagtgcctcccactgctgtggggacatctatctggaagcctgggccttgttgtttatagcctcacccagagctactgtcagatcccagctccctactgccacctgtcactcagagcttctgtgcacgctgatgtccagcttggggcactctctgctggcccagtacacgtggaagcctggggccagcattgaacaactgggagctccataggaaatatcagatttcctgctcgctctcttgaagagctggacccacggggttgtggtgggctctttgagcagtggctttagctttgactggcttggcacagactctacctggccagtatcccctgttcagagtttgaggttcctgcgtaagaagagattaactttatctggtttccctcctgggttccagcttaaagtttcacaggattaaaaagtccacccacgaattccagatgtccccaaggaaaccatttgccagctgcatcctgttgagcagcatccagctgcatcttggtccctagatagggacagctttgcattagttggcccaacaagctgaagacccagcttggtttcccaaagggtagcaagtgtaggcatagtcgccactcagttgctctcctgagtctgttttctgccccctgcagtcactttggtatacttcttgttccccactgtggccctggataggacagctggtgagcagccttgctctggctctctgacctccagcctctgcgagtggtcacaccaacatctgtttgccttctggggttgctggcagtcagtgcctgtcccaagagttgggacttggagaacagtggagtagggggtggttagagggacacagaacttggaaagttcccacccagcgtaccagaaatgtacctgtttctttcccacatccttgggctttctgaatgcctcgtaatgccgctacctctataaggccaggtccttcctctgccagcacgaaaagctaaaaatagcgtcccctgttgtaaccggaggtgggacagctggtttccataaagggggctgggcactgctgcccacgcttgtgggtgctgcctgctctgggatcaccctcttgcgttggctccagtgggctgaaatctgtgccgagcccaagagtccacaggggctgggacctcagaggcctcgagccagaacctgtctcacctgtgtccccaaccttcctcgttcgttcctcatttgttgtgtggaggacacttgagtctcaaagcgtgtcaagaaaaggtcaatgaacaaggtcagcagctatcagcgagggctcacacgccgtgtgtcagtgtgctcagggaggggtctgataaacacacatacatctgtaaacccattgctgcagagtgcatagtcaggtgggcaggctctgtgtggagtcttccctggcggtcgtgtgggttgttgccccttgggagcggtggcacggagggagtttggaaagggcatttttaggtgaatggagcagcaacttcaaggcccagaggtatgttggggcctagggttgttttttttgttttttgtttttttaaaagaagggaagaaaggtaagtgagccaaagcccagaggatggggagggggatgcaggagagaagactgatctaggaattatgctctaggcgtggcgttggtggcgatgctgatgttgatgcacatatttctgggcagatgtgtgagacagttgaggcagaggtgttgaactcctttctgagtaaggcaaaagcctattggaggatggagaaggtgtgatgggagcactgtgaggacagagagggtgtgatgggagctctgtgaggacagagagggtgtgatgggagcactgtgaggacagagagggtgtgatgggagcactgtgaggacagagagggtgtgatgggagctctgtgaggacagagagggtgtgatgggagcactgtgaggacagagagggtgtgatgggagcactgtgaggacagagagagtgtgatgggagcactgtgaggacagagagggtgtgattggagctctgtgaggacggacagacaaggtgtgatggaccagtctgagaattgacaggatgtgatttgagacatctgggcctgagctttctgggcctggtatggcctcctccttattttgtgagtttcatttatactccgtacatagctacatgcatgcacacagacagacgcatttagtatccataccatctagctacctcaccccaactacccttggtgttcatccaccgtccaccatctacccagcatccctcctcagcctccacatctgcccatctatccagtgttgatttctctgatggcttatgcatctgtctgttcttatgtacctatgtaccatgtggcccagtgtgtatccattggcttatgcctccgtccatagatcccacatggacgcgactccccactcagttatttcccacacccatctaccatcttttctctgtctatccatcattcatctcctacctactcatccatctacctactcgttatccatctgtctatccatccgttcatccacccatcatctgtttgtccatccatctgtccattcaccatctatcatccatatatcatccatccatccatccgtctgtccgtccatcaacccatcatccatctatccatccattcatcatccatccatcatctatccatgcaccgactaataagctacaccattcatccttctacccacccatctgtccatccatccaccattcattcatctaccaaccatcaaccattttttcactcttctatctatacatctacctacctacctactaacccatatctagccacctgtctatgtatctgtcaatcgttcatccacacacctattcctctacctaccaaacatccgccacccatctagtcatgtacccatctgcctatccatccctcacccatccatctgttcatctgcctaccatctgtccatccatccacccacccttccctgggtggatgaggctggcctggaattgttctagccaactgaaaaagcacagacaagccttatcatggtttcttgggctacggctgctggctttatgtgctatgggaagaaagacctgcctgccattcctggggtgggtgggaccaggccagctgggttttggttccggggttggggaaccatctccctgcatcttctgtttctggcagtgagtttgttgcctggctcctggaaattggtgagatcagcaagacggaagaaggcgtcaacttgggccaagccctgctggagaatggtatcatccaccatggtgagtggcagtgggtatggcgaggtaggctggatgtcagggaagctgcccttcccccagaaagctgctcctgcacttccaagctgctggcctggtccctgtcccgcagactcagaaccatggctgcctcatgacacgttctcttgggtaccagcaagcgaggactcctcaggaaagcaggtggtcagagagtggaactttccattttccccttcaggaagagctaatttgaggttgtttatcatgtttcttgcagtaaggcactgcttgcacagtcgtgagtggggcaggtgaagagtcctgtcctacggaattgactgagcttggaggggagatgaagatgatagggggtgctggtacggcaggctcagtgctggcgagaggaggcgtggcagtccgtgtcatagggggtcaggtctgaacagaggtttgggaggtctcccctggaagtggaggatagcatagcaggtaggcgctatggctctgggcagggacagccaaggcccagtgtccagggggatgctgagtgccttctagggagcaccagggaaggctacctcttgagtggacccggggcttgtcaggaagtgaggtcgaagtcttggagcttgggaagggattcggctgtggagtctgtgtaggcgcactgagccagccaggagccactgagtgttcagggaagagtccttgtttttaagagttttagacatttggctgtatagagtctgctttggggtctaagtttccagcagcattgagaggtagctgtcaagatgccagcagtgcggttcttaccccagagtgcttactttcccttctttccaaggacaggccgagtcagaggtgcccacagatgtctagctaggccgccagtgtccgccaggcctgtacaagccgtgggcctcacatcccttgctgttctgggggaccaaagggtagagacggagggtgggtttccccagccttaccagtccctgggtccttgcagtctctgacaagcaccagttcaagaacgagcaggtgatgtaccgcttccgctacgacgacggcacttacaaagcgcgcagcgagctggaggatatcatgtccaaggtaggacgtcttctttcagcctgtggccccgatccagctggaggtccctgcagaacaggcctatgtccctgcagcctgccccgcccaccctcctcttcccagcagtccagagggtgtggctcattcagaccctgctcttgcttgtagggcgtgagactctactgccggctgcacagcctgtacgcccctgtgatcaagtaagtccccatggccttcccacccgacagtagcagaccgccctctccccaccccctatcctgacctctctgagcctccgtccccttttccatcagatatggttaataactgacctcttccatcagactgtcaggaggaagtgagtgaatctgtgggaagtcctgaatgcgtatgaagggacaggagagccaggctgaggagtggatctgcctgctggtgtccagctgtgtaaccttgcactcagcctttctgttcctcaccagttctttctgaggcagattataaagtaggatgcaccacaggacctttgcacctgctgctgctgtggaatgttttcctccacaccagctcccacttcctccttccttattttatctgggatgggacaagcttctgccaccaagttccatcttgccctgacaccttcctaacacccagaagctctcagcgcttccagtcagggccgtatgttcttgtgctctgtgtctgtattgtccccctgcagaaactacctgacctaaggttttcagatgctccaagttacagagtctgcttttaacaaatctttttattttgatttcattggctgtttgaatctgaattcaaatggctttaacgcaggaccttgggagcaacactgaacccagtttttgttgagtgagtggttctcttccagccaaatgggtctagcagcagcttgtacctcctggtgcgctgagggttaaagtcacggaaagtatgctcacaggcttctggaggcaacaaatgagtggctcagtgtctgttaggaaccttgtggttgtgggtggagggacagggacaaagtaatgtgacttgttctggggacttcatccagtttgtttgtggtctgtgaagtcaggccctgggaacccttcacccagagccctgcctcctcagtcaccctcatttgctgctctgtgccagttctaggaggtagtgacaaagggcccagcctcctcctgggcccctctggcccctgcctgtgtccagcttcctcctgggcccctttggcctctacctgtgcctagcttcttcctgggcccctctggcctctgcctgcacccagccacctcctgggtccctatggcctctgcctgtttcctagtggccttccctgggccttccagcttgctggtatgactttttccttttttaggtggtggcagggatatgcctagggtccttgcttaggtgagaccagttctcacaactgaccacgcccaatcctgaccatccctcagcggctccacccagggctgtagaactcagtttggctgttcaggtcccatacccctttggccagcatggtggagcgcatacctccctggggggaccctccccgcccccccgcaccttccagccttagactttgccctgtgctcagggcctagcctgcagttcagctctgtgtctttgaaatgtgtgtgtcagcaccaaaagaaggcagaatggtgggagccatgatcacccctccttagagactcagggctccttcgctgtggactgtggacgcctggctgggagaggtccttgctgtggggacatgtggttctgtgggatgcccacggtccccagtgtggcactccacccaaggacaaacctctacatgcaggcaaagctgcacagagaagtcccctgggcaagagagtgtctgcagcctgaggcttccctgtctgctgctggcggggcagctgacccctaagtggggagtggattagcctctttcccatgtccgtggcggtgcttccagctagaacaggctccagaaaccgccatgctccccaccccttccagtgctgctcactgctcacctcttccccagggaccgtgattaccacctgaagacctacaagtccgtggtccccgggagcaagctggtagactggctactggcacaggtgagcacgcgtagcccagactctagctggggacagcagcatagctggggaccgacccagctcctttctgctctctgtgtctacagcgtgaccacacagggagccccgcagagagggcacgtgcggtagctgcccctgtgcagcagctttctgtcacgtcgtcgtgtggcatccttgggtgttcctggtgctcaggttcataccgagccttctccctttctgccgttctgctgtgtcatcttctgattggttgcttcacagtcacgcagtggcagccgcagctccgggcattgcacttgcatgtaaccacagtaaaaggcaaggagagccgagccttttcatttcgtgtaatgtcaagggaggggatgcctcatggtctctcctggccaagtggttttctcggtagatgtcatctgttgggtgagccccacgccagtgcttaagccagtctgtctggaagagaccaggcgtgttgagagggacactgagtgagtgtctcaggatccacccctgggtgcttggagtcaggcatacatgcctgggtgatgagttgagactccaaaggtcaggtgtatctaggcttagaggaaccaaccagccttaccgttgtgagatctcagatcatggcgtgttgtcttatatgacctttgggacaagctggggtagcgtggtggccatcccagtgttacagatggaaacctgaggcttaggtcatgtgacttgttcagagtgcagggccaggtagggagtgctgggtgagagtgcaccgccttgataataacccagctgtgtgggatgatgatgaacagagatgacacgtgcactggccttcctccttgctgccccctggaccccagggccagcaccagcaactggggcagagaagatggacagttggagtccatccaaccccgagaaccctttgcaacagctaccagggcccagcagatggtgctgctgagagcctgggcacatgagtcactgggggaggcccaaatgaaccacgcagggaggggctgcgtacaaatacattgtgtcagaaccacagcctggggccagtgactgactccccccttggaatctcggttttcctgtctgtgacgtggtggctggaaaaggctagcttagaaagcctcctggtcatcgggaagcctgagtcagccctcctgcccgtgcctcagtttcccctgccgacaaggagtcagacagtgaaggcatggagcacggtaggcatggtgggcagagggatcccatgttgtgtgtggccttcggtcactcacgctctccccgtgtgctcccattggtccctcaggaagtcaggaagcaagatggtgacagttttcctatgctcctttgtgtgtgtggggggggtgcgcacacttccctcccagggacttgtgagggacaccatgactttttgaatgagaaacagaagcagctagagaggagttagagagcactatccacactgctccctccacccaccgacttgtcctcccctggggcactcaggtctgtcaccgtgacctgggcttgccttgtgtcctcaggagcctccttggcctctgcctctggggatagaagagacaggctagtccggttctgagctctttgcaaaccgagtagactccagaggctggctggtcttctaagaccaatcatcagccaaggccacttgggctggctgtcactacctcccagctctgcggttagaggcagctgctctgtatgtggagtgttctgccctgttgcctcttctgtcccagctccaatattgccattcccctgcctctggcctagggtcccttaggagttgtttgttttccttgtgaccattacccagtaatgctttcagcactgaggaccccttagcccctctctgaagtcctcagcccaacccacagcccctgctaagagtccctacacctggtcctcacagccactggaaaagcaatcatgtctgtttggctaggagtaccctcctccaccctccagaaagggggccaggtctggctggctaggtgtctggcagccttttcccttctggactgtcacagttgtgtgcagggctggctgcctgtgcatctggaagcccaggagcctggcccgaactgttgtgaggtgcccctgatcacagccctcgattcagtcagcagctgggactgagtctgccagcccggcttccactctgaggtcctagcctctttctatctgactagcagggagattttggggttccaggatggttgtggtggcatacacctgtcttccaagtgggctgggtcggggggtggggatttcaaaggtaaagcttgtctgagctgcaggtgacttgggttgcaagcaacacaaacaggctgctctggcaggggaggaggcaggagccctgcagccaggccactaagagagcagacatcagaagtcagctctgggccccatccctcgtgatcagcccggttcctagttctgctggcatgtcatcaagacagaaagacctaagtgaaagatgactggaccagaggccacatgtccagacctgtggaaccagggtgggcttcgggacagttagttggtggcctgtcaggccatcatcagcctcactgtcacctcctcacgtggcttcgtctctggtggaagggacagtggtatccccttcttgaggtttgcaaaaggccctgcaggcttctcaagcactgtagatttcatttctaacatcaggggacatggtctacagacgtacagagccagagaattttgggctttgtgtctctcgtgagagcagcacatggttggtggcccagaacaaccagggccgcctcatgaggtctttgaggatccccctctctgtttttctattctgccaccattacagtgttttaccctgaggtcacattgtgattgcagaagcaccaggcatcacatcttagttccaggcagggagtcaggaagaagaggacagcctgtgagcacaggaggtttgccacaacacccttattcctagagggttttgttgcatctcattgtccaccttaactgccagggtggtcgtgaaatggggggagtttcagggatcaagaaagggctgttgctaggagtttatcaggaatggttcctaacatttctggggaccttggtccttagtatgacaaatctctgccctcatgcaacttgtgtttcccgatagtagcccatcttaaacgattcagtgctggctcccctcagagcagcctcttctgttccatttcagggggactgccagacacgggaggaggccgtggcgcttggtgtgggcctgtgcaacaatggttttatgcaccatggtaagtgcggggcctccagctttgcttagggccccgagagccaagagccagctttgcatacccggtgtctcagcattgaaggcgaatgctttggtctcccctgctcccaggtggcctggtgtcctcctatgccccactcccattacctttcttggttcctctctcagagaaactgagttctccctttgagtctctgactcctccctgtgggtgaccactgtgcagccaccatggtgccatattgtagtacagagtggtaaacgcagcggggggcttggggctcgggatctggcatatgtgcatgtgtggatcccccttgtatatcagacagacacaacccatcttgtgtatgctgataagctggtactgtggtccaaatgctgaggcttggatacaggtacagactgcagaagtgtgagctttgttctaacttagatttagtgaacttgctctgcaaagggccaagcagctgccacaacactggaacaaaatgggtgtggctaggtgccaataaaactttatttaggaaaactggccgggggccatagcattctgaaggcaatttgcctgtctgtgtccatggctgagctctctgctccctgtaggctttagctcccctgtggcttcaatttctctgttttctccagagatcttgctgcctggtcccctctactgctcatttccttagctgaagggaccaggcttggccacccatgggcctgtctccttctcagaagccgcctgcaccctccagtagccctggccctgccacccgtcctctgcaggagcctctcatttgtgggtgagggtaattgtggtccactcagccttgttcccggaaggcagctatctggggagactacacaaggaggggtacttgggcagcctgatgccctcagggcccttgaggggggaaattgcaggctgtacatccccccatcaccaccacaaactcaaatatctgctaaaataggaaaggaccaaacattggggagtggctgtggcaaagggcagtgtcagcacagagtggaggaggggacagcaccttctgccacgtctgggtcccgagtgtcttctgggagggacttagcagacagggaaacagaggaagcttgccactgcagccctggaaccatctttttgtcttctcctagaagggaaaaccagagtgcaaagggttaaagtatcagctggaggggtttgaacttcagtctgtgtgcacctctcaaagctgagctagcagccttggctggaagggggaggtggggcctcacctggctggccagtgactggagagtgtccctctgtgtctccttggacatcattgctcagagacagcacggtgactcttcctccagctctggagcctcctaaccccatgtttacagcagaggctaaattagcgggatgctcggagcctggcacgccctgctctgagggaagtagcaatttgcgtgcctgtttgttccagagcgggagaggggttgcccagttacacactcacacacaggtagttcccctgcaggaggaagaatggccccccatgagcatagtggggtctggaggaatctggactggctctcttcttgcacgcaggccctcacaggctctttgctttgatggaccttctctctttccttccttcctttgctttttctttcttggtttttctgtttctgtttctgtttttttgtttttgtttttttgtttttttttttggagagacagggtttctttgtgtaaccctggcagtcctggaactcactctgtagaccaggctggcctcaaactcagaaatccacctgcctctgcctcccaagtgctgggattaaaggcgtgtgccaccacgcccagcttcttttttgtttttaaagatttcttgttgtgcgtgcgcgtgtgcgtgtgcgtgtaacatgtggctggactcacccttcatgtggaggccagagggggacactgggtaccttcctcagccactttccactgtggtttttgagacaggatctctatctgaacccagagccctcccaactgggtcaatcgctggccagcaagctctgaagatgtgctggtctctgtctccccagcgctggggttagaggcatgtgcttcacagggcatttatatcggcactgtggatccaaacgcaggccttactgcttgtatggcaggcactgaacccaccaagccatgtcaggtttttaaaggagtcagagagccaaggccgttgtgtggagttcacacatgttaacactggcttgcaattctgctcccttacaatactctctcgaccaagccacgcttgtccgggagctgcttctagcctgtggctgccggttggccaaggcagccgaaccgctgccatctgaccacgactgtgtgtctgcgccttgcagttctggagaagagcgagttcaaggatgagtcccagtacttccgcttccatgctgatgaggagatggaggggaccagcagcaagaacaaacagcttcgcaatgacttcaagctggtggagaacatcctggcaaagcgactgctggtaggaggctcacagtagggctgctctgcctctcttccctgcctctcctgtggcctgggagctgggcagcttcagacagtggccagagcagggcatgcagctctgagcatgagtcttgggacagaaaagccaagtcactgtgctagccaggactatattcctcatgaaacgctggggctgcaggagttcctaccctttcatctagcccacagccattgcttcactgtgcctcctgagtcacctcctccagcactatagatagctctcaggagtttgtgtcctgctcgcatccaggagccttgagtgtctgcagttgggacatttactaaccaggtcagcaaggttggcatcccagcccacctagcctgacttcttaggctgggcttgtggcgagttgtccggaagaggtctgtccatagccactctaacctctctggtctgtggtaatcctggggacggcagttccctctggtgctctaaagccctccaagtgtaacccaccacacctggataagagtcagcgtctgtcctgagctcttcctgcctctccagctttgtcccctgggtaacgctttcctcactgtctgagccaggctagtctctctccctggggctgcctctgggccttcccaccccctgtacctgctgcctagagctctttgcccacccgctctcttcttttactttagcctgagtacattcccagtcacactgtagactgtttccttcagtcagcagtaaaagtggggcagctcaggggccttgtagacttgccacacacaccccccgcccccgcaggatcctagttcttggggagaagggtgttgtcgtcgctcccgtctggttgccataagtgcatcttgggctttcagatcccgccacaggaggacgactatggcttcgaccttgaggagaagaacaaggctgtggtagtgaagtctgtgcagaggggctcgctggctgaggtgagacccaccggtggccactcaggtggggtggtacctgagctgggggtgaccccgtgtctctgagatgcagggtagctgggaatgagactgccttcctggcacgttccactagcgccacctgctgggctcttggagacgtgcagggaaagcagatggctggctccctgcagggtttcttctgtctcccaaaccccagtttatggcatctccttccacagtcttgttcacattcccatggttacaaagtggccaccacactgacctctgtgccgtcacaacacaggctggcgctggccatttcttcccaagggaactgccacccacccttgcctccttgggctttcatttacagctcagagcccagcttcctggtgcttctagaacattccagcttcctcggtgaagagggaggaggccagtgacacctgtgcttgtccctccagatggctggcctgcaggctgggaggaagatttactccatcaacgaggacctggtgttcctgcgtcccttctctgaggtggagactatcctcaaccagttcttctgctcccgccgcccgctccgcctcctggtggccaccaaggccaaagagtgagtgcgagcctcaggctgactcagcaggtctccctgggcctggccctccagcatggggctgccacctttgttagtctaatttgatgtcccaagtgcatgaccagctcagttttgggaacaccgtccccgtcaaggtggatacagttcctaccttccatggattcttgcgaagtcagggggcggggccagatatacactgggcaggtgtgaggcgtgtgccgagttggcggttatcagcagatacctgagattagagaaggaagccagtgtatgcagagagacagtggccagagagatgtcactggggatggagcgatggctctaggagacgacttctggaggacgagggttctagaaagatgaagcactcactgcaaagcccccgaggttgcactgttggtggcaggtcggaggaggcagtgagggggtagagcagagttggagagaggagacatgagcaagtccccatggatgaccgctggagaggaaggcttccctggggatgcaggtggaagcaggtgccttctatggctgcctggcttgcagggtcagggtgggccacatctggacagaggtgcggtgggcatacttttattttacttattatttatttatttatgtatatgtactctgtctgcatgtatacctgcatgccagaagagggcattggatcccattacagatggttgtgaactactgtgtggttactgggaattgaacgcaggaccgctggaagggcagtcagtgctcttaaccactgagccatctctccagcacaaatgtacttatattggttaattatttggttccctgcttcccaggcacttgaggcaaatgttggctgatcctttcacagaggttgcctaagaccatttgaaaacacagatattcacgttaggatccctaacagtaggaaaattacagttaggaagtagctatgaaaataattttatggttggtggggtcacgagaacataaggaactgcatttttttttttttttttttttgagacagtgtttctctgtgtagccctggctgtcctggaactcactctgtagaccaggctgtcctcgaactcagaaatccacctgcctctctctgcctcccaagtgctgggattaaaggcgtgcaccaccacgcctggcttcataaggaactgtattaaagggccccccagcattagcaaggttgagaaccgctggtttagactctgtttctgtaaggacaggtagattcaaggtaaaaggtgacaggaaaggcttagctactcgatgccggagacggaagtcaccagggtttaatctttgaggacaggctctcagggtggctctgcttgcccggtagacatggaaggagggatcatgctgtgtgctggggacagaagctgcctagcagctcaaaatgaatgatatctgccaatccctgcggctggtaccttcccttggcacccacagcctccaagctgtgcctccccttggtatccgccactgtctcagcccctgtctgcttgggtgacagcctttggttctttggggacctggttgactgaccatgttgatcattgctcctctcatggctgatttccaagaagcccagggtgttggcgggaagggactccttgaggacccacactcctttttctcatggcctgtctctgcccctgtgcctgccaggaccatcaaagtccctgaccacccagaggccctgtccttccagattcgaggaacagccccgccgtgtgtctttgctgtgggcagaggtgagcgggagtctggtgtgcagagcctcttggggccacatcgtgggcgtggagagccgcatgcccagtgcaagcgactatagcttcccagtggcagcaaggtcatggtccagctgtgtaagaccttggctagagccttaggcagtccagctagaactgagaaagtgactaacatctactgagcacttagtaaggacagccattccccacgcccaagcttctagagtctctccagagtcctttgaagagatgtgctgtttaccaacttcacagatgagaatattaaggcccagagaggtgaagtgttgtgttgtgtcagacacagggcagagaggtagttggaggcccctgagactgggacctgcatgggccaaggtcctcgaggcctgtgcatcttaggctggagtcagctggccatttgttttcatttctagagttgtccgttagcctagagatgctcacgacccactgcttgggacctgtggtaggactggcagggatggaccgtgctaggcagctatattgtgtcctggattttctgagcctgtgccctaagggtagctttggtctctctctgcgtcctggcttcagtccgtcgctgtgcgggcatgcagggctccaaaagataggggtctgagataccacattgggccggctgcctctgctgtatcagcggcagctctctggttggcagctgagaggaggcacgctctggatgcagccattggcaggggcagctggaccctggctcctctgcctggctctggcctcaagtgttcctgttcctcaggctctgaggctgtggctgccgggctctgcgcgggccaatgcatcctgaaagtcaacggcaccagcgtggcgaatgatggcgccctggaggttctcgagcacttccaggctttccgcaaccacagggaggaggccctggtgagcactgagcggaaggtgggaggctgcctgccatcttggaggccccttagactgcttaaggagcactgagctgagctgagtgtgaaaggcccttttacaaacgggagtgttgtgacttcagcaacgagccacattaaccatagaaatcacttgcagggttgggttctgacagcccaaattctcccctgctgacagtgtgacagactcatggctacagtcactcttccatctacacgccttctcttgactttggagattcaggagagatgaggatattacttgtaccccagtgttgtcaaagccccgcttcagagttggtgttccacccccagccagtggtccctcagttccagagggacattttggagatctcttcagaggtggcctcatgggcaggaatcaggggaccgcctgccttggctcgtcctctgacagtggttcttcgcagggtctttaccagtgggtctaccacagccacgaggatgcccagctggcacgagccagccagggtgcccctgatgaggacccccaggaagatgaccagcctgactcaggtaagggacggggagtgggaagagcttcagtttggggtcacggggatgtctggtcttttgtgtccccaggtctccatccatcccagttggcccccttggtgctgtgagcagctcagagcagggcccatctttagcggctcacactgtagtgaatctccctgggccgtggttctttctgggactctcagcttctagaagctccccacatgccttggctcctgattctcttgctgcctgatggcctagcacagtttgcccaagtcctagtttattatccttgtggctctgcccccatctgcccagggtggctcctgtgatgttcacagtttctcttgctttatttttttaaagcaatttatttatttttatttcatgtgcattggtgttttgtctgtgtgtgtggtggggtgttttggaggtgtcagttttgagctgccatgtgggtgctgggaattgaactcatgacctctggaagagcagttggtgctcttacccactgagccactttgacagcccctcccgtttacttttcattggcttgtcagtcaagagttggttgcttagtgaaagcccaaattctcccctgctgacagtgtgacagactcatggcttatgggatcagaagtacgtgtcttctgcgggccaccgttctgtcacgacctgcaacggtcccctctagagtcacctttggcctcttaccagactgctcacttcctctgctggcatcagaaacttaacctgcgcccgcccctggtccgtctttaccctggactctcaggcctctttagtccttgcttctgcccatgtgattcctgcacccatgcatgctgtccactcggccattgtttgctttccaccgccagggtctgaccagttcccaccaccttaaccggtactggtttgttctgcacctggtttttaccaggattcttgcagccgtgtgctcgccgtcctctccctggttggtccccaccccaaatcccacacagtgttcttacaaaatgagagcagagccttctggtggcctcctccctgctcagggagaaggagaaggcatagccacaaccttcaacgccagggtcccggccagcccagctcccagcatcacctcgctcctcctcgctccatgtcctctgctctgcatctggctgaatgaatgtgtttctgctctgacttcacacttgtgtgcactgtctggaccactgctcccctcccttccctcagaggtcactgcctcagcagtcaccctgagggccctacgtacatactccttcctagagattccggctcacagaaaagtgtgggctcagccaactgagatctgagtagggtcaggcaagcttcagggctggctcaatccggcgcctctcacttctcagccactcggttggctttttacatggtggctctggcaactttgaacccatgaaagagaatgtctcctcctttctaggaacccagtggggtccagactggcagtgttctgctgtctgtggaactgaagtgggcaggagggatcagcctctagtgggtcttgggtcagctccatccacaaggggctctcctatgggtaggatcgtggagcagcaagccatggatgtacaatgtgactgttggcgtgtccccgaccaacatggcccactcaggggtgctggcagcagcctagctcctagggcacagtgctgttctcagtatggtttgcccctctggcttctagccctgcccctgctgtccctgggtccccagctgagtctgcatgaggacagcgctgtggtcagcctgacgctggacaatgttcacttggagcacggtgtggtttacgaatatatgagcactgcaggagccaagtgtcacgtgctggagaagatcgtggagccccgaggctgtttccgccttgctgccaaggtctcaccctgctccctagccctaccccagtcaccccacctcacactgctccatacccagtcccaccccagttctgccctcccccccccccccccccagatcctgacctggtctgttctgcctcaaggtcaggggttgctgattcctttgccctggagccctggcctctggtccttaccccagtgctcatcagcagcaggaccagggaagatagttactgatcttttagcctcaatttaactttctccaaaatgggtgtgtcacagtcccaatctcttagggtgttccggtataaaaaggctccccacaggtaagacctctctgtccctgtgggacacacgctcagaggttgtcctcccttccgcagatccttgaggcctttgctgtggacgacagcatcttcgtgcagaactgtgggcggctcatggccatgagcagtgccattgtcaccatgtcccactacgagttccataacatctgtgacaccaagctggagagcatcggccagaggatcgcctgctaccaggaggtaggtacttggtgcccgcactctgcttacagcgtctcagctaagttccccctgagcgaggctgtccctgatgggctcagtcgccgggcaggccacaagtggacttcaggtacagcggtatccaggtgccggcttgggccccagaggatcagctcccctctgtggttgggccctcgcctgtggtgaccaggtagccttgtggatctctctttaccatcgctgtcaagatggattcacagggcgcttctggttttgctcatgtcccttgccctgccctgcctcaagcattgtagagtaaggaggtgaccgtgcctgaacctcataactgaggaccaggagatgtggtttctaagacattactgcagctaaaagagagaaaagactccacgtctgtactcagccccacagcttctggtaggctgtccttgtgagagacactcagggtgacagcttcattcacagccataactgttttttctccgatttgggagtgtcaggactacagagtggctccagggtattcaaggaccttgctgaaaccaactcacgctcccttgtccgctcctctctccctctcagtttgcagcccagctgaagagtagggtcagcccccccttcaagcaggcacccctggagccccacccgctgtgtggccttgacttctgccccaccaactgtcacgtcaacctcatggaagtgtcctaccccaagaccacaccttcggtgggcaggtccttcagcatccgcttcggacgcaaaccctccctcatcggccttgacccagaacaaggtacctgtgtgtgtctatcagaacttgtgttagagctcaccttacagatgaggaaacagagaaatgactgaaggtcactgtccaggatggggttagtggctgtgtagtcatcagggacccaggctcctgtctttctgttattaccgtctttagtttgagtcttgtaccttcatgatgcttctcgtggtataagatggctgccagagcacttgccatcacgtctgtactcttaagtagggggaaaaatatctcagtagttaaaatatgttttcaacaaatggcagctgccttcttgggtgacctagtgctctgagatgtcaaaaggtcaaacgtgctgcatgcattttcctgtccagaggttcaggcagggtcccctctgtgtgggtctgagcctgtttctgagtaagctcccccacctttgctacaggactgaaccccatggcctatacccagcactgtatcaccaccatggctgccccgtcctggaagtgctcacctgctgtagacgaggactcccaaggccagggtctcaatgacagcagctatgggtcagccagtggtgccccgagccagcaagaccgcggcctgagctttctgctcaaacaggaagaccgtgagatccaggacgcatacctgcagctcttcactaagctggacgtggccctcaaggagatgaagcagtatgtcacccagattaacaggtgaggcctggccccggggccctctctgctgtctggacatcactgctcatagtgaccatcttgagcacctcgggtcctgtgcagcgtgcctgggctgtccctaccagctgcccggagcatcttcgacagacaacaggaagtccctaattctctagggagagtcggttctaaggaagtgaggcaggtaggcagtgtccttatgaggctgaagcctgtgagattcattctctgtgttaacgctgaagcaaaatggactgctgacagggtgtccctgttaccataggacattgtggtgcatacagcagctgccagctctgggcagagatagctccactcactactcagcctctagagggagatagaggttagttaaacagcaccttagggtgacattggctaaagccggggacaggccattctctatagaacataacaaataaatgtccaggctgtggatgtagggaagaaaaggaggaggagaaagaagaggaggagaaaaagaaggaggaggagggggggggaggaggacatagatgaggaggggcagcaggaggaggggcaggaggaggagcaggagccattgtaaatcaagaggcttagaaagtgcattagccagaaacagtgtctagaccaatgtagggacctgctttctcaatgctgtctggaaggaacactttagagccagtcagtcaggaccacttgtgcatggcctggtaccagataatgttaaagggaataataataacaataataaacaacaacaattatcatcatcttcatattcttcatcatcatttggttcagcgagagccatgcagtcaagtttttaaaaggctcctcctttggtctggcgattcaggtggttgtctgtactgtggggctcctgggcctgtagcatgctcagtctctgcttgctcagggcctcggcatcctcctccagttgacagcccaatttgtctccagacactgccccgcgcagcggcaaagcctgggctgttaacggatgttcactgtagctatccacaggcggctggagtctgtccactacccgctttactctgtaattacagttttactgtagacatccctgctaacggtgtgctgccgtggcagagttggtgcttataactgaggtgttcctgcagactctgggtttcttgtttacatttccttttttttgttgttgtttttgttttgttattttgagacaaagtctcttgtagctgaggctggccttgaactccagagtgctgggactacagatacgagcttccatgcctggttagtctaaggcaatgattctggagcctttaaatacagctcctcgttttgtggtgaccccaggcatacagctaataaatatctgatatgtaggctatctgatgtgtgacccccggtgaaagggcagttcggtgcatatagaagtcacaacccacaggttgatcacacccatgtaagcctttatcctctgggctatatcacatccccagcctgtgagaagtgcttacagctgggtccagcagggggcagcactgggcatccatggggtcgctggtgggacttccaaggggcaaagactgctgggtagcttccccctctctctcactgtggagtcagagatgaggtgaagcctgctctttgatgagccctgtggcggtgccctgccagcctgtgtcctcaccttcaaggcctttccctcgctctggcaggctgctgtcaaccatcacagagcccacatcagctgcccctgcgccctgtgacccatccttggtggaggagacctcatcttccccaccggtcagtgaggagagtgaagtggaccggactgaccacagcggcatcaagaaagtgtgcttcaaggtgtcggaggacgagcaggaagactcgggccacgacaccatgagctaccgcgactcctacaggtaggtgcgtgtggcccacaggaggtcaccggacaactgaggcttctgacctgtgggaaagtcaagactgtggcatttcccaagatgaagggcatcagtctctggggctaacgatgtgtgtttggtggggcggagatgcagggccgggggcttctgatcctctcagaggatgttccacagaacttgcctgcttgggtcccttgccttgagctgaggcctgagctggcagatggacaccattcattctgtgttactctgtacgctcccaggctggacgagagtctgggttctgtggtgtgtagggcttctgtagatccaaggagtcagacgttttcttgttttcctgcctccgaggatgggagtggtatttctgcaattgttaaatttattttgaaaataccagtagggtgttaattagttaaccaggcaaaaccaggactttctatgctgtgacaggtcaccctcattaccacagagaagtgggggtccccagtggaaaatcacagtgtctgactcagagtctgttttagtctgtagtgtgggcaaaggctgaagccacaggattgtgggggtggggtgttgccagcctacctggcttcagcaccatccctgcgttccccagatctgcctcgtccccgtggccaccttccacggtgtctttacggcaggattttctgtccgcttctcactccgagtctgtggagcgttgtctcagatccactccccgcccgctccgatttcctttttacgtctttggctctctgatttttccttgttcagaaagctcttggcaaggtggtttcctgtgcctcatctgttgagttccttttggccaagtgcgacgtgggcaggtgtgtctgagctcgtgagagctgtgtagtgcccagaaacctggtgacagacactaagacacccaagtgaagaaagccccgtttgtgcttctgagctggggcctgagcgaatttcccccatcagacaccaagccgggctggccttgccctctgcctctggctggctgggtgtccgcccaaggctaggagttttggctacaccccagatggtggattccagggctgggatgagggtgactcagggtgtctcttgtcccgttgcagtgagtgtaacagcaatcgggactctgtcctgtcctacaccagcgtgagaagcaacagttcgtacctgggtagtgacgagatgggctcaggtgagtgtgacctcagtggagaggctgctggggattgtgggagggatggagaagttgcaatgggaatacggtggctattctgctgggtgtgtgtgtgtgtgtgtgtgtgtgtgtgtgtgtgtgtttgagacagagtttctctgtgtaacagagccctggctgtcactttgtagaccaggctgtcctcaaactcacagagatccacctgcctctgcttcctgagtgctgggattaagggcatatgccatcacatcggtctgtgttctactgtatcgtatcacactcctcagtatcatagaacgggacaagtttctcagaacatatttactatatacctaagaccagccagatgctggggacacagcagccagtgaaatgaagagaagaaccagccattatcattatcagtgtcagaaacacacacacacaccagactaaatactactactactactactactactactactaagtgcatcacgggtatacctcatggtggaatgcttactcagcacgtacagggcactgggtccgcccccagccctgcccccaccaccaccaccaagaataggaaaattcattttgtgaccacacggtacatattgaagactccctcaagggtttgaggcatcttgtccccgtgagttcccagcctcctaggtctcaagctgttgtgtctgttctcgttcttccgtgtgtctgtccagtagcatctctgcataaaaaagaaatcttaattctacatccatttcctgggaggggaatggaggtcagactaggttctacagacttgtgtagcccgtgagctacgtgctccctccagccgagagagccgggaaggcaggcttgctgacttttgcccacaatcctggcacttgggaggatgaggtagaagctgctggaaatttgaggctagcctgggctacatattgagttaagaggccagcctgggtgtacagagtgagatcatcttgaaagtcaagagatgccagtgctgtgtctcagtgtgagaaggtatgcgctctccagtccgatgacccgagtttgatttcttggacatacatggtagaaagagaaaacagactccacaagttgtcctctgacctccacctgagtaccacagccacccccagcaaaataaatagatatcattaaatacttttttgaaaatctagggaagactagctgggcggtgcatcagtccctctccctggctgtcacctgctgctaatcctaaggcttcgatgcccataacaaaactgaagctcacaggggcaaagggctctctccagggccttggctggggcctgagtttgtcagatccacatcgcctgtgggtctgagtctgtagccatggcaattccttgtcagctgtggctgacggctgtggctccttctttctgctaggggatgagctgccctgtgacatgcgcatcccgtccgacaagcaggacaaacttcacggctgcctggaacatctctttaaccaggtaggatctttgccccactgtgccctcgatcactctgatcaccctggggttgtgggtacactgtgggtggcaggcccttcctgtactcatgggagcttcttctccctaggtcgattccatccatgccctgctcaaggggcctgtgatgagcagggcatttgaggagaccaggcatttccccatgaagcacagctggcaaggtgaggggactctgaaagacatggccacatgtgggtcttctctgcaggacagcaatggaagggttgtggttctgacagttccagcctgagccagacccgggccattcttatgtttgttcagactgagcctagaatttttttttctttttttcctgggcctgtggggtgaggcaggaggacagcctggaacatgatctcagtcctcgcgctgtcctccctgagcctgacgcacagagtccgtgcacatctcagcatgaatcattttcatttatggtcagtgttatggcctctgtaacttaaaacctaaactctcccaattagaaacttcgtttcatgagtaccacattaagctccatggagttgagaaaccagcacaatatgacactcattaatgataaatcaaagccgcagatatgacagagacaacaccaaaaacgtcttcggcacatattggtcccggtacctgctcagagcgtccttgagaggaatttctgagggaaggacgtactaaggcctccctggcatcagactgagcggggaggggaagacgagctctctgaacctcccactcacacacggcatgtggccgtctccctcccgacccagtcacctggtatccactcacccatgctccatccgtctgtctacacatctccctactcatgctccacccctcccccatccatcatgcactgtctatctgcatacccagcatgcattacatcctcttcatctgccctgcatctgtctattcatagacatctgtctgtacattcaccaaccctccatccatctatgcatccttcatcacccaccctctgtccatctgcctacctgcacatccacctatccatctacctgtatggatgcacctaccatccatctgtccacccacccacccacccacccatccatccacccatccatccatccatccacccatccatccatccacccatccatccatccatccatccatccatccatccatccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgggatcacccactgtgtatagcagtacctgattcagataggcagccatgttcccataggtatgagacatagcagagaatcaggaactcttggactgtctcaggggtgctacccagtgtcagaggtgacatggagggcacggccacaggggtctcagaaacccaaacagggaaaaggacagggtcaggtgcctgcctgacctttggctggtcctgccccatggccgattcaatgatcaaccttagataaatcccatctctttcctgctccaagcctgggctgctgcttctgtgtagggaaaggccactgggctaccactcatctgccagctcagttggttatggctatgaggaggtaatatctgaggagcctgtggcttcagtttccagctctaggaggaccagccgtgattgatttgtaatgtctgtactgggctggttgtagctatggggagaccgggaggcagtgagaggccgattgagggtgtctgttgtggatgccgtgctgtgatacctcccttaggcttgccatgcacaacccgtgaatacccgtgagacccatcagtttccttggtgtagggtagtgagcttcgtgagctggtgatggtgcctgctggccctctcctgacctcacacccttttgctactttgctgcccaagagttcaaacagaaagaggaatgcacggtccgagggcggaacttgattcagatcagtatccaggaggacccttggaacctgcccagctccatcaggaccctggtggacaacatccagcaatacgtggaaggtccgtgggtatagactgtggtgttgcctggaacgggcctagctatgtggccctgtcttcatgtctgggggggggacggggacagagcatcgaagccatttcctagtgaatgtcctgatctgctgaggccctgggctatctgtgtggctagaggagccctggaaatggtgccatttctactgaggcttcttgtagtcaggaggctgaattctggcttccttccttctctgcttctaaaactggatcccatccacttgtcattgattgtcacagattggagccacttgtctgagttgtcagtgatatgagaaagtcctgattccttagtggccagctgccctgtggccacacttgtgtgaggacatgaggtactcatgtctacccgacatatgtcgtttacctatttgagcctttgggcacctgagtcaggcccctggggccgggggctggaggagggaggagttacagaggcgtgactgtctcaggccaagccacctggttcctaaacagaagtaggtcactaacatgagtctgggacctgactgccaccaagaatcccttcttttctgctttcagctgtatagcgggacttctcgtacccgccagtggttaaatggcacagagatttgtgaatatttattacagcttaggagtatagcagggcagactatcagctacctcatgtaaattatcctgactagtctagcactatgtccctctctcttggccctggcacctctgttcctctccatgtcccgggggtgaatctctcaagtctctttctcccagagaccttccctctcgctgaagttctgccttccctttcctgcccagctactggctgtcagtttttttattaagtcaatcagcaagcgaggaaggtgaatatttacaaaataggaaacctatagctctctgtgggtacagaattaaccgttcaatatacagagtcacacctttacacaatgtgcaagaggttacccccaacacagctctctgatgaggatacaggaacactggtggtaggggctccatctctgatgttcaggggctctggaacttacccagcatgcattgagcacagctcaagcatctgtgaggggccagagcccgggtgctgtaggcactggcttgccccgcttctgccatctctgctcacccctcctcctctctcctccctcctttcagatggaaagaaccagctgcttctggctctgctcaagtgcacaggtaggaatggggctgtgaaggggtccctgggagacacagtgggtgctgtggccacaggctggggtgatgtccctctgctggccaacagcatctcaatggggccctcagcatctgcactggggaggcagccttttctcccagtctcgccgagaacttctcaccttttcctctggggccaggcagaggactagactcaggtcctggggaacatgagccctgtttagtgctacctgttaggcctggtgggtgttggcagggggactggtggaagacggagggtgaggaacatgggctctgagctagtagagcggagcctggaaataatagaggatgtaactgcaggataccttcatgtgtgtgcgtgtgcgtgtagtatgtgtgtccatgcacacacatgcatgtgcacatgtagacttgagtatgcatatgtgcatgtgtggatgtgcctactctttatacagattaccaactgcctggcttgaccagttggggcaggacttgggggaggtgaggcagggggaagtgttcctgggacccatcttgaatatgcagcttagtactgctaggattcgtgtggccaaggctgagaggtcccgtgattcactgtagggcagtggggcagggtttgggcgtatgtccgcctcgggaagagccacacattcgattctccaagaagcaggcacttgggcagtgggagagtgagacttggggcagatctgtcttcttttgaagaatttatttttctgcaactggcttttggcaacctatttgccccttcagagttctccacaggcccccgtgggcatggcaggtccagggttcgggtgttgagggtggagatgctgccagtccgcacagcaccacttacccagagcgccccccccccccccccacagacacggagctgcagctgcgcagggatgctgtcttctgtcaggctctggtggccgccgtgtgcactttctcggagcagctgctggccgcccttgactaccgctacaacaacaacggcgagtatgaagagagcagcagagatgccagccgcaagtggctggagcaggtggcggctacaggtgtcctgctgcactggcagtctctgctggcaccagcctccgtggtaagcggctgaggtcattggcagcacgggagagagtgctgtggctactctctgctcccagttacccaggggttcatgtggcagtgatttgctgagcatttgcttttaggttttggagttcgtggatgaacaaaagtccctgtgctctgtggtgtcctggggaagagagacagacagaaaagacccatggttctgagccgcaagcgggtgtctcgtggcagtctgggctggcagctgaggaatccagggaggggagagaatattacttgcatctagtgcaagtgtagagggcaggagggctggctcgttacccagtagcagttccattatgtgtggttccagaggctatctcaggccgcccacgggcagcacagccctagatcgccccctgctggccactggtgagcactgctgccggtcttcagagatctgcctctggccccactccacagcagccctctaacctctaaggatggaataccagatccagctcattcactgatgtcaccagcaccgagctggccactgggtctacagcttatttcctagagaagtagactgacaggggagacagcccaaaggccttggagtctctctggagggagtagccagactttctgggtggtgacttttgatttatgatatctgtcagccaataggaaggtctgaggaagagtatgcagagggacagcacgggcagaggccctgggcagaggcccgtgtggccagtggggacaggcagggaaagcaagattagtgggatggtctgcaggcagaaggtgactcggaagctgaagggcaggggactcctgtgatctgggctaagttttaaaagaaagcgtgtaaccttggagagaggcggttaggggactaaatggagaaagaaccctctgaggtgtcctggtgagaacagctgcaactagagttgggtgttggccgggaggctggacggaggcagactgtgtccaggcagtcgtagctgctggatggggtaagacgaccaggagcggacggccttgagaaagggatacagagcaggtctagggggcttaagagaggaagtgcagatgctcatggagttggctgcattttggatggtaccgggtgtggctttactggggccacacagcaaggcagagcagaagtgacttctgacccctatggggtacagggcaggtggtgggatgaaccatgatgtcacctgtagagccacacccaagacacccacaggcctcccagccccgtaggtgcaaagcatggcatctccagggcagcccaggacagggtggcatctgagtctcccttaccaccgcctcttcccgcagaaggaggaacggaccatgctggaggacatctgggtgacgctgtcggagctggacaatgtcaccttctcctttaagcagctggatgagaattctgtggccagtgagtaagccctcccttcctgccccgagtcgagctgctcagagccacgctggctctcctccgctaccaggccagcagcccaagtggaccagtctccagtgcttcaagcctcacggcccaacccgagactcagagtcagtctttggggagcacatggaaaaaggaggggggtgtatcagctacttctctgggtgttacaacaaattacttggcaaagtcttcagctgacagcagctacctgtgtgaaggttcagggggaagcagtgattgattagtgatgcctgcctggtaaaaggtgtgggctctgagtcatgtttgtcggccacaattcttccttatggatgctgataagctacagagcctggcttttttttttttttttttttttaaacagcttttgctctgagctgtcaggcaagagagtcacaggacaaggtcggggaggttgaagacactacggccagctctcagggcagggacagtgttagggccaagactaaagcagtggggagccagaggctgtgggtgccagtgaaaggggaggtcatcacaggcaagtctggaggctgtatagggcggttcaaagctaagcacggaggggaggggagggggaggggcttgacgctgcccctctgcgatattagggcagggaagcctcagatgtcaaacatagaaattccagcatgccacctggaggctgggaagacaagaggagagtctgaggctacccctgtgggtcaggagggctggaagtataaggttttccctctggagtgccactctggcctctttagtgagccaccctgctttgcctccacagacaccaatgtcttctaccacatcgagggcagtaggcaggcactgaaggtagtcttctacctcgatggcttccacttctccaggctgccctctcgcctagagggtggggccagcctcaggctgcacacggtgctcttcacaaaaggtgagcagccaggctgagggacctggcagggaaaggggcagaggcaagaccactgagcgccctagggcccagcacctaccctcctgtgccttccctcacagcactggagagcgtggaagggcccccgccccctggaaaccaggcagcagaagagctgcagcaggagatcaacgcacagtccctggagaaggtgcagcagtactatagaaagctcaggtagctaccgtgggctgggggtaagggcgggatgagggctctggggtgggggtggcaacctacagggagtggacacatcattcagagccatgggcaagcctgacactctctggagcacatacagcagtgtgcatggaggccgctgctgacccattgtacagctgagtatgctgaggcccacacagcctgtaccagattacacagacagatgaactcaagtctctttggcccattcctccctgtgcaaagaaggactgagcagggaggattgcttctgggatctttggactcctagccctggatcctgctctgaggagaacttccagagagaggtgcagagggcagtggacaaaatgctgtccagagggaaaacagctagacccaggaaaacagctaaggtctgacactcctactacagctacctacagccctgcctgcagccacaccctgaccgcacccgccaacacacccacagtctcacctttaccagatccctagaccaggctcccagacacagcctctctcaagtcctgtctcattgctttccctgcaataccaagagggagagaccatgggcctgggtttccatggagaggggcactctcttctcaggtctgttctgaccatttgcgaattggaaaacgaagcttccattcatttactaggcacacaatttacaacttagttgttgtcctttgtctgtccctgtctgtctgattagctgctaattccacttgctcatggagactttctgtgggccctgcactgccctgggacccgggaagcagtcctgttcttcatgaatgcttattctgtcaagactgggcctccaactctggctcaccccttatatataaataaagttttattcacacacagccaagacagtttcttcctgaattctttgtgggcccccccccccttctgtgtacaatggaagacaaggactccctggttaaaagggccagtgttttctggttggccccatatagaaggatttagagagtgagaaagaccacaggctggtaaacccagaacaattttgtgccaattgttcaatgtttagaggagagaaagcagcaatggggctggaggagcagggcactgttgtccagggcaggaaggcagaggtggtggtgaagcccagagaacccttcttgcttccctagggtcactggaagagcaggtgactcagtgatttgcttctgagagtctggggaggatacagggccgtaactgtaggggttgggacctggggcaggggagggccgggcgtgtgcgtgtgcctgtgtgtgagtgtgtgggtagtagcagaatcctcagccttatctgtctccttcagggcgttctacctggagcggtccaacctgcccacggatgctggcgccacagctgtgaagattgaccaggtatgcttgcttctggaagtttgggccgggtggggtcacttacaggctgagtctactctaatcaggcccagaggccccctgcaacccccgtcagcctgtttcttctgggtgacaggctcttgctggcctctgttgcttggggctttctgatgaacactttcttgatcacatttcttgagctgagacccctaaagatcagagtggtgactgccacactaggtgtggctttgcatggtatcccttttgcttcaggttcttgccaggcatttacaaatcagaatttctccatcaaaaccagaggcgttgccatttcttggccttttggctaagagcatgtgtcatgtctgttcttaccagcttagtgccctgccggtcccctgaggaaagcgacaaaacagagccttccagctgcttgcgagagatggatgctctgagatctagctggggctcagttcttttttgtcatggtggcctcaagtggattctgtccctctgcctctcatccacaaagcatctctctgggtctcctagttccccaggcccaggccttgaacttggagtaggttgtgaggaactggccatggggctcagaggctgtgagctccgaggagtgtgggtgctatctttggggattctgtagtctgttggatacagaccagaagatcataatggttcacggttgagggagacaggataaggaaagtcttggcattttggtcaagcccttggacttgccacttggagagtggccgcttgaactagttgtgacaggtttagagaggagaaaacaggtcacccgcttaggcttaggtggggctgcacttggcagtggcagagccagtttggaaggtcagaactgtaacagtaaatagcaaatggcaactcacagggccatgggggctgctcatgattgagggtgctgggaagacagctgtgtaacagctggattagaaggatgtcagtggcggccagtggaggtctcaggctgcagccttcatggacatctgtcacctcccttgcagctgattcgtcccatcaatgccctggatgagctctaccgcctcatgaagaccttcgtgcaccccaaagcgggcgctgctgggagcctgggtgccggtctcatccccgtctcctccgagctctgctatcgcctgggggcgtgtcagatcaccatgtgtggcaccggcatgcagcggtgagcctgagccaaggccgaatgggacatagctagcgggggggtgggaggtggggggccactaggtggactctgggaagtcaggggctcacgcacagaggtgggacagctaggttcaaatctgggggctgcagtgcccatgttctctgggccttggcttacctgtcccctgaaatggtgtggccagggtcagtgagcctgggagcatcacgcactgtcccgattctaggtaattcagaaaagacacactcaccatgaacaggccgtctggccagcgtccacccagggcgaccgctgtcagacagcgcgatgctatcctggagttctcagctggcgagagtggcctcttttgggcatacccagccatgtctggatacatttgtggtcctcatgactgtgggagggagagtggataaacagcaggtagaggccagagaaactgctgagtgtcttacagcacaggggtggcacaccatgttaggggaggcctggtgctctacatttagggaaactgagttacaggactcagggtgactgaatagagctgtagattaggtctgtcttgcaatctcatctcaggaactgacgtaaggcctgtgcccccctctcatcctatgagagagcctccagggccatccgttagtatttgccacagcccctgcctgcagctgtgggttcttgtagaaagctccaggaagctcctgcctcagcctctgccttaggggtgtgggtagcatgctctgaggtatgaaggccgtcaggaggaccaaatgggagggttccaggaacttccttgagagacagtggacacctggagatagtgggaggaagggaggcatggcgaacaggaagcgacccttgtcctacctcttccttcacctaccacaggagcaccctgagcgtgtccttggaacaagcagccatcttggcacggagtcacggcctgttgcccaagtgtgtcatgcaggccacagacatcatgcgcaagcaggtgaggtcacccacagtggacagtgtggccagggaccctgaacttagccctgtgggatgtggttcatcataggcccggtcctcctcagccccagacaccttgctcagtcagtctcagctgctaccctacctggctccctgctccccctgccccgcccccacccttgttcccacccatcccaggccctgagttccaggcccaggcctgacagcagtcttccctctagggcccccgagtggagattctggccaaaaacctccgcatcaaggaccccatgccccaaggtgcaccacggtaagtggctacccaccccctcctagcccgacgctctctccaggaaggcccaggcctgcttggcatcagactcctggtctctaccccagatagaatcctagtgttctgtggggccacctctcactatgggactctgggagacacactgtgacttggcctgccacctgactgctgtccagcccctgagtggcagttgggctccttccccatccccatggtgactctgtcagtccagccttctgtcatctgctaccaggctcctgaagcccctcagggggtcatgactcctcagtccctgcccagtctgctaccgatggctgcccaggagtccaccctcctgccccaccccggatcctgcctacaccatttggtctgccacgttctcatgctctcagctcgtcttcatgcctttgtggtgcctggcctgttcagggacagggccatccaccctcttgtaaacccagttgaccccctgcagcagccctgtgaacaacgctctgctgagattcccattggcaggtgggcacatagaggcccagagatgttcagcatcttgcccaaggtcacacagctaatagcagagctggccccagacagtttaggcatagacatttaacttggtaccatgtcatagtgtggctttggttactccagttcaccacagtggcctcccaacccctaaaatcatcgctctttatggctgcctctccttgaagcctagcacacactcttgttcatagtattctgcagtgtctccactctgcagtcccaatccaaggacacatcaaggctgcaagcagacaggctcccaataccctatatgcacccaaatacacacacactacttggaaacaccctgcctgcctctagagccctggctcttggccttcctaatgctgcaaccttgtatcacagttcttggtgtattgctacttcgtaactgtaactttgctactactatgaattatatcctgatatgctggagagtcggcctccaaaggggttatgacccgtagttgagaacaatggcactagaggaacaggatctgcctttgagaggggacaaggtgctaagggcaggttcaggacttactactctgtgtattcttctgggtatgaattgcttgtcccaatagaaggggaactagccacatgtggtggccacgcagtccctcctcacgttctccgcctctgcctgacagcctctaccagctctgccagcctccggtggatggagacctctgaacaccaacatgttccctgcttggtcactgcctcaagcagctgcggtgtgagaggacacggagggtctgcaagggcacccgaggcttctgccattgctgtgtcaagacctacccagatgaccccgctgccactgtctgggacaagcctctgcgcacatcctctctctggactggctgatcactgctgggctggcaggttctccatacttatgcctaaagcctgagagctgcttgggggggccccccagagctcatgaatgtagctggggcctggatgcctgcactcacccaggtcccctacacagggaaaggtcacagggtctagcaggtggaggcctgcagaccccgctcctcagatggccaagctgcactttgaacctgggttcctcccggggccacattccaggggactgtacctatttcctgagctggctgaagcttccggacatgcctcctgccccttactaactggctcagctgactcgggacagcctggcctctgccaggagaggacactgggccatcactctgtgaacacttgtgtgcccggctggcttctaacacccaccgccattggaatttgagctgtcagctctgggcgccagattggctctgatgctaatttatatgacacaacatctctgtggtttatgttttatttttctttcttactgtcattgttagtgttgtcaagagttttccccctccccgtaacgtttttgtcattatgtctttgacgctttaaatttcagagaagagtatattgcctaatgggaccaacataaagtagttatcaacaactttattcagctctactaaaaaacaaaaggaactaaattattgaaaaggtttaagaggtcattatttccgtgttaaaatctaaaggctgtgagatgtgcctcacaggcttcactgctccttcccctgcctcagcacccgcgagtccggcccacgttggacttggttgtgtcaacgactggaccagagtttgagaggtgctcagttgtggcttagggccgggctgcgtgttctttattttgatgtcatcatctcagaacagggtcagagaaccggagagataggaacctgttgtcctaccttctgagtcggcggctgcacgtggggacccctgggctgtttgtcctccagcttctgaacatctatagggaaccgctggcatgtaggagcgggaagggcatgccttctcacctataaggctgtaaggctgggtttgggagtatggtcccctcggtccctcggggccacctttctcttggtatcgggccatctttgttgatgtgttttgttcatccagagaaccagggcccctgttaaccctgctgagggggacggggaagggccccgagggccagggcagcatacctggtttattttaaatgtacagattcttttcattaaattcatgatagattttttattattattaaagtcggtatataatacaaataaggtgtggcctgcttgtttggtggtgagtgtcaccagatgggttccagctcagacaactacatgaacgtggcttagattctggctgtgggtgcctcaattccctcctgaggcatgagagccagctcccatcagaggtcatgtattgaattccaaccatattttggattctaagctctcaaatttgttgttgaccgtagagaaatgtgtttgttatttttctagacgtgtcctgccctgtcctgaggttttctatgtgttcaggagtcagggtccacagagtgccaactgtctgccccagtgtctgagaccattgcatctgagtaaacgcggagcttaaaatcctcacttccgacctgggtgtttgtggcgcacgcctttaatcccagcacttgggaggcagaggcaggtggatttctgagttcgaggccagcctggtctacaaagtgagttccaggacagccagggctacacagagaaaccctgtctcgaacaaaacaaaacaaacaaacaaacaaagtcctcactcacagcctggagagacggctcagcagtaagaacaccgactgctcttccagaggcccctcgtggcagctcacaaccatctgtaactcctgctccagggcctcagacgccctcttgtggtctctgtggacagcaggcacacacatggtatacaatgtaggcaagacactcacatacatacagaaaagtagacaagtctttaaaagtgcagcaaggcctggaatccaagctggccacaagcatgcccatcataacggatgccatacagccagccagagcatcctgagcacacaggcctgggcccaggtgggtcccacacagtttgtgggtgttcatctgcttgggccaagatggacttcatggattgctggggtttgtaggtccagcccagccagccgcttcttgggctaagtttgatgtgcaggccgtggccagccctgggtgacctcctccttccgttcctcctcattttctccctcctcttctttctctcttccctcatttcccacatacaggaaaacaccgacacttctgtccatttctcacgagtccctcatagtccccacccgtcccttgtctattcgaaacaccgctgggtctctgtggaaaggtagccttgcctctcaattctggtttcaaacaacagtactgatctctttaagggcttctttgagggtttcagggcagggaggggaatcttctgggtcatgtggattccagatgtgcgcagttggagttgccaggagtctctgagatgtccacaagaatcctgccccggggtctgcagagagaaggtcccccagaaatgattcggggagactggaggcagggtgtctgactttgagccagtgctgtccttggatctggtgagaagacctgggaacataaattgcacacttgaccctaccgggtgcaggtgtctgtgttccgtctggtgggactttcaagccgaggggaagggcttaccttatgacttctgaggctagagttcttgcctctgtcccctgatcctacagcccctgtgcttgcccgaaggaatgtcactacctctctcagaggctcagtttccttcacgacagcctggccctgaagtaactttctgaaggcatgtagagcccagcctgtccagcagagggcaccagggaccgcggattgcccagaggtagcagttgcctggtagggtccttcctaggggcttcagacacagtttggccacaggtgccctcattgaggacaacgcctgcctgcaggggtggctgaggctgtttggataagcggccaggctgaaaggccgaatgacgtataagcgtcttttcgttagtttctcaacggtttttcttaggtctctctctctctctctctctctctctctctggtcattatttttgattctgtcctcccctccccccgcgcccctccccccccgcgccctttctgggttttctttgccttgtgctgggtctctgggcgtgattttgggtgtttgtttgtttgtttgtttgtttttctgttctttcctcttctgttcccttctctcctttgcccttcgtctttcttccatttggatccaggagaacacaggaaacccttgtcacccacagaggtgcttgtggggggtgtggccgctaaaccatgcttactgtcttcccccaattcccccacttaccactggaaccatttagaactatgaccaccaggtggcgctgtgggcaaggctgtcttgagagggagcccctgcctgcttcagagttaagaggcaaggcagaggggtagtgggggccagggggtgttcaggagtcacttgaaggtagaaactgcccacatgcgtatgtcccgacgcctttgaagaaccagttgtgacattcagacctgacacagtgctcagtgacttggtgacactcttaccactctacagagggggaaaaaaaaaacccactcagttggcttaagggtcagatgagtagttccagatgcagttcccagtcagaggcaggggcattacatatgacaaacaggagccaccaaagccattggatttttttgttgttgttgttttttgttttgtttttgtttttgttttttgttttttgttttttcgagacagggtttctctgtgtagccctggctgtcctggaactcactctgtagaccaggttggcctcgaactcagaaatccgcctgcctctgcctcccaagtgctgggattaaatgcttgcgccaccaccgcccggtgccattgggttttatggactctctttcagatatgccacaggagggcctggctttattctgggaacccaagcagcagagaagaaagtggagaagaaagaactgaacgggcctgagctcatcactgggaagagaaagtgactttgttagtgtgagctctgcttctacgcgttcaagggtgactgctagtcttagcagcatcttgattggatctggggtcaactaagagatgcgtttgggtggatgggtgaaagtgttttcccgaaggactagcagatgggggaggagggaggccatcccccggaacggatggcaccttccaggatggcccagatatgaagagttctgaaggaaaggcaacactaattatcttacttaagatttctgtgcggtgatgaaacaccaggaccaaaaagcacgttggggaagaaagggtttattgggcttacacttccacagtgctgttcatcaccaaaggaagtcagggcaggacctcaaacagggcaagaacctggagacaggaggtgatgcaggggccatggaggggtgctgcttaccggcttgattttcttggcttgttctgtctgctttcttagaacctaggatcaccagcccagagatggcactacccacaatgggctgacacccccccccccattgatcactaattaagaaaatgccttacagctcgatctcaaggaggcatttcctcaagcgaggctcctaactttctgattagcttttgtcgagttgacacacaaaaccagcccatacattgctttagcctgtcctcactcactcttcactgatgagtgcatctacccagatgctgctgccgccgccgccgccaccatccttcactgagatcagaacctaggtcctttggccttccaatcaattccagatcgatgcccagcttctctctgggaatcctccaggtctttgggaccaggctgaggcatccagcctcactactgagtagctagcaggttcggagcctctcccaacagctacggttggactcagtcctgtgtaagtcaatccaattggtaaatccctttgtgacatatattcgttctgtaggcttttctctgaagaaccctgaaggacagtgtgggacactccttcccatatggcctcttgctctgacttcattatatttattcctctgtgtgtgtgtgtgtgtgtgcgcgcgcacgtgcgtgcgtgcatgtgcgtgcatgtgcacacacacgtgtgggagtcagttctttcctcttacttgtgagtcctggaagattggactctgattgtcaggcttggaggcgagtgcctttacccgctgagctgtctcgcctgtctgcatacctgcagttttagtttgctctgggacccacaaaagccgacattggtctcagacagaggcagaagccagtcacagggccctgcctctctggcgatgactggtagccatcaagtcacttttgaccaatgaaatgcatgggtgctgtgctggagaaactctggaaggttctttgctctgtggaggcttccaaggagcctgttttctcctccccgcccccttccttcctgctctaaccatcatctggccactccttcccacctctgccgccaccaccctatcgtggcttggaaggttcagggcctttgcataagctgctctctgcagacagttcccacgaatcctgaggttcctccctctggatctgtctcagattccctgtcggtgagggtcacagagctgtgtgggcatgcttctctgtcctcaccaagaatttgtctttctctgcttcccccggggccttccttaaatagtgactgagtgcagagctggcaggtcactccccaggcccttctttctctgctccagctcatctgtccccaaggctgaggatgagccaaagggcccaaggggacatctactcccagtgagcagatgaggtagatccagggtcctgttggggcctatgagacaccagggtatgggcattagctgaacacctactgtgtgctaggcatgcatggggcacatctcctcagcaaatgctcatgatcaccctacagggtccctgtggggaggaaggtaaggacagtgacagaagtcagcccacacctccatagctaaggagcctcacagttaagaactgggcccctggcacctgggtccagggccttggtcgtattccaggtctcccgccagagcagaatggacggtacaagatgacccaggacaccgtgcatttaaagctgtggagactgagggtggctgacaagcctcagtgacacttcaccttggcactgttcaggaaatgagaaccaggtagcctcaggaaatatgaccccaggtgctgagcatgacagagaggggtaatagagggctagcctctgcctggagcccatgaactctgcactggactttctaggctccggtttccgggccagcgtcttacttctgtgtgcctcaggttttctgtaccattctccctgggcctggtgcaggctggaggaggaggagtagtcatatgacaggagattctgtgaccaaaggtcctttgtcgcagctggaggtctgtactgtatctgcagggatcactggaggtgactaaagtcatcaggtgtgtggaagaaggccaccggggcaggcctggccttggggaggtctgaggggcgtttatacatagccctgattacacacagagactctccacccagagcccccagagaagcaccgtgaccccaccagaggtgaaccagtgggcttgcttcacttgggtgctacacttaggccagagatggcgtttggaggaggctaggctgagagcacatgagtggagatgttctgggccacacagaaccagggccagtgggcatcacctcctctcagtgggaacttcaggatcacggtcacgggaagtctgatgctatcctccccatgcaccacccccccccccccgctagatgtgacggctggagtttgagcctggcatgaagtagaaggtcctggattcaaatttcaccctcgttcttggctggcttcaggaaaggtaaggagttggccaacagagagaggagctgtgattttcagcaggccgagaccctgccccagccactgacaatgtcacaggctcagcatgctcctgccaccgttgctcctgtggcctggccaccatagacattgggaactttaggaagagagctgggcagttgcccacgagcctcattggcttgtgacagcttcttttgattagagagaatcctgttctgtcctgtactgcaacttcggaagattctgtgctgcaggggttgggggcagggggcggggctctgagcacatcacagcagttagtgaataaacagccttaccgtggacacatgcgaatatgtgtgagtgtgtgtgtgcatgtgtgctctgtctatactgctgccccaccgagctttgtcttctcaagtctcggtgctcatcactgcagctagtgacccatggcctcactggggacacatgtgcaagtgtgtggtgaatgtgtgtgcatgggagtgtgcacacgtgagggtgcatcttgggtatgggtgcatagtcctgtctgcaggacaagatttacggtctttcgtggctccctccaaattctcaggatcccctggccctcagaggtgtgatgatgcttctgtggatgtgtgtgactggctgcctcctgctcccgccattctgacatccccgcagtgacggagaggatcccaagaggatcccctgggattgttggctaacgtaaaccctttctgctctaggctgcttgtggtcaggacatttgatcacagcaacagacatgaaactagaacaaaggtcagctccgccgagaccagatcaaagcagtgtccagcccacaggacacagccaatatccgtgaaggagatgattgattgatggaacgattggtcgctctgtgggcaggggatgctggccacgaaggcagaaggagcccgtgtgggtccccagcactgctgttaaacagaacaaagcataaaaaaaaaaaaaaaagcagggtatagtgggtggagactggtgaatccccacagctcattggccagccacgtctgactgagctggtgagttccaggcttagtgacagagcctgtctcaaaaaacaaggtggaaatggatagaggtgacacttggcatcaacttctggcccccacatgctcagacactcgtgcacccgcatgtacctgttgtgcatttacctagaaacaggcactcacaaacacatgcatatcctacactcatacacatgtgtgcacataccctccatacacacagatgcatacaacacacacacacacacacacacacacaccctagaaaagctcactccgacactatgagtaggttcagctctaactctcctacctcacaccccacccatctctctcaaagcctcccgcatctgagaactgatgggaaatttatttatttattctgatgaatatgtattacttcttctcagacaagatatgcatgttttaataaggagcgtctagagacacgattcttaaatccagggacatcaccccaataacgagaatgtaaggcgatgatgagggtggtggggatacttagggccctgggaggcgttgaatcacacaacggctaaggcctccctagatctaggggaagggtccttggtactgggttggtaaggagttagacaggtcctcctctttgtggttaaacatcatgaagctgctgttaagttattcctatatgagacgacaaatctctggatcttggcccacacgtgtgtgcagaaggacccatgcctctcaaagatctgatgtcatcatatcctcactctggtaatgggtttgtcacgtccctatgggcttcttcagaggatcatgggaagaaatgccctaaaatggatttccaagggataacttactccatgaatatgctacctacttcatgaatattcatgaaagcatccttagcctccgtaacactgaaccgtggggcagccgctccggtgtgtctgtggtgtttgctttgatacataaacttctgctccagctgtctctgtctcttgactgaattctttccttcaagaagacattcccttaacactcttgggagcaacacaggggtggtgacatctgttcagctacctcccctgagactgcttccaggcaagttgtctctgtggctgagtttgctatggatgcttcacaggggtgtgatggataggtctgttattttctaagtgccaggccttgacccagcaaactgtgggaattatggaagtgtcacggaggagatatgcttgaattagagaaaaaaggaattccagaatgagtagctaagtcattaagggtgacgatttcacacacaggagagcttgcagatttcacgcacacgagtgctttcaactcatcccggagagctggctgctggtccgggtcagcggattctcagatccacagatcttcgcaggccccagtgggattattccccatttccagccactttgctccagtagcaatgccagagacagaaagagaaattgaggcctcctcccataactgctgtaagcaagccaggacacctctcagagcctccactgctgtcttcctctgtcccctcctcccgctgctccgtcctccgctgccccttcctcccactgatgtcttccactgccccttcttccctctgatgtcctcctcccactgctgtcttcctcttccccttcctcccattgctgtcc

SEQ ID NO: 392 - DNA, 4944 bp, Mus musculus
atggaggcacccggcagcggtggtggtgacggcggcggggacccaggcggggacggtgcgcatcccgatgctcgcggccccgtctccgggccgtgcgcggccgcccgcgactcggagcgccagctgcgcctccgtctgtgcgtactcaacgagatcctgggcaccgagcgcgactacgtgggcaccttgcgtttcctgcagtcggccttcctacagcggatccggcagaatgtggccgactctgtggagaagggcctcacagaagagaatgtcaaggtcctcttctccaacattgaggacatcctggaagtccataaggattttctggctgccctggagtactgcttacaccccgagcctcagtctcagcacgaacttgggaatgttttcttgaaatttaaggacaagttctgtgtgtatgaggagtactgcagcaaccacgagaaggccctgcgcctgttggtggagctcaacaaggtccctgctgtgcgtgccttcctcctgagctgcatgcttctggggggccggaagaccactgacatccctctggagggctacctgctgtccccgatccagagaatctgcaagtacccgctcctgctcaaggagttggccaagaggacccccggcaagcaccctgaccacaccgcggtacagagtgccctgcaggccatgaagactgtctgctccaacatcaatgagactaagaggcagatggagaagctggaggccctggagcagctgcagtctcacattgaaggctgggagggctccaacctcacagacatctgcaccgagctcctccttcagggcaacctgctgaagatctctgcgggcaacatccaagagagagccttcttcctctttgacaacctgcttgtctactgcaagcggaagtctagggtcactgggagcaagaaatctaccaaaaggaccaagtccatcaacggctccctgtacatctttaggggtcggatcaacactgaggtcatggaagtggagaatgtggaggatgggacagccgattaccacagcaatggctacactgtcaccaatggctggaagatccacaacaccgccaaaaacaagtggttcgtgtgtatggccaagacggcggaggagaaacagaagtggctggatgccctgatccgagagcgggagcagcgagagagcctgaagctgggcatggagcgtgacgcgtacgtcatgattgcggagaagggggagaagctgtatcacatgatgatgagcaagaaggtgaacttgatcaaggaccgccggcggaagctgagcaccgtccccaagtgcttccttggcaatgagtttgttgcctggctcctggaaattggtgagatcagcaagacggaagaaggcgtcaacttgggccaagccctgctggagaatggtatcatccaccatgtctctgacaagcaccagttcaagaacgagcaggtgatgtaccgcttccgctacgacgacggcacttacaaagcgcgcagcgagctggaggatatcatgtccaagggcgtgagactctactgccggctgcacagcctgtacgcccctgtgatcaaggaccgtgattaccacctgaagacctacaagtccgtggtccccgggagcaagctggtagactggctactggcacagggggactgccagacacgggaggaggccgtggcgcttggtgtgggcctgtgcaacaatggttttatgcaccatgttctggagaagagcgagttcaaggatgagtcccagtacttccgcttccatgctgatgaggagatggaggggaccagcagcaagaacaaacagcttcgcaatgacttcaagctggtggagaacatcctggcaaagcgactgctgatcccgccacaggaggacgactatggcttcgaccttgaggagaagaacaaggctgtggtagtgaagtctgtgcagaggggctcgctggctgagatggctggcctgcaggctgggaggaagatttactccatcaacgaggacctggtgttcctgcgtcccttctctgaggtggagactatcctcaaccagttcttctgctcccgccgcccgctccgcctcctggtggccaccaaggccaaagagaccatcaaagtccctgaccacccagaggccctgtccttccagattcgaggaacagccccgccgtgtgtctttgctgtgggcagaggctctgaggctgtggctgccgggctctgcgcgggccaatgcatcctgaaagtcaacggcaccagcgtggcgaatgatggcgccctggaggttctcgagcacttccaggctttccgcaaccacagggaggaggccctggtgagcactgagcggaagggtctttaccagtgggtctaccacagccacgaggatgcccagctggcacgagccagccagggtgcccctgatgaggacccccaggaagatgaccagcctgactcagccctgcccctgctgtccctgggtccccagctgagtctgcatgaggacagcgctgtggtcagcctgacgctggacaatgttcacttggagcacggtgtggtttacgaatatatgagcactgcaggagccaagtgtcacgtgctggagaagatcgtggagccccgaggctgtttccgccttgctgccaagatccttgaggcctttgctgtggacgacagcatcttcgtgcagaactgtgggcggctcatggccatgagcagtgccattgtcaccatgtcccactacgagttccataacatctgtgacaccaagctggagagcatcggccagaggatcgcctgctaccaggagtttgcagcccagctgaagagtagggtcagcccccccttcaagcaggcacccctggagccccacccgctgtgtggccttgacttctgccccaccaactgtcacgtcaacctcatggaagtgtcctaccccaagaccacaccttcggtgggcaggtccttcagcatccgcttcggacgcaaaccctccctcatcggccttgacccagaacaaggactgaaccccatggcctatacccagcactgtatcaccaccatggctgccccgtcctggaagtgctcacctgctgtagacgaggactcccaaggccagggtctcaatgacagcagctatgggtcagccagtggtgccccgagccagcaagaccgcggcctgagctttctgctcaaacaggaagaccgtgagatccaggacgcatacctgcagctcttcactaagctggacgtggccctcaaggagatgaagcagtatgtcacccagattaacaggctgctgtcaaccatcacagagcccacatcagctgcccctgcgccctgtgacccatccttggtggaggagacctcatcttccccaccggtcagtgaggagagtgaagtggaccggactgaccacagcggcatcaagaaagtgtgcttcaaggtgtcggaggacgagcaggaagactcgggccacgacaccatgagctaccgcgactcctacagtgagtgtaacagcaatcgggactctgtcctgtcctacaccagcgtgagaagcaacagttcgtacctgggtagtgacgagatgggctcaggggatgagctgccctgtgacatgcgcatcccgtccgacaagcaggacaaacttcacggctgcctggaacatctctttaaccaggtcgattccatccatgccctgctcaaggggcctgtgatgagcagggcatttgaggagaccaggcatttccccatgaagcacagctggcaagagttcaaacagaaagaggaatgcacggtccgagggcggaacttgattcagatcagtatccaggaggacccttggaacctgcccagctccatcaggaccctggtggacaacatccagcaatacgtggaagatggaaagaaccagctgcttctggctctgctcaagtgcacagacacggagctgcagctgcgcagggatgctgtcttctgtcaggctctggtggccgccgtgtgcactttctcggagcagctgctggccgcccttgactaccgctacaacaacaacggcgagtatgaagagagcagcagagatgccagccgcaagtggctggagcaggtggcggctacaggtgtcctgctgcactggcagtctctgctggcaccagcctccgtgaaggaggaacggaccatgctggaggacatctgggtgacgctgtcggagctggacaatgtcaccttctcctttaagcagctggatgagaattctgtggccaacaccaatgtcttctaccacatcgagggcagtaggcaggcactgaaggtagtcttctacctcgatggcttccacttctccaggctgccctctcgcctagagggtggggccagcctcaggctgcacacggtgctcttcacaaaagcactggagagcgtggaagggcccccgccccctggaaaccaggcagcagaagagctgcagcaggagatcaacgcacagtccctggagaaggtgcagcagtactatagaaagctcagggcgttctacctggagcggtccaacctgcccacggatgctggcgccacagctgtgaagattgaccagctgattcgtcccatcaatgccctggatgagctctaccgcctcatgaagaccttcgtgcaccccaaagcgggcgctgctgggagcctgggtgccggtctcatccccgtctcctccgagctctgctatcgcctgggggcgtgtcagatcaccatgtgtggcaccggcatgcagcggagcaccctgagcgtgtccttggaacaagcagccatcttggcacggagtcacggcctgttgcccaagtgtgtcatgcaggccacagacatcatgcgcaagcagggcccccgagtggagattctggccaaaaacctccgcatcaaggaccccatgccccaaggtgcaccacgcctctaccagctctgc

SEQ ID NO: 393 - protein, 1648 aa, Mus musculus
MEAPGSGGGDGGGDPGGDGAHPDARGPVSGPCAAARDSERQLRLRLCVLNEILGTERDYVGTLRFLQSAFLQRIRQNVADSVEKGLTEENVKVLFSNIEDILEVHKDFLAALEYCLHPEPQSQHELGNVFLKFKDKFCVYEEYCSNHEKALRLLVELNKVPAVRAFLLSCMLLGGRKTTDIPLEGYLLSPIQRICKYPLLLKELAKRTPGKHPDHTAVQSALQAMKTVCSNINETKRQMEKLEALEQLQSHIEGWEGSNLTDICTELLLQGNLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDALIREREQRESLKLGMERDAYVMIAEKGEKLYHMMMSKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYAPVIKDRDYHLKTYKSVVPGSKLVDWLLAQGDCQTREEAVALGVGLCNNGFMHHVLEKSEFKDESQYFRFHADEEMEGTSSKNKQLRNDFKLVENILAKRLLIPPQEDDYGFDLEEKNKAVVVKSVQRGSLAEMAGLQAGRKIYSINEDLVFLRPFSEVETILNQFFCSRRPLRLLVATKAKETIKVPDHPEALSFQIRGTAPPCVFAVGRGSEAVAAGLCAGQCILKVNGTSVANDGALEVLEHFQAFRNHREEALVSTERKGLYQWVYHSHEDAQLARASQGAPDEDPQEDDQPDSALPLLSLGPQLSLHEDSAVVSLTLDNVHLEHGVVYEYMSTAGAKCHVLEKIVEPRGCFRLAAKILEAFAVDDSIFVQNCGRLMAMSSAIVTMSHYEFHNICDTKLESIGQRIACYQEFAAQLKSRVSPPFKQAPLEPHPLCGLDFCPTNCHVNLMEVSYPKTTPSVGRSFSIRFGRKPSLIGLDPEQGLNPMAYTQHCITTMAAPSWKCSPAVDEDSQGQGLNDSSYGSASGAPSQQDRGLSFLLKQEDREIQDAYLQLFTKLDVALKEMKQYVTQINRLLSTITEPTSAAPAPCDPSLVEETSSSPPVSEESEVDRTDHSGIKKVCFKVSEDEQEDSGHDTMSYRDSYSECNSNRDSVLSYTSVRSNSSYLGSDEMGSGDELPCDMRIPSDKQDKLHGCLEHLFNQVDSIHALLKGPVMSRAFEETRHFPMKHSWQEFKQKEECTVRGRNLIQISIQEDPWNLPSSIRTLVDNIQQYVEDGKNQLLLALLKCTDTELQLRRDAVFCQALVAAVCTFSEQLLAALDYRYNNNGEYEESSRDASRKWLEQVAATGVLLHWQSLLAPASVKEERTMLEDIWVTLSELDNVTFSFKQLDENSVANTNVFYHIEGSRQALKVVFYLDGFHFSRLPSRLEGGASLRLHTVLFTKALESVEGPPPPGNQAAEELQQEINAQSLEKVQQYYRKLRAFYLERSNLPTDAGATAVKIDQLIRPINALDELYRLMKTFVHPKAGAAGSLGAGLIPVSSELCYRLGACQITMCGTGMQRSTLSVSLEQAAILARSHGLLPKCVMQATDIMRKQGPRVEILAKNLRIKDPMPQGAPRLYQLC

SEQ ID NO: 394 - DNA, 223556 bp, Homo sapiens
gcagacaattttatcacccagatactaagcctagtaccaaatagttattttttctgctcctctccctcctcccaatcttcaccctcaagtaggccctagtgtctgttgctcccctctgcgtccatgagttctcgtcatttagctcctgcttataagtgagaacgtgaggtatttggttttctgttcctgctttagattgctaaggataatggcctacagctccgtccacgttcctgccaaggacatgatcttgttattttttatggcttcatggtattcatggcgtaaatgtgccacattgtctttatccagtctgccactgatgggcattcaggttgattccatgtccttgctattgtgaacagtgctgaaatgaacatacgtgtgtatgtgtctttatggtagaatgatttatattcctttgggtagtacccagtaacagcattgctgggtctaatggtagttctgtttttaggtctttgaggaatcgccacactgcttcccacagtggttaaactaatttacactcccaccagcagtgcataagcattcccttttcttcgcaacctcagggcatctgtgatttttttggctttttagtaatagtcattctgattagtgtgagatgatatctcactggccactacttctctttggttttctctgaatctatgtaagtattttcctatgcttcagtttcacatttctgaaagattaaggttagatggtgggggaaggaactccttttcactttttctagcagtttggggtctgtaagttctttttatgtcgctgtgtccctcagagagctggcagagcgaggttcttttttttttttttttttttttttggagacagagtctcactctgtcgcccaggtggagtgcagtggtgcgatctcgctccacctcctgggttcaagcgattttcctgccttagcctccagagtagtggggattacaagtgtgtgccaccacgacctactaatttttgtatttttagtagagatggagttttgccaggttgaccaggttggtctcgaactcctgacctcaagtgatcttcccaccatggcctcccaaagtgctaggattacaggcgtgagccaccgcacccagccagagtggggttcttaatgtcctcatttaacaaaataagaaattggggctcagggctctggaggagatgacagagccatggttgtgccactgcactccagactttgccctctgtctatttcacgagggaaaatgagatcacaggagagtccattgctatgtctagtcttaaaggagtcagggaacacctgtggacaattggaactgtccctcacccctgttccagcctccattcactggctgcctcattctgaatgctggtgtgacccagacctctgtccttgtcctggtctccatccacataccctccctgggtgatctcgcccagccccaaggctttaactatcacttatatcctgacaatggctacatttctatctccagcctgacctctccctggaacctcaggattgtggatgtgactgcccactcaacatctgacttgggtatttaatttgacattgaacatggccaaaaccaaacgctccatcttctccaccaaagcagcaccccaccgacccctgccatctttcccatcgtggttaatgccaactccaaaaatcatagattataggcgtgagccactaatagagtcgagtcgtgtttaactctatttcactctatttcacccctagatcctctgcaaatcctgctggctccatctttagagcatatccagaatcaactgtttctctccatctcctctggtatcaccctggcccaagtcatcaatgtctcttgcctggactagtgcagtatcctcctcataggtcttactgcttctgacctcaccctgctcttagtttacttcccatagagctgtcagagggattctattagaacctaagttaggtcatagctctcctctgtttagctcccagttcatccaaagaaaaagccaaagtcctatggtcaactatatggctcatacatctggttttcctctcctttctagatgcatctcaactacccttcccccttgctgttccttgaacaagtggacacactcctacctccaagcctttgcacctgctgttcctgctgcccggaacacaggtggggcccactccctcacttctttcagttctttgcttaaatgtcaccttctcagggaggccttctctcatcccctccaggcatgtgctggccccagtgctccctgttgtttaatccattttgtttttctccgtaactcttaccatgatctggctgactctgtcaacttattgggggtctttatttattgtctcttctgtccctagaacgtaagcaacaggaggacacagagttttgctttattcactattctagtcccagtacctagaacagtcccaggcattcacggtgaggtttctctcaacctggagtccaaaacatatactggagatattgattcattcaatgattatttacacatgcctggtgctgtttcagcgcaaggaaacaagattcccacagcccacctgcaacacctgggcagtggcttggcatggcttggcaaagaatcacagagccatctgggtggcaagatctggccagtagggtgggagcagaagtgatgtataaaacttccagctcagggccaggcacagtggctcacgcctgtaatcccagcactttgggaggctgaggctggtgtcagctgaggtcaggagttcgagaccagcctggccaacatggtgaaaccccatctctactaaaaagacaaaaattacctgggcgtggtggcaggtgcctgtaatccaacagtgccttgcacagagtgagcactcaaaaaatgggtgtggtgcctcacacctgtaatcccagcactttgggaggctgaggtgggaggactgcttgaggccaggagttcaagaccagcctgggcaacatagtgggatccccatctctacaaaaaaaataaaattagccagttctggtggcatatgcctggggtcccagctacttaggaggtggagatgggaggagtgtttgagcctggaaggttgaggctgcagtgagctgtgattgtgccactgcactctagcctgggtgacaagagtgagaccctatctcaaaaaaaaaaggctcaggaatggaatttgccctggaaatttggaaggcaggctgcggcttaaatggcatttggagagggtgtggctgtttgtgtttctgccggctacagaggaaaccatcagctttcagtaaaagttaccactggggttgccaggtgtctggatttggactgggcagctttatttttgagctttcagttctgggaaaaaaaaaataacccagacatataaatgtgtgtccagtatgtctgttgaaaccatctggcattcctggctgcaaaatttcaagatatttcctccaggtcgatctctggccttgacgaaattgcagaatttaccttctatgtatcagtctctttctgaacccttttctcaacttttactcccaatccagccttcacgttataaaccttaggtctctgctccattaggaaagcaatagggtgaagaccagcacccttctgaggcatttgcattttttttttttttgagactgagtctcgctctgtcgcccaggctggaatgcagtggcgctatctcggctcactggctcactgcaatctccgcctcccgggttcacgccattctccgcctcagcttctgagtagctgggactacaggtgctcgccaccaggaccggctaatattttgtatttttagtaaagatggggtttcaccgtgttagccaggatggtctcaatttcctcacctcgctatccgcccgtctcggcctcccaaagtgctgggattacaggtgtgagccaccgcgcccggctggcatttgcattttaaaagtagcaagaagtcaggtcaatgcttatttgaaaggatagggtcggccaggcgccgtgctcatgcctgtaatcccagcattttgggaggtcgaggcggatggatcacctgagatcaggagtttgagaccagcctggccaacatggtgaaatcttgtctctactaaaaacacaaaaattagctgggcgtggtggcgggcacctgtaatcccagatacttgggaggctgaggcaggagaatcacttgaacccaggaggctgaggttgcagtgagccgagatcgcggcattgcattccactctgggcaacagaatgagactccatctcaaaaaaaaaaaaaaagaaagaaaagatagggtgaccataaggtccaaaatgggatgttatacattttattatcttttaatacaagaagtctagaggcagggtggttccatggttggttaattcaggatctcagtgacatcaaagatccagattctttccatctgtcattttgcaccttcagttagttagaagtgtcctatctcagggtctcaagatggctgtcatagctccagacatcatggcttcatccacttacaatagcaaacacccatccaaggatcgggcagcatactatgcactttggatctattaaatattttaacctgcacaacaacgctgtgaggtagaagctcttactgaccccattttacagatatggatattgaagcccagagaggttaagtcacttacacaaagtgacacaattaggaagcagtgggactgggatttgaagctgagaagctggtctctggtgctacaacaatgtccaaaggctggagaagaagtcgtgcatgttggtggcagagtgggattggaactgagggtcctagatgttttcctttctgcttcctcaaagcagtgtctccaatgcctcctggcaaaagtatgatttggcaaagctgtggagccctgacttaattggatacctattatgcttaaatcagaccttgaaccagagccccctggagaatgtgcttccaacagcaaggcttcccttagagacgttttgacttgggcagctgggggtagctcaactactaggaagacgattatattttggtgggaagaagtgaaccctgggctgtgtgtccagcgttgatttgagttgtccagctgctctaattccaagggtggagaggcctccctcttcttctcagacagctgctcttggttctcagaatgaggaacagccctgctctgggctgctggtctgacttttgagaactcatttgcatttgggaaatgatggcaccctcgggcagtgcagtaactcacttctcaattggctcattcaacttgggatgggaaagaaaatcacttgtttttccttgctttaacttaattagttttccttttaaacagagcttgggaagggggccttcaaatcctcagcctgcagaagctgacaggggcttgtcagggaataagaaactctgatgtttccaagcagcagaatcttctccccctcaactgtgaaacttatgtaacagaaacgaaatggtatttcccactatttgcaaagtacatggcaacggaaactctaaaattgtccctgcaaaagagaatttccctatcattatcatcactttttttttcttccccctgaactgcaattttttttttttcttcttcctccctgttctttttgagaacgttacccagctgccggctgtttcaggccctgccctgacatacacatgagacagataggctccccactagatattccggacgggtgatggggaagaagggaatagaggtcaaagttgaaatggggataggaagagatctactccagcctgactgcttagtcatgtttggtttagggagttgcctatgccaggattagctgggaggcagccaggttttgaagagagggagtccccactgatcccgccaaggctgaggcccctggctgaatcctgatggctgaatcatgacactggggtagtgacctgaggcagagtcctggaggtgccaccaaccaatggtgcttccccaggcccatcccttgcaggccttagagaagctgaaaggaccttgtttatttattgtccttctctccctgctcttgactggacacaccaggaagccagggaccttatctgttctgttcactgctgtatccctgcctggagcataggaggccctcagtatataatagttgaatgcatgagaggaggaacttgtcttcatcctcacctatcccccttgctggaataatgccggcagcacaagggcctcagctgttggggtgctcagtgctgcagcctcaggaccccgcccaatgcccagtgtgtagtagatgcttgtgaccgacacttatagatgcccaccatgctagctcctcttctctcttgacaacagatctccaagttgtctgggcagccttgtgccaggggacgaagcaggtcttttctaagttgatggtggcaatctatgccctcggtcagggacttttcaagggtgaccatggcttctagtgctgacctgctgggagcttaagtttattcccccaaagagagaagcacagaggagacagagtcttcttcgtacttttctttccttcattggaggtgtgtgaggaggcaatgttgctgtttcagcagccattttgtgcctctgaggccctaaagcttgggaggaaaagccaccatgctgaggataggagggtcaaaggtgccatgatccttgatgacatcatgaagtcctacaccagcctcaggaaccaactgcctctggacctcttgctaaataatgtccttatgctttaagctatcaatagcccagttttcttctccttgcagccaaatgcatcctattagattcagcactcaatccacgcattgtaaaagacttcacttattgagcacctactgtgtgctctaagcaccctccatgtatgcactcaggaaccttgcaacgactttatgatgtaggtactgatattattcttagttcacagatgaggaaagcaaggcacagagagcttaagtatgttactaaacgctgtattatcttttagtgtcatcattaccactggggatggggatggaaggggaaaaagatcccagcagaatctgaggaagtaacgatgtataaaacattggggtgggccagagatgggacccatccacaacgtggaaatgttttttggcagtgtgggccaattcttgggtgaaatgtgggatttgtgtgtaaacttgaggctaaccttccttggtcatgggctgagaagggaactaacatttgttgagcacctactctgtgccagctatgtgtgtcaggtactttacatcagtggttctcaacagggggcaattctgtccccagggatatctggcaatgtctggagacactttttctgtttatttttgaggcaaggcttactctgttgtccaggttggagtgcagtggtgtgatcacagcttacttgcagccctgacctcctgggctcaagcaagctccccacctcagcccagcagctggtactacaggtgtgtgccaccatgcccagctaatttttaaaatttttttgtagagacagggtcttgctatgttgcccaggctggtcttgaacttctgggatcaaacaatcctcccacttggacctcctaaaattctgggattagaggccggagccactgtgcccagcctggagacatttttgattctcagattggggagggagtgctactggcatctagtgggtaggggacgcggctaaatgtcctgaaatgcacaggacacgcccctcccccaacaaagagttatgtgactccaaatgtcaatagtcccaaggttgagaaagtctgtattgcatagaattcgctctcacaaagactccccttttacagattagacgactgaggcccagagaaataacgtgtcttggccaaggttaccctgccagttggatttggactgggatacaaatgcaagcccgcttcattccatggtccattatgttccagccatgttctcccctcgtggtagacagaattaatttaaagatgaggaaacggaggctcagaaaggtaccgtgaacagtttaaagtcacaaagcagagatactccagaggcctttattaggaataaaaatataaataaaaaaccagctacctttggacacaattgactccactacccaagcgtgacaggctcacctatctcatgtcctttactccctgcccaggggaacttcactcagcccaaggcccagatcaaatgctaccttgcccatgatcccaaagaaagaagtcagagagggcagaagccaccccattctctccctgtgtccttaggcacttacagtattgagaggccaatgggaggaaaatcctaggcttttggaacaggaataaataagcaatgtttctgtccataaaatgactacagtctagaggcggatactatgtggatcactttatcccctgcagagacgatacaatctctggtccggaaacacgggtgattagggattgtatgggccatttgagagtggggccaggcttagagggccgttcacacatgcaataatagtaagaacaaacatttacagagaactttctaggtgttgggcttcacacatgcaataatagtaagaacaaacatttacagagaactttctaggtgctaagtacttcccatggaaccccggggaggaccttggagctaggtaccatgatcgttcccgttatactgatgaaaacactgaggatcttgaagcaaggaaaccagcccaaggccacccggccagcaagtggggagctaggatttgaacctgagcagctgactctaggccccagaacttcctcccctctccataccttccgataaggcgggtgatgatcaacattgcccagagcaacctgacaagaagctgggtttcccaaggccttatcccatggggtgggtggatggaagggggagcaggcagggtacctgccacttgatcaataactcaagagcaggtaataatttcttctgggaaaggtggaaagggcagggtcagggggcaaagaagttcagaaagaaaaggaaggaaggaaagagagagatgggaaaggaaacgggaaagagaaaagtgagagcgagcgcgcgccacgcatgttccttcccaaggtcgtggtagcaccgagggcaccgcgagggcccggcgttcccgggaggggccgtcactgcccagagaggggccgtcactgcccaggcagcggtcgcccctgacttcccggggccgcggaggcgcgcgtggcggggctggcttgcccccgagcggctccgcagcgagctttcccagcccggtgtttacttggcccgagcagcggccggacctgcaagcaggagcctgcgcgcggcgggtgtcgcgtgtgccgggtgggagtggcgtagcccgcggtgactgcgggttgggggggcgccacgcgtccgggcgcggagttggtacgctcggttcggcgtgcgcgcggcctcggactcccggctccgcggggcccttccggaggctcccgcccgacccccgagcttccgacggaggcgccgagcgccgcgccgcgtccccaggggccccgtgcacgcgcagagcgcctctgcggccgagcgcggcgtggcacttggcagacggtccctggcgcgggggcggggggccagccgtctgggagccccgagggccgccccctcccgcccctcgcccggcccccgcgcgctgcctccgcccccggcccagccgcccggcccccagtcccgcccgccgcgccgggagcccggcccgccgctgagcccggcccgccggcgcgccccgtccgggatggggcgcctggacgcctgagttgccgctcggcgcgacggaaggagccggcgccgcgcggccgcgctagaatggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggtgagtgtcgctcgggagcttggggacagctttccctccagccgctcgccccgctgcggtccccacaacctgtggccgtggtccccgtgggtggagaattgcctcgggggcgccccgcagggcgcgcggaaagcgggggggatccgagctcctccagagctgtcgcgtcgcctccctccctggccggcgcacggtcctgctccgaccggggctctcccgcactccacttccccgcggcgcgcgctgcccttttgtcttttcttccccgtccccgcctttcaaatagttttaaaattagttacatccgcgatgcaggggcttggggaccccggcggcgccgggagctggcgctcctgcgtctttttcccaggaataactacgcgcccggtgcaccactcatctaggacataccgtaggagccccagagcccaacgtccctgcgcgttgatggagtaggataaaacctgaagctcagaggaggggcggggattgacagaaccccagggtagaatcccccatgcacaggtttttgctggagttcggggagagtgggtttcgaactcaaaactcggcagtccaggctccctaactgcatccacccccaccaactccccatctccaagtgcaaaaccacggcctcagactttgtaaaataacaaccgaccacttactatgtgccagacaccttacatgtgtcattaattagcaggtttaaccttcacaggcggtctatgaagtagggacgagtatttcccccatttttaattaaaaaaatttttttttgagacggagtctccctcagtcacccaggctggagtacagtggcgcaatctcggttcactgcaacctccgcctcccgggttcaagcaattctcttgcctcagcctcccgagtagctgggattacaggcacgcgccagccaccacggccgactaatttttgtatttttatcagagaggggatttcaccatgttggccatgctggtcttggactcctggcctcaagtgatccgccgacctcggcctccaaagtgcagggattacaggcgtgagctactgggtcctgcctcctccgtttttaagattgggaaagtttagctccagaggggccgggtagcttgtctgggatcgcacagctgattaagtgggggtactgggctttgaaccgggactatcccagctggtgttctaaacccctattctatgctgcatttttcttttgctttttttctgtgagagggaggaaggggccacttccctactctcctaggaagtgagaaaagtggccagcgggtggagggggtgggacggggcagagccttggatggaagttaggagactctaaagtctttaatctccatgcctcctgctggggcctcatttactccccttctctgctctaggaagtcttttaatcctggttcaggaagggctggtgtgggggtggctctttcaaagaccctagagccaggctttgtagctcctagtctttgggagaaagagggagactctggggtcctctggggctcctcatggcttaggggtgcagctgaggctgtgtgagatcagagttccagctcagggaggagacagccttagactagagcccttctgcctgtgaaaggagatgtactgggggcagggggatgtgggagagggggttgtgcagaagcattgaaaaccatttggctaaaggacccttctaggaaggcctgtaagaataaggcaggattggctttctttcccatcccttcttctctcacagtttcgggggtggggggtgggggaagaatttgttctgttagaagctggcagtttttgaattaaacatgtagacaaccctggtgtctctgagcaatgtcaaattctagggaactcctgacttctccttctgagccactccatgctcctctgcttggaagagaaacaggaaatacaaaccaattttgatattaatgggaaagaaaatatacctctccctcccacgcccctgccctagatggtgtgtttcattttagaacagatctagattgtgtttgagttaactgtggttttaaatcgtccacgtgtagagtaggaggaagctggaataatggaaattgattggagccaaccattcttattattcaagaaacaggaaaaaaaaagatttctctactttcacattatctccttaacactttacatttgctgacttcatcacatttttctttttgtatctgatgtgtcagttctgagatgaattggttctgacttggacatgtgtcttggaccaatcatgctacgtgtcctgacttcagtttccccacctgtgaaacaaggagcggggaatccgggcttcctttctgcctgggccttttgtgtgtccccaagctggtgccagaaacagacggattgtgtaacctgaccagccatacgttgtttgtgagccacaggagtcctctctcatcttggcccgtcaggaatggcccctaaacatcccaaggcattttcgttttcaaaactaacctggggcttagagcttcaggaactgctaattaccaaggctttccatggttgcaaggctggcagcctcaggttgtgattctcttctgtcttcccactctctcttctcagcctttatatttgctaagggattttccctgctgtctcctggcttggaagaatgcacggtaatccctccctgcttttatttccatgtggttagaggcaggccttaaaggaccaccctggtctccgtgtgtccttggtgtgaaggtcccatcggcccatggaaaccgtggaaagtaacccccgtgataggggccatgtgtggcttctgtcctcaaggagaggacggtgtagtggaggatggccaaatgggtgtttaaaaaaaacaatccaagtgcaaggctctggagccagactgcttgaggttaaatccttggacttgtgaccttgggcaaacaccttaacctgtttgagccttatttgtaaaaagagggatgttaataggtcctattttataggtttttaaagaagataagtgagttatagaaattgatgtaaagcacttagaacagtgtctggcagtaaggtatataaatattggttattattgttgttgtaggaaaattaaataatacagataattagggttgtgggacttcagcatccagagagcaggggtgatcagagagggcttcctggaggaagtgaggtctgagttaagtcagcactgagaggaggatgggggctctgagtgagtttccttttgacaccctaaactccggccacaggaaccagtggttttgtttggttccaggccgagggctttgtggttccttgagaatcttcccatctttccccatctccttcaggaactgggttgcactccctccctcatctccagggagtcctctgagtttggtgttttgcgtgtgtttattaaataatcatgaaaaggcaaggacagccctttcacagagatgctggatcggtcttgggggaaacagtgcctggggttttgactcagaaccttggctcgaatcatttcgaggccctggctatgtggggtactccccgtgtgctctgggcagcgttagtcatgatgaaaacaatgacagtcattgctgtgcaggaactgactttgattcatcacttgccattctaagcactttgcatgtgtcaactcatttaattttctttatgaaggggatgctgtttttatccccattgagaggtgaggaaactgaggcaaagtgaatctaagtgagctgctctgggtcaggtggacagcattgccaggatttgatcctaggctgcctgaccccacaactcatgtccccagccacttgatagaccgcctttggctgatccaagaagggcttggcacatgatttattaaggtggcagaactgggatttgaacccaggtctgtgtgatgtttcacctccgcctgcgcttcctcctgttacttgccctctgtgactcccattcttttctccacagaatgggaagaactgtggacggatagaaatggcaggctgccgagttcttgctctgggctccgggtctgttcatggcacgagggttgagtgaggctctggagtcatgctgctggtgttcaaatccaggcttcttccacttggactgtaggtgaccttgggctgatcactgacttgctctgtgcctcagtttccacatctgtccaacgggcacagtgtagcacctgcgtcacagggatgtggtgaagcttgccccccactcccctagaggaggctgagtagaccttgggcccacctgccaaggggaggcacctcaggggcaggtgccagtaactcccatgatggggtgtgtcagctgggcagtggtcgaaagagaagagagggcctgggtgggtgggcagagaggccggtgggtgggagttggtcagcagctcctcgaaggtctccccgtggctgaggacagagagctatagagacacagagggtctgcccggaaccgaccaggatgggagtctctgaggaacagggattgtgggcagaaagctcccagaatgctttctgtggttctgctttttggagggaggagacaaaagtttttcttctcattggagctccgcttgccaaacaagaaactgtggttttttgttgtcactatttttttttctgttttaaaagattctgtactcctagtctcacactagggagaaatgccacgggtggttggggtgggggcaggtctttgatttcacagtcattgaggcagagggacctccccagtaacttggggggattttcacgtggtcctcatatgaaaagtaggatgctgagaggtatatgtaacacagttcttttggaaaataaacaataaccataatatacacgtgtgttatatgtataaggtgacattaggttggagaaaaggatggaaggatgtgtatcttttacagaaaggcaaccaggaagataaggaagtaaaatcctgtttataatacccttttcatataaaattatgcatatgtatgcgaatatattttttaagaagccgacaggaagaattgtattttcaacatggttattagattaatgcaacagtaataatggtaacaatttgctaatatttatatacttgcaagccctgtttataagttccttaagcattaactcaaaagttgcaggtattcttatgcttcctgttttacaaatgaaacaaagacacagagaggccaagtcagtttcccaaggtcacacagcctgacagaactggcacttggacccaggtaatgcggctgcatggcccacattcttcaccactatcctgaattgcaccaaaatgaggctgtgttcatgagcaaaattactgcccctgtgagacctctgggctgcccaggtgggcaagaattaagtcaaaaagtccaccttatttcagttttcagatgccggagagcctggaacaggccaccttgtgttgggctcatcatcatcaggaagtcagtgaaaatcttttgatggtaaaaactgagtgtcagcaggatttagatgggttacattttttttaatgtatggcagacagagagctctgtacagataaaaccatgaagatatgagactgcttttctctgtgtgcaggtatttatggagcatctgctgtatatcctgggcagtgttctgggccacgagaatgaagtcatcaacaggtcgttgtccttataagaaggacaaccctgtggggattctacaactcattcttcagacaaaccttctggaagcctacctacttttattctggtgtttgccctggtagcaatttaactgtcactttaagaagacgcgaatggggttggtgtctctggcttttgagacttcagggcacccctttcttggagagaaagatactcctttatcaggccagagagctgaagacctgttgggcttggggccactccctttaataaagaaacccacatcctatttgcttcacagccgctctcccttaaaggttttgcaagagtttaagtgtttgaagcaggtcatgcctggctgcaggagaacctgacctctccagatttttggggcttttctttttttccaacagacacaggcatgctggctagaatactggagggaggtgggtgatagggtgggctgcccctcaaacctgtgtgctgtgtcccacagcatcattccccagacatggggccaggtcggagctgattcctgccctgcgtttcggagatcttgaacagaagccaggtgggtcattcggtctgaatctccttgttttgcaggtgacataaattgcgtccccagaggggaggtgagcaccagttaagggcagtagccactcagtttgttagagttccatccccagatacctgggaagagagcttggtggcccacatccttttctggggatctgtgttttagccaggatcaaaaatccccccgtttttttttaagatggagtcttgtactgtcgcccagtctggagtgcagtggcgtgatcttggctcacttcaacctctgcctcccgggttcaagcgattctcttgcctcatcctcccgaatagctgggactacaggcacgtgccaccatgcccggctactttttgtatttttttagtagagacagggtttcaccatgttgaccaggctggtattgaactcctgacctcaagtgttctgcccgccttggcctcccacagtgctgggattataggcgtgagccaccatgcccggccaaaagtccctcttgaagaggtttcacggggtcatttctggccctagcgttggtctggagcaaatcccactagtctctcagccttcagcactgtcgacatacggggctggaccattctttgctgtgggggtgctgtcctgtgcattgtaagatgtttagcagcatcgctggcctctacctaccagatgccagtaggacccctcttccccagttgtgacaaccacagatgtctccagatattccaggtatccactagaggtggttgggtgtgaaaaatagcccccagttgagaaccactgggctaaaagctcctttgactaccacctgtgctctcagatcgtgtgggggcattagcatgcctgtgtggaaatacgtgagattgatgtgtttatgtaagtagcataatacggtttgcccttttcacccagcagagtgtctgggaggctccctctcttgcggttcatggtttagagcacagactctcgagccaccttgcctgggttcagatcccagctcttcccctgtgtgaccttggggatgttgctttgcctctctgagtcctggtttccccatctgcaaaatggggatgaccccagcactcctagggttactctggggagtacagtgactgtgtgcgggctcacccctcctcccggaggaagtcccaaggaagaagcagagccctccagccttccagccctgtgtagatttttgagcttatttttattttcttggctccttgaggaccagaagggaatctgtctgctcttcttttgtcttgtggtcagacactcaatctgtgtttacccgcctgattccttccccaggatggaactgacagacgatcccttgattctgggccaggggaggcgagactatttcaggctggcgggactggggccactgaaagctggtgcaggcaggtggccatcggccgtcaggacccagggtcttgtgcttccccccttgctgggagggtgggtggcttctgtgcatctctcaggaggagcgaggccggggtcagggtgtgggcagttgatgctttcatccactaatcgacttattcattcaataaatggccattcagcacccactgtgtgccaggcactgtgctaggtgctggcatgtggctggaacaagacagacaaggtctctgccctcagggaatcttcagacaccgcaaaaagaaatcccttgagaaaaggaccagagttgtcataataaggacacccactgaggccttgctctgttccaggtactgtgccacatgcttcttgagcccttgcagcaactccctgaggtcaatatcatcattatacctattttgcagatggggaaactaaagccgggagaggctgagtaacttgctgaagtccacacagctggggagtggattcagacagaaggaaataaaatgaggtgatgtttgtgacagggatggtcgcatctactttagatgggatgggcaaggaaggcttttctagggagatgacatttgaccaagtcctgaaggaggagaaggagccctggtggaaagagtggagaaaagtgtgttccaggcagtgggagcagcagatgcaaaggccctgaggcaggactgtgccaggcttgtttgaggaacagtaagaggccagggtggctggaggggagagtaagggagatgagattggcatgttggtggggtccaggtcgcatgggcctcagatgcatggtgagcagtttgggttttatttctggtggtgtgaggagccaccagagtgctttcagttggatatggcatgggtcagttggtgacgtggaaaccaagactgtgcaatggtcttactaaggtctcagagaggaatgggtgtaccgtcccctcccacagcagatcccctgcctgctcccaggctgctctgtgacctacggctggttctgtcctctctttgggtttcagctttcctgtgggtactgggttaccaagtaaccagggcaggcttcctggaggaggccagtggacccaaccacacccaaagaggagtttgggcccccatctgtggccagaatgtggatgagctgtgaaggcagctgcctctgggctgggagggctgttgatgcgagatgaacctctgcttcctgagacaaaggaaggtgccccttgttttctgttcaggaaactcatttgcataattaaaaactgtttggcgggatcggtactccaccctccatgcataggcatcataacagcactttactgtctattagctctcacctctgccctgtgggggatggatttttcaggcccacttcctgcatgaggaaaatagctgcagagaggggaagtggcgtacctgaggacgcgcagccgggaatggccagggccgttgcagttgactcttttgatctcgccctggcctcccgcattctgttctccttacgcagtcagagggatccagtgagaccctaatcagttacagttacatctcacttagcataaaagcagtccttagtctggcctggaatgtcgcacaagacctgcccctcttggctctctcagctcctctttcattactcctttttccccataaagttttaaaaactgagatgtgaattcacaaatcataaacctcaccctttcaaactgtacgattcggtggttttgagtatattcaccaagttatgcagtcatccccattatccagttccagaatcttctgggtagctcttaccccctcgcccacttcctccaagcgcatttgccttttctcaaatgcaccaagcacgcacctgcctcagggcccttgcacctgtgctgtctggaatgcgctccctcccacctcccagtgtccccgtggctcagccctccacctccttcaggcctttgctcaaaatcatgttcttgactgggtcttttctgacaccgcacatccccacctcaccatttcttcctttgcttgcgttgtttttttcccactagctaacacactggacattttacttatttattacttattgtctgcctccctcgctggaatgtcacaggcatgccaagaggatagagattttgatctccagcaccaacaatgcctgctacatagtagatgctcattaagtattttttgaatgaaaaaaattgcttctatatgtgcctatgttttattacatgatgtgattgttttgaattatataattgctaagcatttttgtgcagacttctggggactaagatggtctggtgtcttttgactatgtgggtatgtgagctgggggattttgcacaggagaattttttacagtgtggcattgtgctcaagtgccaggggcctagccagattgtctgggtctgaatcttatctctgcgcctcagcagctgtgtgaccttgggcaagaagctttccctctctgaaccttggtttcctcatctataaaatatgttgagacacttggctcactgcctggcacctgagcaggccccagtaattagtgaggttatttttaaacattctgttttagaatcttagtatttccctactttttgcagaggaacagttacagcatatcatcttgaacacactgcctgagatccttcctgggacttgaaataagtgactgaatttattttgaccaagtggtcccttgccctggacattggtctgtgcactctgaaggcagttgggagtaactgggatggctgtaagttggagctagaagttgctgttcactctcttctccaagcaatccctccgaagattgaaaaaacagattggtgtctcaaaaatacatgacagcacctcccattgccctgctgtgaaatccctccatgaacctgaaagggcacagaacacgctgcttcccactttctgggtgaggctgttacacatcctgtttcatttacagccttgcagttttgcagatgaggaaactgaggcccagagagggtgaggtcacttgcctaggatcacacagagatggcgtattagttatctgttgctgccaaacaagttaccacacatttagtggcttaaaataacgcctgttaattacctcgaagtttctgtgggccagaagtctgggtgcaatgtaactgggttttctactgaaggtctcatgaggctgccatcagggtgttgacccgggctgtgatctcatctgatgcttggagcgaggagggtgtggggcatgggagggatctgcatagggttgttggcagaatttagttgcgtgcattgtggagccggggtccccattttttgcagggtattggctggtgatcaccctcacttcctagaggtgccttgagtcttaggggtgtggtcctgccacaacatagccacatcacggccagcaggtgaatcacttgctttgaatctcttcctttaggaagggcctagaagtgtacttgtactcttctccctgctttatcccccgcaggcgtcttttaaggctttacctgattaggtcaggctcactcagtcagctgattttggaccctgattatatctgcaaaatcccttcgcctctgtcatttaccagtcacaatgacagtcccacttacatgaaatgggaaaggatcctccagggcgtggacacagggggcagtgatcctggggccatctcagggttctgcccaccaacaatggtcagtggtgggtttgaactcaggattattctactccagagcccatatttgtgaccactgtgctttactttatttactccctctctggccctgcccagagtgaaccctgagtaaggtgaactgattggctgttggcctcattctggctcattctgagcgagacggggcaggtgggctgtattatgaggtgtggtttcctcgctggtaagacctggtctctccaacacagtacacagacccccagcatctctctgttttttttttttttttcctttttttcttttttttttgagacagagtctcactctgttgccaaggctggagtgcaatggtgcaatctcggctcactgcaacctccacttcccaggttcgagcgattctcctgcctcagcctcccgagtagcggggattacaggcatgtgccaacacgtctggctgatttttgtaattttagtagagacagggtttcgccacattggccaggctggtggtctcaaacccctgacctcaggtgatttgcccactcggctgactcccaaagtgctgagattacaggcaatgagccactgtgcccggccgccccagcatctcttgaaatgatttgccaactgggttgttgaagttgaaaccagagcatctaccccatcctggtacccccgttacctaggagtgtaggcttagacctggccacgggacagatgcctgactgctttctcccaggggacatttacgccagatgttgtctgtgctgtttactctgagtgtggggtggggagtgaggaagcccatctgattgcattgatctccacatattagggcttttccagataactcattgtttagtgatttccaatttgtgttcagagaacatattctgtgggttttcaatcctttgaaattgagacttggtttatgacccagcagatagtctaccttagggaccatttcatgtacatttgaaaagaatgtgtcttctgctgtcgttgggtgcagtgttctacaaatgtcatttggatcaaggtggttgttagtgttgttcagatctgtatatccttacagatgcttggtctccttgttctggtagttattgagagaaggctctggaagtctccatctgtgactatagatttatgtttttctcctttgagttctgtcagttattactttttgcattttaaagttctcttgctggaaatacacatttatgattatgtcttcctggtgaattgatccttttatcattatgaaatactcctttttatctctgataatgctccttgtcttgaagcctattttgtctgatattgctatagccatgttgcctttcttctgcttactgttttccatttttttcgtttctgcctctgtgtctttatattccaagtgcatctcctacaggcatcatatagttgggtcttgcttttctaaatccattctgacagtcgcaaccttttaattagactgtttagcttatgtatatttaatgtaattactgacagggttcggtttagctccaacaccctgccatttcattctggtttgtttgctacggacattaacagcacaaggagtcctcttcctcccccatcctcactctgctggaggtggaacatggaggttaatcgaatcccagctccttatgatggcttagaaggtattatgtgatccagctttagctcactgtgcagacctcatctccccgccttgttcattctgtccaggccccaccacatttctttctattcttgcactgtattcaactggctccagcctctaagccttttcctttgctcttcctattacctggagctcttggaaccctgatttgtaccaaggacccccctttctctttcagctctcagctcaagtgccgcttcctcagagagccttctagtccctttctctacaccactgcactgattttcttcttgacctgtcactgcctggaattatcttgttgatttatttgtttagtatctgtctctcccattagaatgtaagttgcatgaggtcacagcccttgtctgctgtgttcatggccaagtccctggtgattagcacttaatggggactgtgttagcatttgtggaagaaatgaatgcatgagcaaaaggggctgaatggggcccactctgtggcagaggccttcctggccatgactgtgtcttgggagcatgaacccacgtgtaggggcagccgcagcctgggttccttggcctcctgcccttaccacactggggagggcaaagggattggaaagttttatttgccacgtcagggagctctgggtggtctcagccaccagccagtggcccaccaagctgttgattgggtggttttaaagatttatttccccttgaacacaaaggtagtaaatacagtggaggtgtcagtatcaaaagcacattcccttatgtctgttcagctacaggcgctcttatggaacccagtatggtaaaatgatattttgtgtgtatacctggctgcatatattattcatttctacacgcatatggcagtctaggcacaaaaccaaacatgttgtatttctgggcaatttaatatgttcttttcagagttaactttttggtaactttttatttgatcgctccccctctccctttcctttcttcttccctgtctccatcatgcacacacacgttattattattttgatctatttgagagtaattgcagacaggatgcccctgcaaaccttggcatgcatcacttaggaagacagacgttctcttgtgtaaccacagtgccttcaacaacaaaatcaggcaagtcaacatttatactaaatgatacaatgcacagtctatattcagatttcactatttctccccaagtgttccctatacccatctcctcgcccatccccacccccagtccaggatctagtcctggatcacgcattgtatttggcagtccagctctggtgattttgattgtcctcagtagaaagtctccactgagatgtgctcatgcttgtcccagagccaagctctgtgaccagctctgtgacctcgggaagctgattcttggacctcagtttcttcagctataaaatggggaaatcgctgtccctacctcatagacttgttcccttgttccaacacattgtgttaagcacctactgtgtgcctggcccagatgctgggatacagcaggatgcagggcaggccgacatctgggccgttgggggtggagtagagtaggtgagtgctgggtgtggagccggctccctaggacgcccaccacgtatgactgtgtttgcagttactgcgctcattttagaaaatttgggaaataaagatgaataaaaagatctcacccttccaaatagctgtttcatctttgggtatatttcctctttgttccttgcatttggtctgagcctggtacacgacagcaggtactgcttgtgcatacttcctcgtgtcactgctaaatgctctccatcagcaagcctttcatggcttcgtaatgaaatgtgggggctggatcatggccactgtccagttcaaatcctgactgcctgcctgctgtgtggtcagtggcccagctgctccatctgtgtgtgcctcggtttcctcatctcctaaaatagtgccctcttcttagattgaggggggaattaggtgaattaggacctgcaaagctatcagaacaatgcgaggtacatagtaagcattccatatatattagctatacttataagaattattatactaatatataatttaataatagcattctagtaaaattattatttacccattcctcttatattatttacccattcctcttacattatttacccattcctcttatattttttacccattcctcttacattatttacccattcctcttacattatttacccattcctcttatattatttacccattcctcttatattatttacccattcctcttatgttatttacccattcctcttatgttatttacccattcctcttatattatttacccattcctcttatgttatttacccattcctcttatattatttacccattcctcttatattggggcatttaggtagttttcagtttttcacaatgacagtccatctgcatctttgttgattgctaccggttcttttgtcaatttagtaactgagggctgaaaaaacctgggtttaggaccctttggtccttattagcccaaagaaattattagcactagaatcctggaaaccggctgttggagctggaagacactgagacatcatctcatccaatcatctcgcttttcaggaaggggaaattgaggcaccgagctgttcagtcacttggcctggggatcccaagtgggtctgcggttgagatggaaccgaaacccaggttttctgactcctattccgtgatagtctgcttttgtccaacagctaagactccttggaggacagagagggaggtttaagttgtatccaaatgagttggatgaatgttttgtcctaggggattcccttgtctctaggaaacttcactttcagattctttgacttcagtgatcagtagtgtgaggggtgtgtgtgtgtatccaggtctggtcagtagtgtgcatgcacacgtgtgtgtgtgtatccaggtctggtcagtagtgtgcatgcacacgtacgtgtgtgtgtgtgtgggggggtgtgtatccaggtcttgtcagtagagtgcatgcacacgtgtgtgtgtgtatccaggtctggtcagtagtttgcatgcacacgtgtgtgtgtgtgtgtatccaactctggtcagaagtcattgatcgtacccttgctgtgggccaggccttgtacaagctactgaggccacagatgtgatgaaagcagggcccctccttttacttatgatcagaaccactggttccaaacccaggggtcctaagtccaggttaggctcatatgtgggttttgtcagcctgcacgggattgttttaaaattttttgtttaggctgggtacagtggctcaggcctgtaatcccagcactttgggaggctgaggtgggtggatcacctgaggtcgggagttcgtgaccagcctggcaaacatagtgaaaccccatgtttaataataataaaaaaaaaattgttatttacttgccagcaatgaaaaatgaagacatttcatacaaaaacctattatttctggcttcttagtaatcagaagatgtgtcacttgctcttctgcaggcaacgtttggtttggctggacctgaagagcagctgccccttctgcagggcacagggcttcagtcttcatttagccacagtctccacccctccataacatgttcctaacactgagaccaaacattggttgccatttattatggcacttgccctgctggtttttaattattattattattttttttttgaggaggagtctggctcttgtcgcccaggctggagtgcagtggtgcgatctcagctcactgcagcccctgcctcccgggttcaagtgattcttctacctcagcctcccaagtagctgggactacaggtgtgcaccaccatgcctggctaatttttgtatttttaatagagatggggttttgctatgttggccaggctggtctcaaactcttgatctgagatgatccacctgcttcagcctcccaaagtgctgggattacaagagtgagccaccgtgccctgcctttttttttttttttttttaattgaggtgagatcttgccttgctgcccaggctggagtgcagtggtgtgatcatagctcactgcagcctccaacccctcctggggtgaccttcccacctcagcctcctgagtagctgtaactacaggtgtgtgtcaccatgcccagctaattaaaaaattttttttagagataagggtctcactatgttgcccaggctggtcttgaactcctggacttaagcgattctcctgcctcagcctcccaaagtgttgggattacaggcatgagccactgtactaggcctggttttttttttttaattgtagaattaagaggacagaggaatgtttcttctaacccttgcgtgtatcagatggaaaactgaaagaccaagagggttatgtgttttaaggaaagtggaaggtagcaggtttctctttggaagagaagagtattcctgtgtgtttactaggcaaagacactcttctctgttaaaaggatacaatagtcattgcttttactaaggagccgcgcacagcattccctgttacctgcccagctcctataggggttttaagttggagacttgttttccagtttgtgagtggtccttcttgttctttgagatgaaaaggggagaaggtgggtctctcttagagggtgcgaatctgtttcccagacttccacttcctgtggcctgtgggcaatggctcccttctcttttctgcaacatcagctattaaacaggaggttcccacatggtccgtcctacttcctgcacttatgcccctttgggagaacctgggaggaagtagtgggttcctccaggggcgttagagggtccctgcctgggcctcttcttaggttgcaggaccctgataccatcccggtcaggtttggtgtcttcctgctcttgggcagcctattggtggcctctcccctggcctcgtttctccctcatcttgaagattttgaaataacaagaacaataataaagacaatggcattgctaccactgctgagattggcaagagccggctggttgtcaggatcctttggttgcaagtgacagaaaacccatctcaaaccaccttcagtaagaatgggaatttctctctgtttccctggggcagctgcctcctgggtgagggatgtagctctaccacatggtagtgggggaggagtggttcccagaaggaagcccccagggtgctgggaccagaagatggggagggatgccaggtgggagcatctcttctcccctgtgctggtgcctcgatcccagattggaaggctttgccttcccccaagtcttgggtcccaggggagccccgttggcccatggcctgcttgcagtggctcttggcctttccatgtctgacctcagaatccttgctcctatcctgcctccttgggaggccttccttgactattccagctctccctgtggatgtcattataacactggtgcccacatgtgtgaggaactgtgcccagtggacactttccaagcaacatagccccccaagaacctggtggggaaggtgttcctgcgttgcctgtttattgtgtcgatgaggaagcagaggctcagaaaggttccctgacctacccagagtcacacagcatctttctcttctattgaagactcagctgtgtgcattttgtcttccctgaatccaggctctgccccttctaggggtgtaacatcaggaaaaggactttgcctctgtctttatggggagagcattccaagcatgggaaacagcaagtgcaaaggccctgaggcaggagcctgttttaggatccacacggaggccggaatggccaggggcagagcaatgggaggtcaagtcagagaggtggcagtaggagtagggaggctggtgggcagattgcacagggccttgagggccattgtaagggctttgctttctacgctgagtgaggtggtgtcgctgagtgaggtggtgttgtccttggagtgtttcagcagaggaggggcagatctgactcagttttcgcaggatccctctggctacttgtgcgggtagatgataggaggtggggtggaggctgaggaggaggctgccacagcagcccgggcaggagagcctgttctgcaggtggctagatggcagtccactgcccctgctttgtcctcctgtgctgctcacgagctgtgtgacctcgagtcctggctgcttttcttggagctctattttctcatctgcacagtggtgttaatgatgtgacctcgctgatggggctgtggggatgaactgcatgagctgataaatgtaaagtgctcccggagtgcctggcacagcctaagctctcagcaaatgtttgtggagtgtgccagtgaggggatggcagggaatttggggccgctccagctctgcccacggtgcctgtgcctgaggtcagccccagagcaggaagcaccccgttgttccccaactctgccctctccatccccacacacagagctttgaatgaacaggatccagaatgttccgacaacagtgcccccctcccctttcctactgacaaagccatctttgttactcctgggtgtgaaatccatttcagaaatgaggatggtgcaggctcaggagtcggcttgcaaggatggggaggggcttgggaggaaggtgtccccatcttgctcagggccccctgagtggacagcctgctcccccacacccctctagcctcatttgggcccagaatgctctggaattggcagtgttttttggaactgtgtggagctgcatttccgctgagaaaccctatcagtcaacgtcaccttccatcccttactgtcgtcacacgtacacaagaggcataatgcccagcgctggcctggctgcaggcaagcaagcagtcccagaggacactggtgggagtgttcatgattgctgccttgggggaaaatacattggcagtgtctttaaaaataaaaacccacgataccctttgattcagttcctttaggaacttctcctatagaaacaagaaaaaaaaagtaggtaaagatgtaagttacaaagatgtttattccagttttgtttctaatggcaaaagaaattggcaactctgtgagtggccgttagcagagaaaagtctcattaggatggttgttgatccacatgttggggtaacggacagctgttggaaagaatgaggttggtctctatggacatgaggggctgtatgtgctgtacctttaaggagggataagttgctgagtgaaatgtagagcaggaccccaattttgtagagaaaaaaaaacacaaaaaaggctctctcaatgggtatttatgagtgtggagaaagatactgcaggatgtgcaccagatgttagccttggtagcctcaggctgagaatgggggggagtgtagaaaaagaattttcactttatctttgtatacttttttggcattgctacactagttctaattaacacactatttttcaaattaatatagactaacaataatttaaaaaagacagttccctgccagttgtcttttccctcatgtcagcatggctcacctccatcttcagctatgttctgttgagatgtcaccttgaagaggcgttctctgactgttccatggatgaatggatatcggattcctttgaactgtccctatacctcttctgagaagccattcctgctactcttatgcatctctgacttccttttccccagccccagccctccatactggcactgagccctcttcaccttctgcctgctgttggagctgtttgggggccatcttgaccttggtatccctgatgctgagcccagtgcctggcatacagtcagtgctcattaaatgcttgttgctcccttgtcagggaacttaccaatctgaaagcccaaagtctgagaggcgctggtatgttatctttcagtcccggctcctcctcttactgggagtgtgacctggggcaagtcatttaacatgtttgaaccttagttttgtccttaataaagtgggagtaatagtaatcccttccttctaggatcattgtacctctgaaatgagtgatggtgtgcaaaagatgtttcatttggtacctggcacataataaatgcttaattatgttagctgttattaataataatgaaccaagtctagagtttagaacaaacaaaaaatgaccatttagaaacacctactgtggggcagacctgtatgtaatattgggtcacataaaccctcccataggcctttgagaatcaggatagcaggtgtctgagcaagttgtgcaaccaggtcccttaagttcaaatccaggccctagatttgatgaatggacaaagatctttgtcctcctggagctgatgttctggtgggcttagaacagtggttctcaaacaagggcagtttggcccctcccccaaaggggacatatggcaatgtctggagatatttttggttgtcacaactggggaggaaggatgtctggactctacctgctactgtcatgaagcaggtagagtccagggatgctgctgaacgtcctacagtgcctagcacagccttatcacacagtattacctggccccaattgtcagtggcactgagcgggagaagccctggtctagagcagtgtctggcacatcctgagagctcagcacatgttcgctgctttggcggcagtgatgatggaagtgtttctgtatttgccacctgtcttacaggtggggacattgaagcttggagaggtgttacagctggttctaagtctcattgtcagttggcactggagctgggatttgaacctgggtctcgatccctgaggctgagccctgtggctgaggtgggagcaggatgccccatccctggtgtctctctcaagagttggtggctgttggggggcacagaggggtgaggtgggattctgggcttggggctggcctgtaagtccaggaagaagggagcccccggtgctgaggggaccctggagacccagccctgtgtgtggtgctggctgcccctcctggctccctaattcgctgccagcacttgttgtctgccagtcaccacaacacttcgggccaagacatattctcagcccctccccgtgtgtcaggtctttggcagccgcagaaggtagggtggagggggtctctctgtttctgctcctgaagagctgcacttggcagagagcacgtggtgtctgcagcctggccttggccgggtggctcagccagctgagttagcctggatcaccttgcacccgcctgtccttctctgactgagcctcagtttcttatctgggtgatgagttggggtggggaatgctaattcctgccctacctacctctttggagcaggctaaacagtggatgtgaaactccattgtccatagcaagctgttctagaacaaggagttgatgtcctgctgctatcaccgtttcttctccccggcacatagccaggaggctggtgggcactggcagcccggtggtaaggagatggggaccatttcttccctctcttcctctgtcacttcattatcattctgtagttgagctcatcttgctcaatcatttaaaatgccctgccagcatttctcaaatttatattccttgccctgacctctgtcccgacctctagatgatgacccgacatctccatgagggcattcagcaggcatcacaaacttgctgcctcctccccgccactcctcttgcggccccctccttccagtcactctggcacctccttgggccatcttgacgccactcttcctcttacatcccacatccaacccatcaggaaatcctgtcagctccaacttggacaagcagccaggatccggccacttctcacctcccatgggtagccccgggtctcagccaccatggtctcctgctgggactcttgcagtcgtctcctcccttgtcccatgcttccacccttgcccctggttctccacatgtaccctgcgtaaatcaggtcacattcgtcctatctgagcccccgctgcctcccacctcacccagaggaaatcccaacgccctgtagtctgtggtcttctgactccttcgccaaaagtgcccagcacactcctgcctcagggcctttgcacatgctgtcctgttggtcgggaacattctccaggtatttgtgcactcatgacctcttcaggtcttgggcctctccctctcagcccagccttccctggcctcccatcgaaagtcacccctcctcccatgctccccctctgtctccctcttctccgtggcacttgtatttgattgactcctctgcttcttgcctgctcttccttcgctagaatttaagctcccagagggcagggggttttgtctcttttattccctgttgtgtccccacacctagaacagtgcctggcacatagtgggtgcttagtagatatttgcagagtgaaagaaggacgagctatccagtcgttgtcacgtatttcctgaagattatattatatcccaggccttcttctgggcgtcagaaacgcagatgactcaaacaatggtgtgtgtcctcaagggctccagtccaggggagaaaatgggcacctaagtgagacattacaggatgataggtgctgtaacagctgtatcactcaggactgtttgggttgtaagtgacagaaaccctaacttgaagagtctgaagcaaacagacaaacaaaaaaagactttctgggcttacttgactcaggagtaatggcctcaggcacagttggatccaggtgttccctggcctgaccttgaggtcatggacccatccatgaaccaagtatcacccatccagagggccccagagctctgattgcccacgcctgggtcacaggttcgtcagtgtagatggggtgaggtgccggctgccccacaaccacatgtactaagagcaggactcagggcacgacttccaggatatcagacctcgggaagctgcagaaggggtgatgctatgtggattacaagctgtttttggcgtgtgtggccctgtgtgttgcaggtggttgggaagtggaattggggtgctgctggtcttggtgacaggtggccctccctctccctgtacatacctcttttgcccccttaccccactccttgaaaatactcctggctctcactctgttccccttccctttatcacaaaggggctccagatggcatggctttcggggagtctgccatgcaaatctgttgggttcatctccctgttctccctcccccacccgcatatgctggctctgagcttcttggatcctattttgggtctgagggaggaaggatgcttggggtccctggatgggcctcagtgctttttctggtctggcctgtgctgctgggaagccatgttttgcatgagattggcctcgtgggcctgccgtgagccttttggttcccagggatgccctgaaccagccatgcctgctattacctacttatctgggggtttaaaccaggatatcgcaaatctgactatacctctgaactacctgcaaacctagttccaatgcagattttggatcagcaggtctggagtagggcctgagatgccgcatttctaagcaagctcccaggagatgagacgctgatgccactggtccagggagcacgctgggtggtgggggtctaaggcgtcttctcaggaaagccccccttggcttgcccgctcctcactccccagcttgggccagggcccctgttacaagctcgcagaacggcctggcttctctcagagcccttgttgcaaagggaatgggggattcccacaccatgtcaggcatacttagagctccaggaatcttgttttctgctgtcttcatgctgtcagcagatactgactaaggtcctactgtgtgccaggcatgggggaaacagcagtgatcaaaacagatacaatccctgctctcatatctctgatgtttgggatgggggagatgaataatgaagaaataacaaatgagaaaaatcttgtaagtgacaagtgctatgcagacagtaacacagagatatgaattagagtcgggggctgttttggatctgatgatcagggaaggcctgcctgtctgatgaggtggcctttgagctgggacctggacactgagaagccagccatgggaattaaggcaggaagagtagcctgtgcaaaggccccgaggcagggatgagcttggccaatttcaggatcatcaaggaggctggtgtggctgggtagagtgagtgaggggagaatgggtgggagaagagatctgagcaccatgtgggggctgcattgggcagggtcttggaggccatggcaaagggttgggcttttattgtaagaggtagagaagctgtaggagcattaggccaggcagtgacagtgaatgacttaccttttaaaagaacccctctggctacctggctaccgtgaagaaagtagatggtttggcgggggtggggatggggtgtgtgcagggtgtcttagtttgttttctgctgcttataacagaacgcctgaagctgggtaatttataaagaaaagagatttatttagctcacagttgcacaggctgggaagttcaagggcatggccatggtgtctgatgaagaccttcctgctgcatcatggcatggcagagaaggtcagagagaaagcagacatgagtgaagagacaaaacccaaggggcgtcttggctttataacaacccactcttggggaactaatccagactccccagagtgagagctcactactgtgaggatggcaccagcccactcatgaggggtccgcctccatgactcaaacacctcccatgcgaccctgcctctcaacatcgcctcactggggaccagatttcaacatgagttttggtggggacaaataagccatagctaaaccatagcaggggacaaagataagtggggagaccagtgaggaggtgactgcaacagccccggggagagacgtgggtgtcctggcccagggtggtggtgggaggagaggagcgactggatgcaggacgcaggctggtttctcaacagaaagcctatatccacggaggtgaaactgtgccttggcccttacctactggaggatggtgctctgaccagaagggactctgtcgcaggatggttttaggaagctctttgggtgtctctgcgtggtggggctgggcttgcttcaagatgacttagggcaggcaggtgtgtggttgtcaggcctggtgtggtctcattttctcagcaagagggagagcccgactggccagcttctcagaattagaccttcagtgtcaccgatgcatgaggcatggagagttgctgaaagaggagatgttccttggtgcttacgcagctcgcatggtttccacaaaagaccacgctgcctatgatggcatagacactaatgccagtacgaatactgctactagtagctggttcttcacacgagctagaccatgtcttaagctcttcagctgcacaatcttgtgggatactcactgcagcctgtgagggaaggattcttattatccccattttatcctggtgataggcaggaactctccaaaggttacccagctagtaagtggcagattttaagctaacatatctttagaaatcccataattatttgcatccacaggctgagtgcggtggcccacacctgtaatccctgcactttgggaggccatggcgggaggattgcttgaggttaagagttcaagaccagcctgggcaacatagtgagatcctgtcactacaaaaaaaaaaaattagatatttgcatccagagtggttaggtcatgtgtcatgtatgttaaaggcattggtctcattataaaggcccgtgttcagtatgtaccatggtgcttggggccttgttttagccctgcccgagaggctcagtacatggatagctggctgcttttgccatctgagaggctgtactcccttttacgcctcgtaggtaagttctgcagcttccctggtccttggtttcctcgtctgtgacatgagggagggaaagagagggaacaaaagctcccacctcacaggaccactgtgtggtgaggctttggggtttgcatgatgccgggcacacatcctaagtgcccagggattgttggctgctgtcgctgttactattattatctttattctcactgataagtcaagtggtaaatagagtgaccaactgccccagtttgcttaggactgttctggttttaaaactaaaagtcccacatctcaggaaacccctcagacctcagtaaactggggctgttggtcgccctactgataaggggcttatcaataaatccaggcccttaatgtcagctcagcctgcatttgaattagccctgccacttcccagcggtgtgaccttgagcaggctatttaggctctctgtgcctcagttttccacttgttaaacgtggggtgattatagtagctaccttaagggttgtagtgaagtttaaatgagtgtaaagtttggtgaaatagctttattcaaattctccagagtcccacatggacaggagagaagctgagactgttttgaagctccttaggctctcccctccgccacagctggcccacaagtcaggctggctctgtcctctaccacatcaaagtcccccaaggccccctttatggcaggggtctgctggcccctggcgcagaggcagattagagtgagatcctatctggatgggtggaggtgcccagccagggagaggtactggtggccactgataagcagggcccttgtgcccgcagcccctgccccctcacccaggagaacacgggtactttcttcttgggtttcaacccagctggcccctctgccctgttgtggggggacagaggcccgcttgcctgcaggacaacctctctgtaccccattttccacctatctaaaatggggctggaaaacccttacccatggggtacacaggaagccaaggcccctccagtctttggctgtattattaacaaaatgcatgtaggataagactggggccccagagggtggcttttgaaatacttaagtttgaaccagctaacgcttttagcacatgcagtctccagggtgatagaccgcgctgctcggggcagggccacagggtttataggagttgctcttcgttttaggatgccactgacagtgtgcttgggtggacacaggcttagagggatgtttcgaacgttttcctcttccaggcctgtctgcatgtccttgtggtgggcagtggggatctcacttggggactgtgaggggcttccatgcagcaagctcctgccaccctcaaccaagtgtatatgagagtcttgagaattaaatgaaagaaaatgtgtgggcactcaagaaatgatagctgttatattttaaattaaaatgctatttattcagggccaggtggggtggctcatgcctgtaatttcagcactctgggaggctgaggtgggcggatcacttgatcaggagttcaagaccagtctggccaacgtggtgaaaccccgtctctactaaaaatacaaaaattagctgtgggtggtggcgcgtgcctgtaatctcagctattcaggagaattgcttgaactcgggaggtggaggtttcagtgagccgagatctcgccattgcactggagcctaggcgacagagcgagactctgtctcaaaaagaaaaaagttatttaattcatatttagagatttaagtcagggtcttgcatagatctgaagcgattccaatttaatcccagcaggagggtcagatacacagttccttctaaatttagtcaggtgaatataacaccaggagatgaattttgttgagcacctactgcatgccaaagctcctccacgtgtgctccagggacttggcagtatcaccgtgggagcttgggctcacctcacatccaccgcagcagaatctgcttttgacaaggcccccagctgattgacaggtacacttcagtttgcaagcgcatgggctgggaggtgggaaaggacttgtcagagtttaagtgcagcggggaggctggtgctggtgtggagggagggaaggctgaggagggtaatgggacagagcatgcagggccttccaggaagaggtgaggagcagggatttcctcccagtgtggcagcctgccggggagggctttaagcagagcagaagagtggtctgatggatgatttaaaaaggacccttaggtgtgggtatggaggctggaccgtaggagcagcaagattggttaggtagctgcctcagtgtccagtgagggatggtggtggcttggaccaggaggtggatggagatagagctgggttggacttgaattggtagtggaggaatgtgggtgataaagtttttcagtggaggaggggaaactagaccttgacccatacaacctggaaggcttcctggaggaggtggagactttcaggatagatgcggcagacttgaggacattccagaggtaggaaccccatgggcaagggcaaaagtgagttcatgcaaaaggcaggagattgacttacgtgacttcttcccaacccttaaaggttacagatgagctcagcgtcgtccctggaattgcaaagctagagaagagattaagagtcaaaggctttgggcacccccttgaatggggacaagaaggcagcttagggaaagtcacagatccaggctgaggaatcttgagggtctgagcactggctctgtcaggactgcaggcctgtcatcgactctcctgggcctcagtgttctcaggcatcaggtggggttacagcggggtgcaaagtggatgtgccgctggccgggaaagtcgggacagagctgccattgcaggcctggcgccctgtgccagggccacgagcagctcgctttgccagactgtgctttctgggtgagaacagggttgtttgaggaaggtgacaagcggggaccgacgggggtgtcgttctctttctctctggggaagatcattgagaaagagcgggcacacaggggcagtgaacagagacagcgctgtgggcctcttttttggggggatgggaggggagagagagctgggtcagctgtatgggccacttaatacccatgaacttgcaattaaatgcggaagtgagagacaagaggggtggtaaaaggggatattgttcccagctcctgagaggagggggctggagccctggggaaatggccagcctccaacatgaatgggcttcagtgtcctggggggggtctggggggagcagggggccgtcatttggccctttgtcctgctctgctggactcaaccacaaaggccagcttgattcccatttggcttttttctggggaagttgtggtgcggggctggaccctagcttggccacctctcagggacccaagcaaagagctccctctggtaaagggggatgatagaatttagagaatttccagaaatgctttccaccgtgatcagtcctttttcttccattaaaattttaaaattttaattattttaggtatatcttgtatgcaaaatgtacaatacaccaagtaaacggcttggtgagcttataataagatatatctgaataactgtcactcagatcagatattgccagcaccccagagggtgtcttctcccagtcagtatccccaaaagtaaccactgttctgatttgtatctgcgaagattagttttgcctgtttttgaactttatgtaaaatggaattatatagtatatgatcttttgtgtcttttaaattaatttaaaatgttacagctatacatgtgtatataattatatgtgtatataactgtatatataactatatatgtatatataattacgcatatacatatataaaactattttatatacattttatatcacatctatgttatatataccatatatgatgtacgacacatataactggatatttatatatacagtatatatgtatatgtacacatataaatatataaatatataaatgtgtaatcattttcatggttcaaattaaaaagcatacagtgagatagaatgaaatgttagcctccaagttccctccccagaggcagccactggccccggtgtcatacaggccccttcagatagtctgggtgtaccccttttgttacacaagtggggcccacagtacacgtttctgcattttgctttgtgcctgtatgatggaggttgttccatgatagcacatggaattgcctcatttcaaaaatgatagctgtatagaattctgttgaatggaggtactttttttttttttttaattattattaaattagtcccctgttgatggacactgaggttgtgcccatcttttgccattacaaatcatggtgggacagacacatgccacttcatacctgtaagtttattcatttctgggaatggaatttctgggttaaagagtgtatgtatttgtaatttttcattaatgtttcataacatgacaaatacaaatgcattcttcttgtagaaaattaatgcattgtggatgaggtaacctaccccttcgtgttcctggttgcctccagccccagttgctcttgttaataggctggtgtgcagctttccagatctttccctgtgtgtttgttcatgtcattgccacacatcgatgtgaacctgcagcagtgacatagcatgctttcgagcacgtgcatttgttttggtaaaagatacagagcagaggctggtggagcaggtggttaaatctgtaggcttggggctgagctcctgggttcaaattctgggtccctgagggtaaacgtaggatcacctagcattctgagctggctttgctcatgggatgtgtatgtctggataatctttttatgttgttttacacagtttcaggcccttccttctgacttctgcctaccattttgcagggcgattctgctggagtttatacattcattcccttcttgatgggcatcttggtggttcctgcctttttctttttcttctggatttctcagcctcagctctagtgacatttggggctttgttgtgggggattatcctatcctgtgcattgtagaatgtttaggagcgtccctggctctacccaccagccaaaagcaccctcctcctcagttgtgacaaccaaaaatatctccagacagtgccatatgtcctcaggggtggggggttggggcaagcaaaattgccctcatttgaaagtcactggtctgtactaagcagtgctgcaggagcatccttctttgagcctctctgtatgtgggcaaggtcatcatcattgtattcccattccacagataaggaaatggaggctcagaggggttgagtcatttgtcttgggtcacacagcaaatacgtggcagaaccagcatcccagctctgccaggtacagttctgggctgagctgagtgtttagtgggtgatggaacagacccgagcccctgtccttatggatctaaccctctggtaagaggcagacagtaagccggtcatcaaatacatacatgacacatcaggtgtcatgttagtgactgaggataaggacgcaagagaattacattaacaatgtcacctgacttttggtgacattttgcaataatagttgacatgtgagggtttcaatacattgggaactgtactaaagagtttcacttaatcaactcataggctagtcacaaaaacccctatgagatactgcagtggctcgcttctgtgcctcagtttctttatctgtaaaacagcttccccataggactgctgtctggtacccagcaagcactcaataaatgttaaatagcactgctgtctccccaacatccaaggcccagtccccgaggactgtaggcagccggggcccctcttagggaccctgtccctgggcctctcctcagcccctctctttgtctccgtggccatggcaacctggctgggtgcttggcacttcccggcccagcccccagcctgaccagccggcctcctcctctgcagaggctgccctggcaggctccagcctggctgggaagccacccccaccacccactgatgggggctcctgggcagtactggtgctgccctgcagtgtgggaaggaccccaagcaaaggctcctgctgggcctcctctctgcctcctggcctctttccttctggagtggagagagagctcttgttttcattgtcctggttagctctgtcttcccagctttgcctccagcttccttcaggactctctgtccgccccttgccttccctctctctgtttttctgtctcagtctcattctctgtgcccctatctccctctgtttctccctctcactgtctggcttctgatacttcattcacaggctggtccctgcatctgagaatgaggtgcagggcaccttgaggtcccttccgtgctcagagacagggccttggtttagaggggctcgtttgcagctcccagtagctcagtgagagcctgctgctccaaattatgggggtgttcataagggggtcctcccactctgtggggtaggggtcctcttgtcccatgggggcttctagtgagtgaggggatcctttagcccggtgaggtcatattctgcctggtgagtaaggggttcttctcctggccagacacttgggaggagatgggctactgagccacttgctttgacatctgagccagccatgtgaagggcttggacctagaaaacccagaatggtttcttcccatttccctgggagtggaccactgtgagtcgttaaaatcatcatttattaatggccagaactgacccttacatatgaataagtaatgcttccatgtaatgctccagacttgtagggtccttggggacccgagagggatcaagattaagagaaaagccattcctgtctggcctttgcctcgggctcagagagagtaaatgatttgcccgagcaagggttgcaaatccagatccctatggctgtgaccggtaaagcagccagtgcaggaaaaatcacgtaaccctctccccctaactttgtctctctactttcaacatcgatgtggatatagaggaacatctctttacccttaatctctctgtaccttggttttctcatctgtaaaatgggaataacaagaatgcctatctcataggtgtttctctttttaattttttaattgagtataattcacatgccataaggaattccccaaagtgtccactccagtggcttttggtatattcagaagcttgtgtaactgtcactatcttctaatttcagaacgttttaatcacacctgaaaaacaacccaaacccattggtagtcactccccattattccacttccccaatccctggaaccattagtctacttatttatgtatgtatgtatttatttatttattttgagacagtttcttgctctgttatccaggatggagtgcagtggcacgatctcagctcactgtagcctctgccttccggttcaagcaattctcccccctcagccttccaagtagctggaactacaggcgcataccaccatgtcaggctaatttttgtatttttagtagatatggggtatcgcaatgttggccaggctggtctcgaactcctgacctcaagtgatccacccaacttgcctctcaaagtgctgggattacaggcatgagccaccatgcctggcccactaatgtactttctatctctacagatttggacatttcatataaatggatataaatggaatcatactatgtgtgtgtgtgtgtgtgtgtgtgtgtgtgtgtgtgtgtgtattttttttttttttgtatctggcttcttccacattgtaatatgtgtcagaatttcattccttttttatggctgtatcatattccattatatggatatacattttgtttatccattcattagctgatggacatttgggttttgacagtttggctactatgaataatactgctatgcacatgagtgtacaagtttttgtatggagatagtttttatttctcttgggcttttacctaggaatggtctcataggtttcttgggacgattgagtgagttcataaagtacagctctcagaacagagcctgggacagcgcgggtgctagatgtgtgttagctcctttttttttgagatggagttttgctcttgttgcccaggctggagtgcagtggcgcgatcttggctcacagcaacctctgccttctgggttcaagtgattctcctgcctcagcctcctgagtagctaggattacaggcatgagccaccatgcccagctaattttgtgtttttagtagagaccgggtttctccatgttggtcaggctggtctcgaactcctgacctcaggtgatccacctggcctcccaaagtgctgggattacaggcatgagccaccacgcctggccttagctcttatttttataaaacaatgcctcaagccctgggccttggatgttggggagacagcagtgctatttaacatttattgagtgcttgctgggtgccagacaccagtcctatggggaagctgttttacagatgaagaaactgaggcacagaagtgagcccccacaggcaggcccccaaccccaatctgtgccttctggagcacatgtcccatgtcaagcaagcagccacctctcagccccaggcagcagtccccgtgcgggaactcgagcccggtattgccagatctcttgacttcttaaagacattttccaacggcaggaaatgtggagtttttggtatgaaatcactcgatttttaaaagttggcaactcaatcacatttttaacaaacacttcatgggccaaaccaaacatgactgtgggccaaacctgtgggttgccagtttgcatactctgcccccgggttgacttgttgctggtggtgaggactttgctggacactgaacttgatttcaaacatttctgaaccttgggcacccctctttcctggggagttctggctcttgtccgtttcaattgtgttgaaacctgacccatcactgggacggtgggcttgttgaggacccccatggcagctggtcatcttgggattcctccctgtcaccccccagggtcataaaacgagacttgctcatattgggtgcttattctgtagtccttgactttacccctcaccagcagggtgaccttggggcaaatgacttgacctctgtgccttggtttccccagctatgaaacgggtaataataacacctcctctgggtttgatgcagcacttaggacagcgtccagcacgtggtaggagctcagtcatgtcagccaccgttattattacacacaaatgcacagacgtgcagacacagcaatgccaggctctgccatctggcagcagcagcgcgaaggtaacgatttatttctgtgtgctttgtctgtctgtgtttaccgaagggagtgatattagtgtgtgtgtgtgtgtgtgtgcatgaatctgcacagttccaagtcagctagctggggtgccgttttctgcatgcatatctccttgcataagtacagtgtatgcattattcatgcacatgcgcacactctcaccctctcacatattcctgggaataaatatgtgttggggttcccgggtggtgatagcagtcacctgagcagccagtaatgtttcagttgactggggagggtgggagctgatggggacagggtgggtagaggtaagcagatgttctggagaatctgggtggctgctgctggggatgttgggatatggcagggaaagtgttgagtgcactgagggctgggctgtgggacttgggtgcaacccacagcttgtggctgtggctgtggggaaaggtgctgggatttgactttcactgtctcggcattcagtgttggagtggatggaacagccaggcttcctctagggcgtgcctaacaggcccctgatcctttctctgcctcccttcaccttccctttcttctcttcagcatattgcaggctctaatttaggcaaaaactcctcagagtctaagaaaagctgaagcatgcagaatgagcacaacagaatttagctgtctcgagaggcagcctggaccattgaatttatcttttttttttccgcactcatgttgaagactttttttccctgttaaacttcttaaattaccttgcagccctccaccctcctttttccttggagcctggggagagtggagccttttgttcctctgtttcctctcttccgttcctactttcgggggaggctcgtggaacttgaggttgcttctgaaatagagaggtggttagactgggtcagccctagaatggatttgacaacttactcatcatattgttagctgacacttaccaagcacttaggatgcatccggctgtgtcctgagcattctgcattcattaactgacttatttcttctggctgccttgatggaagtgttcctattgtcccatttcacagtccaggagactggggcacagagaggttttgtcacatgcccagggttcctcagcgaggaaaggctgagccaagtcatgaaccagcagtctgacttcaaagcccacactcttaactacagcactctactacttctttgctaatgggttcattcagcatattggttgagcacctactacgtgccaggcccatttttctccttctttcctccccttcttcacttcattctttttctcccttcttctttcctccttatccatcacccatccatctccccacccacccacctgtccatccatctgtccatccatttgtcatccgtccgtctgttcatctgtccgtccagtatttcctgcaatatactcatttcagtatcagtcttatgatttgtataatattcaaataccagtcacaacattgtctatataatatttttactcaatctgaacctcctccctttttaaaaactttatagtctcagcttaataatgttcatgaaataatggttttgatatgatagccatagttactcatatcaacataaaaatactcatttcaagtggctgcgtgggggctggctgatagcctggccctgccacagacaagctgtgtgactctgggcaggtgactccgctcccttatctgtagcacggggagactaatgatacccactgctaagggtgttgtattaaatgagataccatatgaacgtgcttagagcaagcccactggcccatcctgagctctcagcaagccctgactgttgatgatgttgttattaccatcattattactcagaaaacctctgtggtgaggagcagagtcagggcctgaggctctgcaggttgtcccgtgatgaaggtggatggagatgttgaggaagcagatggtagatcgcactgtgaagttgggtgaagctgggaaccttccatgacattggaggaacttgttccattctgaattggtggttatttggaaggggtagacatggccgaactttgaaggttctagctaaagtcagggttttatttaatccttgcatggtggggctcaatgtgtgagtgagtgtcttagtctatcttctgttgctcataacagaatacctgaaactgggtaatttataaagaaaagaaactttcttcttacagttatggaagctgagaagtcccaggtggaggggccacatctggtgagaacgttcttgggggttctaaagagactcgaggcagtttagggaatcacgtggcaggggggctgagcacactaacacgccagctcaggtttctcttcctcttcttacaaagccaccggttccactcccatgataccccattcatccattagcccgttaatccgtgaatgcattaattcattcatgagggcagagcctcttatgagccagtcacctcttacaggccccacctctgaatcttgccacagcgggtatttgtttccaacacatgaaatgtgggggatgccttcaaaccatagcagtgactgaaaacccaaaccagtcagactcatataagagaagaagtataatagcccatgaagctagacctacagcttcaggtagagtttgatctaggggctcaacgtacaaagaattggcttcatcctgtgctctgtgtgcctcaggtgggggatgagcaacacctttcaagcagcatcagggtactttacggtaaaatgagggaatagaagctggtggccaaagagctgaagcctgccatcatcctcagggccagagcttctttgaaagaggggagcttcctgtttgagggtggtaggtgggcatttgggtccaagctctgtgttctgctactgagatttctgaaggacatttgagggctgctttcatgactcatctttgaatgaattcactcacccaggttacatcatatctccaaacatctgcctctatcctgcaaaaggctcgaggacactgcccgcctgttccctgggtggtggggctttcttagcagcaaaatgttcccggcttacagaaaacttcccacgggccttttaaatccatcaagtgaattacaagttcaatttgggtttgcacacattctctcatggtcccccgctctagggctggatgtggctgattcctgggtgcgttaatctcgaagcctccgccatctgcaagtgaagtttagctcccacatcggcagttttcctgccttgcctttgcttgtgtatatgtgacttccctaattttgaggtttcttaaaaacagagaagataaaacaaaccacagccatatttccctcctccagcatctggtggccacttgtaatttgtaatgttggggaaaaaaagtgttttgatcatttttcaaaattagacttaaaaaatgtatcattgggtgttcctgtgttaaaagtttgttttttcttttcagaacattttgcaaccagacttctttaggggtttccttagtccttcttctgttctccagatcagcttataaaattccttgcaaaaatgtttttttgttttgttttgttttttgttttatggttgctttttttttttttaatgtaagggggaagacgagggttttcgtcgtcctgcttacataaatccataatgtggggagcagcagagagagtaaatgagctcgagagtgctcaggcctctgaaacattctcttgtggaccccggctggccgggggctgtttgctgccagcgggcattcgctgttccttcaaacacttgtaatgtgtgatgttttggaatcagccttttttctttctttctttttttttcttgtttgtttataaaggacctttatgatgtctttgaaaagaaatcactagacagagccagcttttacatgattatgagatttatgtattcataagtgccgtgtcgtcctgggatcgggggaagcagacacgagtgtcagggtctgtttccagggctaaaaggaagaatcctccccaggcctcctcagggagggccagggttgaggggcggtgggcactgtcgcccgtcaccatggtgaggaaggagggtgtcaggaatggccttccagcccgcttctcgcagcctttgctggacgtttctagccaccagtgaggcccagagaatgggtccccagagggtcatcagcatcttatgctcaagggggcttctgagaggttcttggagtgtgttgtggggagggggggctgggagggtcaggagtcgcatccttgtgacctcttgtccttcccacgcctcctcctctttccctcccctccacctctccctttcctctcctccctaccctcctctctctttctctttctctctctctttctttttctttctttctctctctctctttttctttccttccttctctttcttttcttttctactcttctcttttttttcttttctttctttctcttttttttttgacagagtcttgctttgtgacccaggctggagtgcagtggcatgatcttggctcactgcaacctctgcctcccgggttcaagcgatttttcccacctcagcctcctgagtagctgggattacaggtgtgcaccaccacacctagctaatttttgtatttttagtagagatctggttttgccatgttggccaggctggtctcgaactcctgacctcaggtgatccacctgcctcggcctcccaaagtgctgggattataggcgtgagccaccgtgcccggcccccatcctcccttttctaccctatcccatttccccgccactttctttctctcctgctctccctcctctccctgagtctccttgttggtcatgtcttgggcccaggttctagggtctctgtaggatgggtccccaagggtaggtttgcctagccctttagaaagtccaaaacctacatgccctgaaaggaggcaaatagatttgttgcttatttgtcctccaagggggtccagctgcttaccaccccccgcccccagcatgccaccaggacccctcccagggagttttgttcaggcctagattccaggtttgacctcacctccccgactcaccccctttctctgcccagagccatcctggcccctggctgctcctcagatgctcgggtccagcccagccccattctcttcctgctgtgatccatgagcccgctcaggccccactgtcttcatggaccctcctcatggccttttctgaaccccctgctggaaggcaccggcccatccatcccggctctttctgccctgtggctttgcctgctgctgtgttgtctgtctccctttgctagaggtaagctctgtcttcctgtgccctccgtctccaccgcctgccacatgatgggggctcgtcagtatttatggaatgaatttggggacattggtgcactttttttttcctgctgatgccttggatcaaaaccctctgagtgcacaggcttactgagggaaagcagaggggctgctggcaccggtggaggtggtgacatcttgaaggttggaggtaaaagcccaaagagactggccagctgggacaggtacttctgtagggtgagagggggtgtccctggagtccgaacatcagcgatgaggcctgagctcagccctggctggccgctctgctatctggtgccaggctctgtggatgagtttggggaaccttgggtggtcacagtggctggagccaagccttggcaccaccagggggtcccacccaaagccagtttcttgagcagaatggatggcagtggaggtaccagtggcgctcagcatctttgcagcttcgatgagtgggccctaaaggtgtcctctgggctggtgttggctgccacccatcacaggtgtgggagcggggcagccactgctggtaaacctcctgtgggcttgtcagaggagaccccaggcaggaagtaggctgacaggcagatcagcactttaaaaaaatatgcttcatcgaaatagaaattatatctggctgggtgcagtggctcacgcctgtaatcccagcactttgggaggctgaggcaggcgaatcacctgaagtcaggagttccagaccagcctggccaacatggtgaaaccccatctctactaaatatacagaaattaggtgggtgtggtggcaggtgcctgtaatcccagctacttgggaggcttaggtaggagaatcgtttgaacctgggagatggaggctgcagtgagccgagatcatgccattgcactccagcctgagtgacaagagcgaaactcggtctcaaaaaaaaaaaagagagaaagaaatagaaatgatatctggaagaacctacccattttaagtatatacttcaatgagattgcacaagggagggtctgctggctacacacagggagctgtggctgcttctgcccagccagtggagtgggaaggagctgctgtgggctcaggtggggtcaggaggacccaggacatttaattcccaaggtttcatgcccagtcgcccacttgcctttctcttctggtgggctcccagttcctgtgggcaggtcggcttcttgacccccagaaaaggggcttctttagggaagagggggaggcctttcggtccagcagtgtgcagatcaggacggcctcactgtcacagaataattgttaccaaaatgaggcctgctgctgagaactcattgaaaatgggccctaacatagcaatattgagaatgtggggtggcgggggtagagtctagatgagtccttcactttgaagaagaaaaccacaatcctaaaaataggtggaattttatcccgtcagtaactgtatttagaatgtaataacaacattgcatgaattcttagaatcaacaaggagggaaccaagtgttattttttactgttgggggtatgtgtaatttttctgataaaattaaatgattacacgatgccacatcattcatgtaaggtttcactttatagcatgatgataaagagtcattttgcaaaacccctggagcccgtttttggacttcttgtgcactctctgatggtcagaaaagttcctttggaacttcttatgtggtcttcctgggctttcttcactctcattgtgagccagcgactcctgggtctttatttgtttatagctttgcctggcagccagctgtggttctccagcatcactttcactgatgtcataaaaccctgcatcttttgcaggatttgcagtttccttttgcaactgatttgctttccgttcaccttgtgttgtgactgtggtatattcaggagcgtgagatccataaagacatggaggggacattagcaggtgagctgtttgagcaggaatcactttagaagtggccagctcatttggggtattttgaagacaatgacttttcttccttggggtacttgggtaacaggtagtggtgaagtggatactgaagaagcattttaagatgtgtctttgttctgggagatgctgctgagtagtcgagaccaatctcactcctgagacaggcagggtatgattgagacacggtgtcagggtgctgtgggctctcggttttcctcccgtacatctgcttaggtcctttgttatttctcctctgcctcctgggttccgatggtttgggggtgccagcccccacctgtgggcctcttctcttcctggtgatgtcacttgtgtcctttgtaccatccccacctctggattgcacccgggtatggccactgtctctttgccattgctacttggatctaaaataacacctgaaactacacatgtgctgaaccaaattcctcatcttgcccctgtaactggttcctccctctctctctcatctcagctaatggcacctccattcttccacttgctcaggccaaaaacttcggagtcactctccatcctctgtttctgtctcaccatcccatccagtggccagtctcattgttctgccttccaagcctctcatcctcactaccctctctgccaccaccccatctaacagacatttcctctttcacacactttacaaatggtattttctttagtcttcattcaaccatatcaggcatgtatccttctttttcatttcacaaatgaggatgttgaagttcggagaggtgaagtctcttgcccaaggtcacacagctggtgagtggcagcgctgtgtaaacccaggcaacctggttccggaggctgtgctgttaaccagcactctggtttaaggccttctcctcttttgcttggcctgttgctgtagccccgtcacctcctacagtcctttttgtccacagcaaccagagcgatcttgctaaccccaccttagactatgacactcgcctgttcacttcttctcccttgtgatgcccctcctgggactcctcatcacactgcagtgagagcgagaatcctttattgagcctgctgctccatggaccctctaaacacagcccggcctctaggttcttgcctgtgctgtttcctctacctgggaagtcctttccccagatctgcccctggcttggtctcctcatcatgctttcagttctgtgctcaaattttcccttctcagaagaccttccctggccggccattattttaagccagaccatcccaaacctttcctctacatttaatgagactttctcaccactttaacaggacatattcatagaaatggatatatgggtgtattagtccattttcacgctgctgataaagacatactcgagactgggtaatttatagaggtaaagaggtttaatggactcacagtttcacgtggctggggaggcctcacaatcatgggggaaggcaaaaggcatatcttaggtgggcaagagacaatgagaaccaagtgaaaggggtttccttttatgaaaccatcagatcttgtaagacttattcaataccacgagaaccgcatgggggaaacttcccccatgattcaattatctcccactgtgtccctcccacaacacatgggaattatgagagctacaattcaagatgagatttgagtgaggacacagccaaacaatatcagtgacccagcctgactttttcctttgctaattgttgactgagtcacccatgaggaccctgagactcagcaggagaaggacttgccagacatctgtggccaggtcaaggcacaggtggtcccagagtccaaatctcctgagcattggctcccctgatttttgtatagtacaaattcatcaccatctgtaacagggtaagtcatttaaaatctgtgggcctccatttcctcaattgtaacatgttgctgtggtttgaatgtgtcccccaaggttcaattgttggaaacttaatccttaatgcaacaggaaatagggcctaataggaggtgactgggtcatgagggcatgcaaattcgtagcaaattcatagctagacattctcatctgagcttcataatagctcctggaggtggaccccttccctgttttcagaagaggaagggggagtcccttacccaggattccacagtgagtttgtggcagggcctgggttcaaaccaggctgtgtgcttttctagctatagactcttggtgtggccatgaaaaacaaattagggggatgaggcagggggtgtctgacttggggactcttctctgcaccaagttcagagttcttcttgggtcttcttttggggaggagtggggtgtcagctgtaggccaggggctgcaccattgtggcccatgagtcacattccttgtgtagttgtgcattgtctggccagtaggtgatttggtttggtcagcacagggctttaagaaactttttattttgagataattgtaggcttacagaaaacttgcaaatatagtacagagttcttgtacatccttcacccagcttcccattacgttgacattttatattactgtagtataattacctaagtacaaagtacttctttgtagtagaaaaaattaatcttgatacagtactattaactataaaattcagtagaattttgttagtttccctacaaacgttctttttattttcaggatccaacctagggcaccatgttgcatttagatagcatggccccttagtctcctgtaatctgtgagagttccccagtctttctttgcctttcatgaccttgacacttttttgaagagtcctggtcaggtattttgtagactgtctgccactttggacttgagcttatgcgtaattaggagggataccccaggagcgatgtgcccctctctgtgcattttaatcagggggcatgtgatgttgatatgttcaaggggagatgttaacacttaattaagatggtgaaagccaggatactccatggtgaggttactaattttcctttgtaattactagacattttgggggagattctttgagactgtggaaataccctgtttttgtttgaacctttgcccactagttttagcatccaccggtgggtctggcctgtgatagctcttactgtggtcttccagtcgtggctttctatttccttcactcctcctacttttattaactaaaatccttgtgtaaaaagaattctccctgattcattccattatttatattatcataaaccagtattgtcattatttattttgttgttcaagttgtcccaactttggccattaggagttctttctggttgaccccgtgcccttttgacatgcctcctctattttttttcttctttctcttttttttgaacattaaaaaacattattttgtagagatggtagagatgggtcttgctgtgttgcccaggctggtcttgaactgttggtctcaagcagtcctcctgctttgacctcccaaagtgctgggattataggtgtgagccactgcacctggtctcttttgagcatttctttactagttgaaatctaaccacaagatattctggctcatcttgtattttccctgcctcagccctgaaatcaaccagttctttaaggacccctagctcttttaattggagaatggtatttagaaacctaatctgggcagtagttatgctcattgttactggatgccatggtatccaggaatatatgtatagacacttacacaatctatatttacttctgtatctttctatctgcacatatatttgaaaaacccagtgtccatactgatacccagtgtgaaatttttcaaacatttaatttgacttttgaagcttacatagagtaaaaatgactttttgggggtttagagttttatgaattttaacacatatgtagagttatatacttaccactacagtctggatagagaagacttccatcacccaaaaaacactctcatgccaccccttagtagtcacaccttcccccatcgttacccctgacaaccactcatccatttcctctccctgtagttctgccttttctaaaacatacacattccgtataaatggaatcatgctgtacaccaccttttgagactggcttctttcagtcaccataaagcctttgagattcatctgcattgttgtgtgtatcaacagtttgttccttttcattaccgagtagtactcccttgtttggatataccacagtttgtttatccattcacatgttgaattgcttgtttccagtttttggtgatttttaatagagctgctataaatatttatgtatagctttttgtgtgaacataagttttcatttctctagggtaaacatccaggagcagggttgttgggccatatggtaagtagatatttgactttatgggaagctgccaaaaaactttgtgggaagttttccaaagatgctgtactaatttactttccccacagcagtataggagagattctgtggttccacatcctcatcagcacttggtattgtcgggtttttcaaaagccgtttaagtagaagcatagaggtatcccattgtaattttaacttacattctcctaatcgctaatgatgctgcctatcttttcatgtgcatatttaccatttatatacttcttgggtgaagaaaatgttcaagttttttaatccattaaaaattttggcttgtttcctttgttaatttagggttgtattctgaatataaatcctttgtcagatatgtcatttgtaaatattttctccccatctgtagcttgtcttttgttctcttgacagtgtattttgcatggcaaaagttttcatttttgttctaatttatcccttttcttcttttacggatcttgctttttttaatgtcacatctaagaactcttttcttaatctcaggtcacaaggattttctcctgttttcttctaaagttttatgttttgaatttagatctgtgatccattttgagtttacttttgtatgaagtgtgtagtttaggttgaggttcattaatttgcatatcgtgtgtggttgttccaagatcattggtttaaagcaacagtttaaaagactgtcctttctctacggaattgcctttgcatccttatgaaaagtcaaacggccatatttgtgtgggtcaattcctgtactctcttttctgttccattgatctgtgtgtctcccctttcaccagtaccatatcatcataattattgtaactttataatagttcctttttttttttagagacggagtctcactctgtcacccaggctggagtacagtggcaccatcttggctcactgcaacctccacctcctgggttcaagcgattgtcccacctcagcctctggagtagctaggattacaggcgtgtgccatgcctggctaattttttttttttttttttgatttttgacttttagtagagacgggatttcatccttttggccaggctgatcttgaactcctcacctcaagtgatctgcccgccttggcctcccaaagtgctgggattacaggcatgagccactgtgcctggccataataattcttaaaactggataatgtgaatcctccaacattgttcttttacagaattgttttggctattctagtttctttgccttaccatgaacatattagaattaagtagcacagggttttaaaagtaggacttttttttgcaaaaatatggctttccaatttctgtagggaaacagaaatccggctgtacttttgcctggcgacatttgattggaacacagtcacagcttaccctttagatggatgtctgctctccagtttgccacagtccccacccttcccttttgtactactcctggccagcttcactcagtcactttccttgcatggcttctgttggcattggtgtttgtagcccctggtgtagacgtcttgggcacctctggctgtgggatctgaaatactgataatcccgataatgatgctgctgctgctgatgatgatgatagcaaccccacttccagtcagagctgtgtttttggcattgttcttagttcttgatccacagcctctccgcaggtctttgtcactacagagtactgctgtcgttatgcccattttacagatgtggatgcagagtctcagagaggtacagctgccggccccaagccatacagcttggctttgccgtgacccttcaggccttggtctttatatcagagtccattatgtgtggttgtggctaccttgagactgttaacctcttgagggcaacagcatttcaggttcttacctccctgcctgactctagctgtcaagttttgttctcagatatttgtgatgtgatgttagggagccttggattccgccggaggccctgtctgtaggcacttctgggtggtaggcatgggatcagcatcaaccgtaatggtcagttctgaaggttgctggggttgaacagccttccgttcactgtctgggtttgggattccagcgaaagccttcataccctcaagagaatggtggtgtgtggccgggggctcctgggcctcatgctggaggctggagagttagagaattggggcatgaccagctcatgttgttcagacctggtctggtgtttgtgcctcgtgtggtgtggcgggttttggcatcagaaagcctgtatttaggctgtacttcccccttcccagtgtgcctttgtgggccacttacctcacttccccgttgctcataaacgttagctcacttcccagttgctaaatagttgccaataaacaacagcaactattattattcatattgatgagtggaattacttgttgactggaccaaggggcgggagaaacccctcggacctttcgcacatcgcagggtgttggagtggttatgggcctggagtggaggtcagtctctggctctgccactcgctgtgtgtgatgctttacctgtgagtgtgcctcagttttctcatctgtaaaatgggattaacagtactaccactgactcttaggagaaatacgtagcacagagcctggcacagggtagctgcttcctgaatgcctgctgttctgattttttgtgttaatgctgaatcttcacgtgtgcccgcatagtaggcattggtctcccttccagagaggagactgagtggccatgggagcaaatacctcagtgactggacactaagtagtttccaggcagagagcaaagtagaggcctccagccctacaagcagtgttctggaattcaggggcctgctgggttttccgagggcctgtgagtcatgtgctttagaaaggagcctgagaaactctgtccccagccccgccccgtggactccccctctgaagtgatgcctggcttccaggctccagcggctggttgccaaggagtccagctgccatcccctcccacagctgctaagcaggcatctggttgccaggtgccacctccttggacatcttggctctcagagcgcctgtctcggctgtctgaggggggcggggtccatgggggacattggactttagaacctgggaggctgttggggtgtgggggccagagcagccctgaggttgtggtccaggatgacccggactctaggttcactcttttagcctcattcctcattagatgcccctgcaggaggctgggcaggacttgtgtccccattttacagagggggaaaataagcctcagggggtgaggggagtctccagctgggccttggggtcctctaccgtccaggggaaaggtcactgtgctcacctccattggtgaggatgtgatgcttgtctcttccccctgcttgttagatgtgagagccctccttcctcagggccttgcctgctgagcttacaacagaaccctgtctccttagctgcacctctggcccccacctaccttcttgcccagatttccaaaaccgcctgtattagtccattttcatactgctgataaagacatacccgacactgggcaatttacaaaagcaagaggtttaatggacttacagttccacacacctggagaggccttaaaatcgtggtggaaggcaaggaggagcaagtcacattttacatggatggcggcaggcaaagagagagcttgtgcagggaaaccgcaccttataaagccatctgatctcttgagacttattcactatcacgagaacagcacgggaaagacctgcccccatttaattacctcccattgcatccctcccataacatgtgggaactcaagatgagatttgggtggggacacagccaaaccatatcaccccctgcctgagtcccctttcccagtccttactctcacctgttcactctgctccagccattgtggtctccttgttgtccctgtgcaccaagcaggcccctgctgccccactgcccatggtgtgctctcccttggtaacccatggcttacctccttacctcatctgggtctcagctggacgtgttcttatcagggaggcttttcctggccaccacatttaaaaaagcacccgtctccttgctttatctctccctttcctgcttgatttcttcgtaaggcttcgcagtctattctggtgaatctccctggctccagctccacccctgtagaatatcagctccgtgagggcaggagcttcatctcttttgttcatgctcatccccagggcctacagcagtgcctgtccttctggacgtgctacatgcgtcatttgccgagagaaccaatgagtgcctggtgtggtcagggatgcaggagcagcgtgtgcggtggtggaaaccgtgtgagcaagggtgtggtataggtgcctgtttccccaaagctgaggctggaagcaggttcctgtctcccactggctagtacctgcttctcttttcggagggtagtggcccctgccaccctgcagagccatttaacgctgaattcagcctcgctctgtggaaaaacaccttgccccatggcaggctgaggctgtgcgtttccatggagttcctgttttgacctgatggaaaatctctgtgggccaccgtgtgcctggccagggcagcggaggggccggagatttgcctggatctgtggcctcagccagtggtttcagccgtgcgggtccagccactccctgccctgtcacatccttccagcttccctggcaaagcagcttctcactgaggctggaaggaggtgcccaggttgggggagagaggtgggcatctttatctgggtttccagagcctgacacaccctgaaaacatggcagaatcaccctcttttatgaatgtagaaactgaggcagggagtggtgaaggcaccagcttcaggccatgcaacaagaaaagggtaggtctgggatttgaagctatctctgtctgaccccagagctctgaaccccagaaaccacacttccttcattctcgggctctgtcctcactggatgtgaagtgggaggtgaagtgatgaggaaagtggaagacacacagagatagcagctttcaacccctccctcgtgtgtccccagctcctcagccttcaggcctccgctctggtgtcctcctccaggcagccttcactgaatgcctctgcctaggtcaccctgcccagcactcagcacgattgcagttgaatgcacattgtgcaaggatttgctgacggacggtctgtctccttcaccagactgccttgcgtgaggtcagacttaaaatgtccgagattgaactctctacccgccccccaaaccacagtcttcctgtctcaataaaagtggccttcatccttgccagtggtacaggccagaaaccagggagacggcctcgacttccctctctctcgtccctcacatcccatctctcagaaaatcccgtgggctctgtcttggaatacctctggattctgaccacagctcaccaccaccctggtcaaatcctccatcacctcccgcctggacgattgcaggagactcctcctgagctccctgctacagtctgttgttcacacacagccagatggccccttaagaactcaggtcagatcctgtccttcccctgctcagaaccctccatggctcccaccttacccagagaaaagctgaagaccccactgtggcccagaaggcactgcacattctggctcctggttaagtctcttgcctcgtttcttcctgctctcacctcgccctctctcagctttccttgctgttctttgaacacaccgggctcactcctgcctcagttcctctgcaggtggtattcctgctgtctggaacagtctcccctagatagccacatgtccccacctcttcatgtcagtctcagctcatctgcttctcagtaagtacctgctgaatgaatgaatgaggtcccagaggttctgtcctgagacagttccttgctgctctgtggttggtgcattgctggtgcatcacatgcttagcggtgatcaggaaaggggctagtgtggggcacttggaggccagaggtgcctctggtaggatgtggtagctagatgccaggatgagaagcttgaacttaataattggtatggacattcctttttctttcctttttttttttttttttttttttgagaccaagtctcactctatcactcaggctggagtgcagtggcgtgatctcggctcactacaacctttgcctcctaggttcaagtgattctcctgcctcagcctcccgagtagcagagattaccgacacctgccacctcacccagataatttttgtatttttagtagagacgaggttttgccatgttggcgaggctggtcttgaactcctgacctcaggtgatttgcctccctcggcctcctaaagtgctgggattacaggcatgagccaccgcgcctggccagttatggacatttcttgagcacctactgtgtgctggtaagcactttacaggtcctctcttacttaaatctttttagtagctcttgttgtggatcctgttttgcccattttacagatgagtaaaactgaggtcggcgaacgtagtgacctgcccagggatatgtggtccctgagtacacttgttttgatttctccagacaacttcgccattggccttggcactcagccatgcggccatcctggctggacggcagtggacagggtgagtcctagcccagcctgctctgccccttcctccttcctcagccctcagtttcagggcagtaaatttcctcagcagacatgaagcgatttgtatactgtcgcctttcctcccgctgagctgccgacttcctttccagcttgatgtggtgggaagttccgcaaagagaaaaagggaactgctgggtctgtgtcccgtggttggtggctggggcagtatttggggcattggagtgctgtcctcctatggcactgcttgggctggggcatctcttctgcaggtatggccatgggcacgtctcacccagtgtcacagggacaggggccggcctgattcaccagaaacagggctgccacgagctgcgcacctgcgccttcttgggggcatgggcaccctgcagggccatacctgtgccacccaagaaacctggcccagctttctggaaccccagttttgctcagtgatatggctggacacattatttttacttttttattttttagttattttatttatttatttattttgagacagagtctcgctctgttcagccaggccggagtgcagtggctcgatctcagctcacagcaacctccgcctcccaggttctagcgattctcttgcctcagcttcctgagtagctgggactacaggtgcccgccaccacgcctagctaatttttgtatttttagtagagatgggatttcaccatgttggccagggtggtctcgaactcctgaactcaggtgattcgcccacctcagcctctcaaagtgctgggattatagatgggagccaccgcgcccagcctagacacatcatttttagaggaaaatcaaatgcaagtaataataatagcaaaacacgcttgctgaatgcttcttctatgctagtgcgtggcatcacaccctgcccacagggctgtggtgaggatttatgggtttctgttgagaaagcacttggaaccgtgtccggcatgaaggaattcttaatgagcatcagctgggcctcgggttcctcctccgcatggtgatggggctgcacggctgataaggcttgaacttttgttgcctttttttattttgagatggagttttgctcctgtcgcccaggctggagtgtaatggcacagtctcagctcactgtaacttctgcctcctgggttcaagccattcacctgcctcggcctcccaaagtgttgggattacaggcgtgagccaccacgcccggctagaacttgttgcctttggcatcattttagagcaataaattggtgcaaaccctttggcaaaacacttagcggagacaacaagagactcccaaacagtgattcccctggaattgcaggggatcccactgctgaaaaaaatcctaagcatggggggaaaatccccagatacttttatgtaccaggttactcattgaaacaccactgtgagcgctcaaaatcggcaacaacctaaaggtcggatagggaaatggttagggacatgagccacacccatttccttagccactgtggaccactggaaaggtgacatgcaaaattatgtgcaacctgtgatgacagccatgcctaaaaactgcaggagacgccatggaaggtgacatgttgaaatattgacagtgggcactgtcagaatgtgtgatttccagttttcttcctatgactttattaattttcctgatgaaaggcaactgtacatactgaaaccagaagactcaaccagcaccttctaaacctggtgccccatcgcaggtgcctggggaagcatgttaacaaggcagatgcccaggctcctccctctcccactgcgttggagcctctcagtcttcagggcccaggaatcagcatttccactgagtgccccaggtgattcagacgcctgctgtagcctgagggtcatggattagggctgccaaggggttgccttgtgattgcaaaggtttgcaaatctgggtctccagtttcctttccttcctcacttctgcatggccagatttttttttttgagatggagattcactttgtcacccaggctggaatgcagtggagcaatcttggctcactgcaacctctgcatcccaggtttaagtgattctcctgcctctgcctcccaagtagctgggattacaggcatgcaccaccatgtctggctaattttttatttttagtagagatggggttttgccttgttggccaggctggtctcgaactcctgacctcaggtgatccacctgcctcagccttccaaagtgctgggattacagatgtgagccactgtgcctggctggccagatcttgcctgtttgtcaaggtcatgctcagggtcctccctgacctcctctgagctgctttccctgccctgctgcccattctcgggttcgtgtacctcctggagcccttcagggttatctgggagctttggaaaaagagctgatttcctggcttttccagacctcttgagtcagactgtcatttcctggtatacctcctgggcaaaacatgtgttttgaaaagcttgacaggtaattcttatgcccgcttcctgggcatcagacccactgacctagagatggctcccacctggcttttaaaaccagatttctaattgttctttttaattggtaaagatagcacatattcttagcagacaattgaaatcctgcagaaaattttagaaagtccattccgtgataaacctcaaatttacctccttgggcttacaagtgatttatggagcacctgctgtgtactgagtgtccaggctgccgcagtgcacaatacagacaaaagctctccccctcaccgtgtgtgcagtgaagacagacagtgaaggtgtcagccaaggaaaatttgtagtgttctcaggtggtaagtgctatggaaaaacatgaagcaaaattagagggctgggctgctgggaagatgtggcagttttcaatggtgtgggcagggcaggcttcactgaggaggtgacgtttgagcagagacctgaaggagcagagtgaatgagtcatgtggttacgtggtgacaggcgttccaggcagaggggacagccagtgcaaaggtcctgtggcaagagcctgtctcatgtgtttctgcaccttcaagggtgccagtgtgggaggagatgagggagaagggagttgcgtaggaggtgaggtcacagagtgtgagctcattctgatagcgcagcctctgttggaggattttaagcagaaaggcaacatgcaagggctctttgatgtacgaagccggccccatgcctagtgggtgctggggctcctagagatgccccagcgacgacggtagagtaggtgtttgtggctgtccctgtgcctgtggtgggcgggggacacctctcacacacctggagaggatcccctcaggattcaaggcacgtctcattcaacggggcagcccctcatctcccctcccccgcaccaccacccccagcctctttgcttcagaacctgagagcagacacaggcttcctgttcccgaatcttcttagaagcagggttgggaggcagcgagggggtgtgtgtggagggtggctcgtctctttggcaacgggcctcaaagaagccagggcttcgtggatgcacagttgtagaaggaatgggaatggggtctggctctgcctgaagccagaacgatgtattggccctcagggcttgagccaggacaacccatgcgtggacagtagacaaaccagggtggacggtgacaatctccttttaaaccctttgctgaaaaaaaaaaaagggaatagtttctgttgcaggataattacagacagtgaagtgcacagctccattggtgattacgtatgcatcaccaccaggtgaagatctagaacattctttgcctccagagtccccttgagccccttgccagtctttatccagccttgaatgacgacttttcttttttttttttgaggcagagtctcgctttgtcacccaggctggagtgcagtggcatgatctcagctcactgcaacctctgtctcctgggttcaaatgattctcctgcctcagtctcctgagtagccaccatgcctggctaatttttatatttttagcagagacggggtttcatcgtgttggccaggctggtctcgaactcctgaactcaagtgatcggccgcctctgcctcccaaagtgctggtattacaggcgtgagccactgggcccggccgagtgacggcttttctaacctctgtcatcaaagaagggtcttgccagttttgggacttcgtagatgtggaatcccacgggtggctgcacccttttgtgtctggcttctttcgcttgggccatgtttttgagatgcgtccagtttgctgcgtgtgttagcaattttcttttgattactgaatcattttctgttgtgtgagaacaccaccatttgttcatccgttctcctgttgatggacattggtaattttaaaatttgagtttttattgtgttccattctctgtgctaagcactttatgttttgagtgatatttccttgaatcctcaaaagaacactgagagatagaggcttttactctgtgttacatacataggaatggaagcttggaggcttatggaacttcacctcctttcccctcttaaccagtatttattcagcatcttctgtctacctcaacccatgctgtggattcagcacaagcagccagagaccctcaccatcacggagctggcagtgcgcagagaggaggactctaaattagcaaaatgcatagaacaacactttgtgctacctgcattacagggaattaaaacagattatcgaggtagagggtggctcgggggcgacttgtggcttgggtgaggctgcttcagccaggatggtcaggggaggctctctgtggaggtgatatttgagcatcctgtgcagtgacgatgaggggcggggaacagcacgtgcaaagtccctgaggtaagaaaaagcctggggtgacctaggaagggcagactaggcagtggggctgcagtggaatgagacacacgactctggggaaatgtcgggaaagtacagcgtggtctgtagttggagagggctgcttttacgtcgatgcactgacagataagaaccccatcagtgatggtaacgtaagtgttggcatttcactctggtgcgactctgaagttagggttcgttatctatttccttctctgagttaggtggaaactgaggttcagaggcccacgtaccctcccccgctgacaggtggggacttgaaccagcttgtctgacaccagaacctccatcttccagctctcagccatcccctcttcagggccctcgtttgagggggcttcttcatgcttctctggttccatcatctcccctccctcctcgggggctctgtcccatagtcaggtcccccagggaaggagccattgaaagactcccttgcagaatccctggtgagctgtcgtagtctgtggtgtggctggttgtcactggtctggctggaaggcagggagtcgaggtggttagaatgtgtgggcctgacctcatagccccagagctgggagccctttgagatcctctcatctgaccactgttccccgtttcgcggacgagggaacagagtgtgggagcagctttctcagggtcccacagcgagtctgtggcagggctacatttggcaaccaggtcagcaggccctgagtggtgggcgctgtgcagatggggaaactgaggcccagagaggaggaatcagtcatctgaaatcattcagctagtgtgcagcatttctcgtagtcctcatggtaatccatgaagccggcagtgttatcacacagtgtctattttacaggtgaggaacctgccccagagaaaggggtctccctccctctacccgtccatccactcactcaccaagaatgagcataaatgaaagaagatggaaactgggactaagtgggacctctgagaggtcttaggctggtgggcaagcctgttattaattgaatcatcacataaatcaaggttaagttatagtcatggtggcactaagtatgggagcctatgcatgggtttcctgggccctgaccaaccttggatctcactggggagggcagggaatgtgagacttgaagcagctggcaggagggagatgagtgttgcaggtggagggagcacctgtgctgaggcctgggggcaggagcaagctgggtgtgtttggggaacagctgaggatcctggaggccggtctggctgcagcacagcttggaggctgaggtcaggtcctgcagagcccttctggatggggttctcagagaagcggggagcggctgatgggctgggcagggcagtgggtgaccacatttgccttttgtgacgatccctttgtgtcactccacccagggatgcctaagtgatctaggccagtggtccccagccgttttggcaccagggacgggtttcctggaagacatttttttccacggacctaggggtggggaagggatggtttcaggatgattcaaacacattacatttgttgtgtactttgtttctattattattacattgtaacatataatgaaataattatgcaactcaccataatgtagaatcagtgggaaccctgagcttgttttcctgcaactagacagtcccatctgggggtgatgggagacagtgacagatcatcaggcattagattctcgtaaggagggtgcaacctagatccccggcatgggtggtttgcagtagggtttgtgctcctatgagaatctgatgctgctgctgatgtgacaggaggcggagctcaggtggtcatgcgggcaatggggatggctctaaatacagatgaagctttgcttcttgcctgctgctcacctcctgctgtgtggcccggttcctaacagcccacggcccagggattggggacgctgatttaggcctcccaactcctggtcttcccacgaggctacactattctccttcccctaattaaattctcccaatttttgaactgaagaagcagtatagccccatgggaaagagacttggctctgaagcccctggggcctgcacttaggtctggctccgtcctcctcctctgcatgactttgagcaaataactctgttccttgtctgtgaaatgggggtgtaggagtcgcttcctcctgtacccctggcattggcatgcagtaagcacttaatacgtgttgcagctggttgtcgtgtccacgtttcattggaaatgcaggcattatctagttctgacagcttagtatcccaaggtttcccttatctgatctttctaaatggcttcttgctttctaaactcaggaactgaatagatctgaatagtgaaagatacttgatgttgctgtaattattatagtaattactgttattagaccatctgtccttaatgaatatttgtttgtagatacttttgtgggtggggaaagaaagcattttgcagcttactaaacatatgccaaacaatgtatgaaatgtatagctagactgtatgataatatctgttttgtagtaatcataataacagagtattaggattgtgtttggccgtgattcatggagatacaacaggtttgcttttctttcgtgtacatgtttcgagctagcagtcgtattagtttcttgtgcctttaaacagcacagatttattatcttacacttctggaggtcaggagtctgaactgggtcttacggggctgaaatcaaggtgccagcagggctgtgctcctggggggtctggggagaatccgtttccttgccttttccagcttccagaggcccctgcattccttggcttgtggcctcatccatctcccagccagcagcatagcgtcttctggtcttcctctgacccctggcactcactctcctacctccctctttttctttctttttttttttttttttttttttgagaaagagtcttgctctgtctcccaggttggagtgtagtggcgctatcttggctcactgcaaccactgcttcccgtgttcaagcaattctcacgcctcagccttccaagagctgggaccacaggtgtgcaccaccacatctggctaattttttaatttttactagagattgggttttggtatgttggccaggctggtctcaaaatcctgacctcaagtgatccacccacctcggcctcccaaagtgctgggattataggcttcagccatcgtgcctagcccctcttttccttttaaggatccttgtgattatgttgggcccacctcaatgctattgataatccccccctttccaagatccttaccttaatcacatctgcagagtcccttttgccatggaaggtggtgtattcacaggttccgtggattagtatgtggacgtctttgagggattattgttcagcccaccacaatggtcaagggctgttggggcctctctgagagtcctctgatgtctgcaagctctgggtcctttctgtcctgcaagttctccctcctttcacgttggatcagaaggcctggcactgtattgggctccagggacagaagtttcttcccttgtggagcttgggggtcacaactttaatgatgtggccccatcactagtgggaagtgagtggctggtcagggaagctgagatcgcaagagagggttagagtggatgtggcagaaagtcagagcctggactctgatggccccgaggtcagaggccagctttgtctgcttagctgcatgctctgaggctgccgcgtcagccactgagaacctcggtctcctttttcgtaaaatggagatgagattgtctaggatgaggcaatcgtgggaagcattgggtacatagttgacacgccctaaactgaagaccccaagctgcagccaagcagccagtgtctgtactcctaagactggcccttctgctgccagaattccctccctggggccgagcaggctctgggaaaaatcaatgggaggaaacctccatggctgcacctccctcactgaggcctgggccctgaatgccactatttttacattctctcacttttgtgcattgtttcctgactctacaaatacaatccttcaccagctaaggggggactgctcgccctccagccccaggaacaattgtttgggaagatggaaaaaaaatagttggactgaggaaaaaacaaaacctcttgaaagtcattgtcttcagatgtcaagtgtcagccccacagagaggagaccgcattccactcattgtcctgctgcagacaggcacaaggaccccaggatgtccagccaccccgccctgcatcctggggccccgagtgacttggttctctttgtccaggacattccggcgggaaatgccacccaaagcagggcctgttcccagccaccactgtctccgtcacttgaggcttttccttccagccacacgcccatgcaggccccagatgggcgagggctggtgctgacgataagggctacagttcgtacagtgcttcctagtgcattttatcctaacccatcaaattctccccatgcccccgtgatgcaggtatctatttcttttttcttcttttggtgtaatagtgtgagatataattcacgtaccaccatacagtttacccatttgaagtgtacaggtgaatggttttcggtatattcatagagttgtaccaccatctaattttaggaccatttcatcacttcagaaagaaacttcatattggctgggcatgatggcttacgcctgtaatcccagaactttgggaggccaaggcaggtgcatcacctgaggtccgtagtttgagaccagcatggccaacatagtgaaaccctgtctctactaaaaatacaaacattagccaggtgtggaggcatgcacctgtaatcccagctacttgggaggttgaggcagaagaatcgcttgaacccagaaggcggaggttgcagtgagctgagatggtgccactgcactccagcctgggtgacagagcgagactttgtctcaaaaaaaaaaaaaaaaaaagaaacttcataccattagcagtcaggtaccatttttatatccccatttcatagagagggaagctgagacacagagaggctgtttagggtcacacagccagcaaatgaccgaaccaggatttgaacccaaaatacttggctctgtctagaggccattttcttagctttgctataatgcaatggttcttaaccaaggatgattttgcctccaggggacatgggcaatgtctggacacatttttgattgtcacaactgaggagaggagggttgttatttgtatctagagggtagagggcagggaagctgctgagtgtcttataatactcaggacatccctcacagcaaagaactatccactgaactgtcaaggtaccaaagttgagaatctctgctagaatcccactctgatgagcccatttttcaggaaaaaaatcaacaattgaggagcccaaaggagtagggagaagctgggttgtgaatgggaaggattttagaccatttctgacaacagtgaagggagataaattctgaacggcttggagaagacttagcaggaaaaagatctgcattccattagtgatgtctgccctgggtgagggtaaaggcgaagtagcaggttcaggtttgccttgcctgtgtctaggacagaagtctcacactcaggtgttcacagggcgcagcagtgggttgggtggtgggaaattgaggagcacttgtcctgggtgaaggtgatggctatcactctgctctacagcacctgcagccttgtgggcatttgagacccatgtgtcagttttttcaaaagaagcttggaatttggattttaatgggaaacctgatattcaaacttaggcccaagtttctcaaacccctctgcaggccaaaggaatgatgcctctgagttaccagtttgagacccataaggtagccccatcatgtagaggaggctctgcataaatatctgttgaaggaaggatgggttgttggtgaactcaggaaagtttgtaggccaggccccagccccttgatgggggctgcgtgaagaaaagcattgggttcctctcagtgtcccccactgccttcccccactgttgcatcagacctcttcatgacaggttgttgcaacttgttttttgcatcaacttcctctcccgatgtggtggggaacggggcggggtggggtgagaactgggcaccttttaccagggcctagaatctgggtgggggtgggagtagtctactctagatgattgattgactaattaattaaacacatccttttcgagggtctgctgtgtgctgggtccaatcctaggctctgggacaccacagtgacctagacagacaaacatccttgccttcctggaggtgagactcaagtgggctagatggataatagactgatataaacacacataatgtccatggtgacaggtgctgtgaggaaaacagagcagggatagacgttttcgataggattgtcctggaaagactgaatgtgcctcggggcctttgccccggctgttgaccctgcccatgatgctgtgtcctccgatacacgcaatgctgtttgctccctgtgtctgctcaaatgccatcttctcagaacggctttctctgaacagctccttgaaatggcattcccaccttatccttctctgttttcttaccctgctttagttttctttgtagcaatcattcctacctgccattttattttaaaatcagtgtatagtctgtctctgccactactttgtgaaggtggggagttagtctgatttgttcattcactgatgtgtcattggctcttagcgcagtgcctggcacataataggtgtgcagtaagtatttgctgactacacaggcgaatgtaagaatgcataagtccttccgtggcagggtcatggcttatatctgtgtctccagcacccagctcggtgcctggtgcacggcaggccctggttaacacttgctgggatggttggtactcggagaggacttgtccccctagaatatcatcacaagcaacttcctgcccctttcctagtccagcctccctctcctggctcagcctttctgccactttttccaggaagtgtttgtagttacaaagtgttcacctgcatcatttcacttaaacctcaacaactactcctccccccctttttgtttggtccaggaaattgactcagaagtgtggtgacttgctgaagtcacgtggttggcagtcagcaaggaggatggggcagggcagaggggtgcgctggtggtgatgaggatgtggggggctctgcagtttataaagccttccccttctcatctcacctcaggagactcggaagcaggcagtctataataatagagctatttgcaggatggaaaaaactaataaaaataagtaaaaatagtgtgggataaatgtgagtgtgcttggtgcatgtagaagccctacagatgtggttgatccaaatccaggtttccttaggaagcacagtgggttctgtctacctgcaccagggcttggactccctgcagacactctagaaactcaagatggggagatcataatagccaatgcttttttttttttgaggcagggtcttgctttgtcatccaggctgaagtgcagtggtgcgatcttggctcactgcaacctctgcctcctaggctgaagtgatgctctcacctcagcctctcgagtagctgggactacaggtgtgcgccaccacacctggctattttgtttgtttgtttgtatttttggtagagatgaggttttgccgtattgattgattgctcgaactcctgggttcaagcaatcagcctgcctcggcctcccacagtgttaggattacaggtgtgagctcacaggtgtgagcctggccaataatagctaatgttttttgagcacctgctatgcaccagggaccattcaagtgcttgttatgtgtgttagcttctgtaattctcattgtaatcctgtgtactcattttatcccccgttatagaggaggaaatggaggcagagagaataaataatttacttcaggtcttagagcttgtaagcagcagagctgggatttgagcccatttaaatgctttgcctgtagtatttctttttttctttcttttctttttttttttttttttttgagatggaatcttgctctgttacccaggctggagtgcagtggtgcgatttcagttcattgtaacctctgcttcccaggttcaaatgattctcctgtcttagcctcgcgagtagctgggattacagatgtgagccaccatggctggctaatttttgtattttttgtagagacagggtttcactatgttggtcaggctggtcgcgaactcctgacctcaggtgatccacccatctcagcctcccaaagtgctggtattataggcgtgagctaccgcgcctggcctgcctgcagtatttcatatcagcctcacaatagcccatgaagtcagtagttttatggtccccatccatgttatagatgaggcccagagagatggagtcagttgcctaggtcacagagcagtaggtggcaggggcaggatttgaaccaggtggctagttctagcctttgagcctcatccactcttacatactgcttgcttaggagatacagtgctcttctagcaaggagtagagagagtttctaagggtagggagggcttctgagagttggggcatgggaggaggaggtggaatgctggccatatctttggcctccgcaggggaatgtgtatgggttccccgcagatgcagcctggattcaggtgggctagatggataatagactgataatgaacacacataatgtccatggtgacaggtgctgtgaggaaaacagagcagggataggcgttttcgataggattgtcttggaaagactgaatgtgccttggggcctttgccccagctgttgaccctgcccgtgatgctgtatcctcagatacacgcaatgctgtttgctccctgtgtctgctccacgtgaaacctgcctccacgtctgaccggggactgcctgtggttccgcagccacctcctctgaccttcagccctgcacatgtagagattttccccatcagctcagaagtattttggtgttttaacaggcagcgaggccgtcctggtgtgtattaggagaacatctgctgaagtgcctggcctgtgtggctgcggtgctgcaaagccctgtctttcacccccccaagctcgggggggccctacaccctctttctttttgaggctgcattgcgacacctcaaccactccagggcacaccagagggacgctccactgccagcacctgcgctcctctgcctgatggctttgtctgctctgagctgctctgtcactttcagggaagatggggagtgccaggatcacccccactgcccttaaactagtgacagacagggctgatgtacagactccctggcctcctcactccctgagggtggctgtgaggtgtgcgttccacacggtctgtctggggcctcatggtggtaacttgcttggtctcatacccttcgtgggctgccttcccttcttggttccacctccctgttggtgtttccagggaccatctcccacctcccacctcccaaagaaactacttgtactccacttcttgcctcagggtctgctgcatctggggaaccaccccaagggtcctgtcatggtacacccgctaagatgcacccacagcacacactccctgcattctctgtgcacatagccacaggcagagttgattggtaattttgtagacatttaaatcaagatttattctttttgacaatgcagttttccttttgtatttggagccaatgcacgtatttttaaaggcctccaacatttctataggtccaaggaatggtgccaaggaaatgtgcccagggaaggggcctggtctgagctggtccaggggctacacggaattgaaagtgcccaccccttcactggacatttactgaggacttattgggcacctcctgtgatcctggctggatcctgggggccgggggctcccaccgtgggcagaggcaacaagttatttacaagcagtgtcagatttaatcctcatgtcagcgacttgcaaggtgaggctccattacacagattttatagatgaggcaactgaggtgcgaggcttggccgactccagagcctaatgtgtgattcatgccctgttttcctctttcctaaaaaggggatgcagtagcccaccttgtgggattgttatgcaggacgaacatgctgaccatcagtcacctgctgaaccccttgttactgggcatctgctctgtgtccagtccagcacggttctaggtccagtgggtggacactgcccaaacaagctgccaccctcctgggactgactttgtaggggacacaggaactgtaagtgaagaaacagctcagtgcaggtggagggcagtgctgtgggggatggaggaggatgagatacagtgtgcaggggaatgggtgtctgtttcaaatggagcagtcggggaaggcctcagaagaacaggcatttgattctagaggggaattgatatggtttggctgtgtccccacccaaatctcaccttgaattgtagctcccataattcccatgtgtcatgggagggacctggtgggaggtaattgaatcatgggggcgggtctttcccatgccgttctcgtgatagtgagtaagtctcacgagatctgatggttttataaaggggagttcccctacacaagctctcttgcctgccgccatgtaagacataactttacttctcatttgccttctgccttgattgtgaggcctcctcagccatgtggaactgtgagtcaattaaacctctttataaattacccagtctctggtatatctttattagcagtgtgagaacagactaatacaggaatgaattgagggtggggccctgcagatatctggagaaagagtcttccaggcaaagggaacagcaagtacaaaggccccggggtggatggtgccttggtatattcccaggaggcctcagttgtaggttctttgtatgctttcaggaagaaattagcctgttaaagatacaattcaaagcaatatgtttgtgctgtggactatataatgaaatgagttatagatacatatatggactttgtaaatgtgccatgggagtaaaggagtagtaagtctgactttgtaaaaaaaaaaaaagctatctcttcccagtcctctcagagtatgtctgtgactgaatgagtcagcggtggaatccttggggaggatgtttcaaatccaaaatttgggtcttttgggaaagcctcagttggttctgagccagtggctctctgtttctggcccctggcatggacgtgatgaaggaatgctaggtgggaacagagtggagagggttttaatcagcctgggcagtggtgtgggctctgggtggtggacattcttgtgttctggcccaggctgtggaagctccaggccagcttgtgggggtccccaggtttccagagttgactcagagaaggagggctggtcggcagctcagaggctcttctgcagaaggtaaatctttccatctcatatttgccttgccgctgctctgttccccactggcgggcactgccttccctgcacagggatacacatatccaaggaggagaagacagaagccaggggtcctgatgattggggcaggtgatggggtgggcgagagagagcctgtgtgtttagtacccctcccatccagaaaaataaaaacatgcatttatgttaaaaatgacttttgcttaaaaagtagcatgttcattgtagaaatctggaaagggaaataaatgaagaaagaagaaaatggaaattctttagaatgcccctctgtcagttaggattaggttcagtggcttgtgataaaacccaaataacagtgtcttaaatgtgatgaaagtttatttccttattctgtaattataggtgacccagggcggatatgttggctgtaccatcactaggaacataagtgcctactgaatgctgctctgttttccccaacacgtggcttctacctcatggtataagatgtctgcttcacttccaggcatcgcatttgcaatccaatcagtaggaaaagggaatagcagaagagaatccctacccattcctcccccaacccacaaggatacttccaagatgttgtacataatatgccatgtatgctgtactgacctgaacttagttgcatgcccacacctagctgcaagggatgctgggaaatacagtccttatttttaaatctggagttctgtttctaaaggaaaaggagagaatgatattgggggacagctagtaattttggccacattcctacatagtttcttgtagtatgggtatttccttccatacttcatttttctatgcctagggagagagaatttatttaaccaacagtgagattatattttatgtacttgtttgtaacttgattttttttcctagttaaggatacatcaacagtccttttccgtgttattaaatagacttctgcaaactatttttagcatgatcattccttgttgagctggatggtaatttatttaactaaacccccagtgatggaattataaatcagatattgaaggtaaagcttcatgccacatatgagatttattttcccctgtaggataaatacccagaacttggatggatggagcataggatttgggcatttgaaggggtcattgggcaattggggagctccccagactctgggctgtgtggggcggcttgcagcaggctgtgtaagcccccttctgctgttatagcgattttattatcatcgctcagattccaaggcccttgctgttccatgacactgtgcttccgactccccgccacccagatcatgttggggatggggtcctcagggcacccccttttgtcttggctgtgttctggagctccccccacccacccccactcatcgcttccctttgctcccagcccataccctggccctctcaagtttcaccatatgtctggtgaggtcaccccagccacggcagaggtgtccttgggggcagtcgggccccctccccaagcagatcaggttgccggcatcagtctcagggagtgacttcaaggcctctttctgtcctttttatctccagggagagatttatcctccccaggcaacagcagccatgggttccaggcagatggcagctccccaggggcacccctaagggcagctgctacctgttttaaaggctgatgcggttcattgtccacagtcactcactgatggcgcgtgatggagactgtctgggtttaaggcccagctccttcacttgccagccgtgtggctttaaataaggtctttactgcgctgggccttaggctcttctgtagaatggacatagtaataacaatgcctgcctcctcgagtttgaggattaaaacacctagagcagcacctgcacataatgaggcctaaaggtgtagttagtgagttaaaaaggtgttcttattctagttgcctctcccagctcgatatcagcttactttctggagcctgttctcagtttctccctgtctctcccatcctttctccacataccagtctctcttgagcacctgctgtgtgccagcctctgtcccaggcgctgcgtagacggccaaggaaattgacttctgccctgagggagctgatactttagtgagggagatgatactgaatgatcaaacctatccatacttaattgataagagcacagccaatagcggagacgtctgtgaagggtaacagggttcaggtggctatgtagtgggtgagatcctctcttatatgggtccaggggtggcctgtgagaggagggacctctcctgccaattgaatgtcttgggaaaagctctgtaggcaaagaacagcacgtgcgaaggcctggatgctgggggcctggtgtgttcaagaaacaaaaaggagaccagtgtacctgcagctgagccagtggggtgagaagagcccgcattagacagtatttgggcggtggaagaggttggatttttttctaggttttaattagagccttttctgaggcaaggatttcttgaccttgtcactgttgtttgcggtcagctgtgtctttgtggggttgtcctgtgcactgtagggtgtttcgcagcatccctggcctctacacactagatgccaggagcacccctgtcctcagttgtgacaacccaaaatgtctctagacattggcacatgtcttctagggggtaaaatcacccccaagttgagaaccactgggctcaggttagggcgacaggtgagacctggcctggcatcgggagacctggttctaatctgtgttttgtcaccagtttgctgtttgacctcagaccagtgtctcatactcttggtatctccattaagtgggagcttgttggagatggcaaactcatcatccttctaaccctctccctgccacatccatggcagacatcactaatcaattatgatgtggcttcctgctcagtctagagctctggggaccctggaaacactcaggctgggagctgagtaaacagtctctctggtccttctcttatgccccagaagacctggatatacatttagaggaacttgaacgcctgggctcgaggaaacatgtgcatcacctagaggaacttgtatacccataccccagtcgacgagagtatacagctgaaagaacttacacctgagtgccattgtttacagtaaggatgtttgaaacaagtgtctgcagcatggcagtggttacttcatgctgtgattttgactagtaagcaatgaaatgaacaacttgaggtctgtcttattgtggattccccaaagaacatgacccgagactgattcaagggcaagtagcatacttgggaggtcaccccaggaagcatcaataggagagtgggggagtgaggcagggaggagaaggcagccaagaaaggtgtgtcatcaagcgggttaccatgggggccaccggagctgaatccatcaaggcactcggggagatagtgtccatcgagtgcctcagtttcctcatctgtcttttcatgccaggtcctgctggccatcactgagggctgctcccaggcagtcttacttcttccgcacctctggcctgccctgcacatgagagcggggtcttcaggccaagagatgcaggtgctggcagctcgatgtggtgtggggtaagggtggggtctggatagcagatgttgcccagtgtacatatcaacatgggtaaatgtggaagacatgatgttgagtgagaaaatcaagttgctgaaagcatgctacttataaaaatgttgtgaacatgcaaaacaatattctctcttgcttatagatgcacacagcttggtaagtgggcagaggcatgcgtgggaatgaggagcaccagctccaagtaccttgcagggagagaaggtgcccagtggctcacctctctctgtaatgattcctttctgccttttctacttaatacatggaggtttgatatttgcatggtactgtgggtaaactgaactaatctcgagtgcatactgctggggctttgcatatgcagtgacctgtgtctccactgctcagatcaagatatagaacatttccagcacccccaagagcctcctcatcccgtttccagtctgtgcctcccccagacttgttgaatttctttttgcaaatggtttcaagcaaattcggtgtagtattaagatttgccaaagctgggtagtgatgagtttgtgggtgtttgttgtttctctctattcttttctgtatccctgacgtatttcatcatcacattcataaaatgaagaggaggacttgggcagatgtgaggacaagtggtccaggcatgggcaaagcttccgaggctggaggagtttctcaggcagccctggaaatcctgagaacagtattgtgtctaagggaggcttcggagatgagagctgcttttgacctgagtgtttcaaagctgtcaagccttggacaaaggaagagtcgccctggagggtccctttcaccatcctgccagtgcaggggacgccgtgctgcctggaaaagccagtcgtgccttgggcagcaggagggctggtcccagagcctctgctgcccattctttccgggtcacgagctgcccattgtggccttcacaccggcttgtttgcagttcctcagtgggtggcccgagcctcccattgttgcagcacaatagcggtggcagagctcgtgtgaagaaaccaggacaggaagccccaatctaggccagcggagtgcagcactcccagcttcctgccctccctggctgtgctgggtgaggctgcctttgtctccctctagtctggggaggctggagcttgacttcctgtcagtatcccaggccctgttaaaacatcctctaggaaccccagtccctgtcccctccgctcattgtcgtttcaaaaacaggatccacagacttccaaggagcctgagtcgaggtctccggcatgggtcaggcactgtgccaggcgcattccaaaccttcctttgattttcaagcacctgctatttgctgagcactacatttggccctgaagacgtagctgtgaacaagacaggcagggtccctgccttcagggagcttccattcactttatcccatgacattctaaaaggtgctgtattcctatgattccactgggaagagtaaatgaagacttagagaggctagtgcactttcctgaggtcacacagcaggaaggacccatggttgaaactcagactcaccagtttccaaacctggcctctgatgttggattgggggttatggtttcatcccagccatgatccctgcttatcctggcctttcccttaggagcttgtatagattgcttaacctcagtttcctcatctgtcaaatgagctcctaacgcaagatgggaagataggagtttgcattaagaagaggagggcctcttggcggaggtgacatttgaactaaggccggatggatgaggaggctgctcagggcagaatgggggagaacatcttgcaagcaggaacagcatatgcaaaggtcctgaggcaggagtgtatttggcaggtggatagaatctagaatgagagtgtggctgaagattatttatattgaggtgtgtgggaggatgaagtactggaagatgagatcagagagattaacaaggacaagatcatggggaccatggaaagatttggattttaagtgcagtgggaagccatggagattttaaaggcatggattgactgatctcctgtacatatttaaagggatctccctggctgtgtgtgtagagaacagacttttgggagggtgaaggggaccaggagggaaatggctgtgttagtccaggcaggagatgatgatggcttggactcggggggtggtggctgtggagatggggaccagtggttgtagtattcaggtaaagctggtaacatttgctgatgtattggaaatggagtgtcagaggagaggggctgaggacggctagtgggttttggctagagcccttgaaagacagaggtgccattaagtggggaagagttcggtgtgagtttgggaaaggtcattaattaagtgttggacaggctgagtttggacatccaggtggagacactgaatctgcagctggagataagagtctgggggtttcaggggagaagtccaggctggggatataaacatgggggtcataaaaaaaggggatttaacccatttatgctggaggttgcaatttttttttttaataaaaaatcagaccttggcaatgaccttgaagagtaggatataagtaactcccacaagcttagcattccagtaatggaacactaggcataaatgggttaaagccccaagactggctgagatggctctgcactctgtgtggacagagacgaagctgcttcctgtgtcttgccttcctctgtgactcgccatgtggactgtcattgcgccccctcccaagaggcttgagtctgggcaggtggccgggctcccgggggcaggcatggacgtgtcgtgtctctgggtgatggaaaggatctgacagccttgtgcagagggctagcctcctctctgcttacctgctccgcttcccctgaccccagcactatcttgggctgtccccgccatctctcctgcactcagagatctccctagacaagcgtggtgggatgagacaggcccctgcagcccatgtcttaatcagcctgcacctgggctctgtgacagggagaccatgtgctcacctggagcagcccccgtgtggacccccaatctgtcatccatcttggcagggcaggtgactgataggccccacagctccccgtggccctgtggctatgacagcaccatgaattccttttcccaggggtctccatgtggctgcttccaggttagcctacagccagatcccacatcctggagttccggcaaaccaggcggaggtggctgtgggtgctgggcctcggtctcccttaggtgctgactctgctgtctctcctttccccaacatttatccctgtgactctctcagcccatacgtgtgacccctcggcagctcttctttctgccacttttctacccacaccacctggtgccaggccaccgtcatctcttgttggcaccattgcaccctactgccctggtccccccacttttactcacaacccctaaaatccagttccttgcaataacagagggctttttcaccaacacttcaaaactgggagacttttcttttgaaaaaaaattctaatttctggcttcattaaaaaccacaacaacacccaaatccgaacctctggtggtcctgggcctgcggcctccccacgtgaccccacatgaatggtgcaccctcggctcccgcagcccctgtcactcctgccctggtgtcgtcacactcatctactgcgtctcacagaggagagacgtgatttgtctgttccaagcccctgaaagggtggtagaaggaccatggtccattcaaacagtacattcctggcatctgcaaggaagcttcttgtgagatgatctggaaggatctctgagctatattaagtagaaaatccaggtgcgggtcatccagtatacgttgctattttttggtgtgtaaagaggttaaaaaaaaaaaggaatagatgtgtatgtgtgtgtgtttgtttttgcatagattttttggaagaatacccaagaaactagtagctggggttcctgtaggggttggggagggactagatggtttggggctggggtaaggagagagactttctctgtttttgccatttttatttttgacttttgagccatgtgactgtgttattactcagaggttaaattgtaaagcaaagtaaaaaaaaaattgacaggggaaatgaattagagtctgagaggcgcccctgggtgaggaagcaggtgtgtatctttttgggccaaaggttcctcgaaggcaggggctttgagatcttctctgctgtatcttcagggcccagtgcagggcctggcgtcgtaggtgcacagcacacccctggtgaccgtgtgggagtgagggctgctccagtgtgtttaaggtgtaagcagagcacgtttttcctcgtcctctgcctgtgtccctggactcgtggtacctcccagatcctagttggcatttgaacttgagagccttctgtagggccgtccatgggagagctggagacgcggacactcacctctctctgcttctctcctccaggcattcctgcatcgcatccggcagaacgtggccgactcagtggagaagggcctcacggaggagaatgtcaaggtgtggacgctggggctggcccctgttctagagcatctgtgttgctttgtgccttgctcttcccgtgcgatgctcagagggtgtgcatgcagggggaggcgcatcacccgctggctgctggccgccagctttgccctgccccagcttgctcccttcagcccctggaggcctcttgtcctgtgagcaagctgtgcttggtggatgtcagcaggaatttttagccccgggccccactttccaacccgagactttccctctgtgctcattgtgaccccccagtcttccgggctcctcgtgtcaggccctctggcttggagccagtggaaaatcctctcccaagtgcccccgggagccgggcacctccagtccctctcctggcagtcccggcccccgctcccgccctgggcatccagtgtccaggcagggctgatgagtaattgggtccagtttggccttggccatggctctggggagtttgaggaggagatcaataggccttctgtgtgcatggctcagccccagcctggctctccaggcctggctttctgtgtgacctcactctctgagctgcctttcaggcctcggggctctgagggtcctggtgtccaaggtgcccagtatttacagcacacaaaggactcggtcatagaagacattccccccaaacgccctgattaatctggacggtggccttgcatgttgacagctctacaccgaattatttgcataagaaagctgagtcttagagatgtcaaggacttgctcaaggtctctgcatggctcctcctgggggtggggtgtgtgtgtgtgtgtgtgtgtgtgtgtgtgtgtgtgtgtgtgtgtgtgtgtgtgtgtgtgtgttcatgcactgggatctaaactctatgcctgcattcatttattcactcattcattcagcaaatatggctgagcacctcctgtttattccacttatttattacactgtttgttatagtttacaaattatttattataattttaagctgcgacttattacagtttataaaaaattacctttttttttaatgaggtagaagtctcatacagtaaagggtgcaaaccttagtgctgaatgcagtgcgtgtctacgtacgaatgcaccagtgtaccatgaaaccaaatgaaggcagagagcatttcccagccccaactgcccactctgggcccccctcagtcagtcctccctccctaaaggtaatccctggttcctagtaccatggattggttttgcctgttcttgaaatttacattaaagtgagctctttcgtgtccctgcctgcctctgggatttgcccatgatgttgtgtgtagctgtggttcactctttttcattgctgtgtggtgttccattgtaggaatgcaacacagtttacttacccattctcctgtggatggatattttagttatttccagtttttggctgttaacaactattcttaaaaaacatacaatcatgagggccaggcgaggtggctcacgcctgtaatcctagcactttgggaggctgaggcaggcagattgcctgagctcaggagttcgaaaccagcctgggcaacacggtgaaaccctgtctctactaaaatacaaaaaaagttagccaggcatggcggcatgcatctgtattcccagctactcgggaggctgaggcaggagaattgcttgaaccctggagacggaggttgcactgagccaagtttgtgccactgtacttcacactccagcctgggcgacagagcgagattccgtctctaaaaaagaaaataataataataatttaaaaaatacaatcataaaagactcagagaggcaaagtaataataataattgctcattgcggggtctgtcctgtacattgcaggaagggttaacagcatccctggcctctgtctacgaaacaccccttttcctcccaatttgtgacaaccaaaaatgtcccttgacaattgccgcatatcctgtgtgtgtggcggggtggtgggtaaaattgccccttgttgggaacaactgatcagaaggttaaattctaaaatgtaggattgctgggtcaaattgtattagtgttttacacttttagattgatgtggggaaacagggtatctcatatattgtttgtgagagtttagacagcgtatttctaacctccttccttattgtgttttcttctaccacgtcattttaatgagtgcatggaaatatacttgtaatttcaacatcgtcctgtagctggacacagcagttgtgtctgactgtgatgaatgtctgcatactaaatgtggagctgcttgcaagactttgaccttgggaatattattttatctgagccttggttcttcatctgtaaattgggcataacaatagtttctatctcacagatttacagtggggattagattctatgaatgcgtataaagttcttaacacacgattagtcactaattccgattatagtaaataaatattggtaatatttctgttattacaaagatttctattagtggtaaaccagttccggtgtttgagagttcttctttgactacaatgtcacccgcaccgaggtttgtattttttcagtgcttggctttgctctccctctgagccttaacgctgtcctctggcctctcttttcctcacaggtcctgttctcgaacatcgaagacatcctggaagttcataaggatttcttggccgccttggagtattgtttacacccggagccgcagtctcagcatgaacttgggaatgttttcttaaaattcgtgagtaccatgccactgcccctggtggactctagtttttgaaaagtgggcttctccctgggtccctgccccatccgccttcaccagcttcctctgtaggcctgtctgggagatggggtagcaaggtgggcaggtgggcccagtctgcatccctggaactatgggaagtaggtcaggcccagcaggctgtgggcatttttagtgactctcctttccctcagctccacatagagggtgggccctcactgaatgcatgtgtcctggagtcctgcgacctcctggcctggcggggcccctctgccacagtgaccatcagaggtagctagtggccaagaagagatggacttggcatcagacagacctgggtttgagtcccggctcaggcacccactggacagtaagggtgtctgatcctggggtgccccgttgggctgttggtcagagaggctgacgcttgttgcaatagcctctctcttcctgcaagattactaacgcatttggaattgtgggtggtaggctggaagaaggaaggcaactgcttttccataccctctttttctgtactacctgggacccccctcacagacagaagaacccaagctagcctcacgggcacgagatgtgagccaaactcctttgcctctctgagcctctatttcctcctgtaattgcaaagtagggacaattccgtatacctcctaaggttgatggccagactcagaggtaaagcaatcgggtagagagtctagagcagagcttctcagctggggtgattctggcccccaggggacaatgggcaatgtccagacacatttttggttgtcctagctctagagtgctactggtttctagtaagtagaggccagggatgccaccaaacatcctataatgcacatgacagccccgacaacagagaatcatctgacctcaaatgtcagtggtgccaaggtggagaaactttggtgtatcagcactcggccactgttaactcatcatcatcatcatcatcatcatcatcatcatcatcatcatcactaactcacttctccaagggatcacatctgagtggctagagcctaagatgatggagctgtgtgactttgccctcagagggcaatggggggcaagtctcatgtgcgatcaggcgtgcagactaccccaagatgcagtcattcagccaagggccagccactctctacgtgaaagtgagggcaaggagagcttctggccaggctgctgagccactcatgaactgtggtcctctcagcaagttgactgatcttgtctgtgcctcattgtccttttacccataaacgggataaatccaggacattgtgaggattaagcaagataatacaaggagcctgctcagtgcagctcctggcacagtaagtgctcaataaatgtcgacgttatcttcctattcacatagcggacgctcctccatctttggaattggacaaataagagcacaatggggcgcaggtgggctgggtgctagcggagggcattgagcagaggagggaagtggtccacaggccctttggctgctgtgagggggagtagctgtggagggagaactggaagccgggagacatctaagaggttaccccaccaagtgagatgacggtgcctcggaccagcatggtagcagtggagatggtgagaaggggcaagtggccacagtgtgcagtaaaggtgtttgaataggaaaatgaaaaggatgggagggacagtctttcctttgggttcagaggagacaggaagtgctttttctctggagccaacagccaacgttcaaatccctgttctactgctcgccagcccagtgaccttgggcaagtcctttcacctctcagggcctcagtctccaactctgtaaagtgggggtaacgacaattcctgctgcagggggctgtcatgaggatgaatgacctggctcagcaccaagctaatgccgcgtgtcagctgtgagtgttactccggcctgcttcctggagggggtgggcttggggttggctgtgatgtcatgatccgagcttgcttaggattgcctatacttagcaaaagtgggagaaagggtcctcaaggtgcactgtccagtttgccaaaagccctggcccccctcattcctttggcttctctgtctgagccccagaggctgtggggaagtgggtttaactcgcttgtcagtgaggagccctggaccctgaggacacagcggggctattctcacctctctctttctgcaggattcctgacttgctcagagatgcagcggagggctggggggctggggacggggagttcagtgtgcatgaagcaacctcttttccgtgtcctctcttctgctacctgggaccctcctcatgtagcctcatcaaactaggcacctggtgaaggctgcacttaccatcagagtcatgacgtgtggagggtggatgtttaggcctttgtgggaagttgttctgtgctggggccttcctggcatcctccctgggcctgggagatcaagcattttagagcccagctgctcgactttgcatcctagctctgctacttccttgctctgggatcctgggagaatgaccttacctctctgtgcctcagttttctcatctgtaaagtgggtatcacaaaactcaccttctagggtggttgagagaatgaatgacgttggtagaacctggcacataataagtgctcaggaattgtttctcacttgggtaatgtgcgcatctgttcacgtgatccagcgctttctggcacctcccaggcttctctggagtgtgactttgtgcagggtgcccagacctgggatcactgagccccattccaggcgatctatcatgagcccccctgcacctcagcagggctcccgtccttccagcctcacaaagctgctgtgatgcccgggcacaaggatgaatgtcggaggctttgacagagatgaagtattttggagattggttctcccctgagccaacagagagacctgctggaaacatcaatcagatctcttcaacccctctcccagcaccctccaaaggttcctgcctcattggaataaaatccccacagcccgccaggccctgttcattcctcggaacttgctcccctggctctagccacacggatctcctcgctgttccagaacatggcaagcccattctcaccccaggccgcttcctctgctggaccagttccctcagacatccctgcggctctctcccttcttgccttgaaagctttttggaaatgccatcttctccgcaaaggcctccatgccctcctgtttaagttgctgcactcctgcccttccgcgcccctcccctactctgtcattctcaacagaacagtccgcatcaccctttgacacatcggatcttttgcccctttttgcttattgtctgtctctccctagaatataaacaacatgaggacagggactctgtcatgttcactgctctgtctctgcatcagaaatagttcagccccttagccgggcatggtaatgtgcacctgtagttctaggtacttgagaggctgaggtgggaggattgcttgagcccaagaggttgaggctgcagtgagttgagatcatgccgctgcactccagcctgggtgacagggtgagacattgtctgaaaacaaacaaaacaaaacaaaaaataaaataaaaaaaaaatcgagccccaagctcacttgccctctggacatgcaagcaaactgagagaaaggttaagctcaaggtcacgactgtgccagccgcagaagtgggctttaggccatcctaagggctaagccagtgttcttcagttcagctcacacgctaagtttgtaatttttgctatatctgagtattctttgtattattatttgtttaatgctttaaaaaattgattcacttatcgtttgaacccgggaggcagaggttgcagtgagtcgagattgtgccactgcacaccagcccctgcaacagtgtgagactccgtctcaaaaaaaaaaaaaattgattcacttaacaaaacttcagtgaacttatttaaaaagagaaatttgcatcatcattgaaaatagaaaatgagtgctataaatagaaggtaattgtcaaaataaatgcagtagaaaccaaacggtattaccgcattctatctagaaactcttaactacttgagcctttcagcctgaggctgcttacatcacaccagctaagaccctccttgagctaactggacctattgaaaaaggagccagcgttctcagtgtgtgatacagtgttttttaatttaaaatcatctttttaattaaaaattaaaattatcacgcctcttcctgcctgctcacggaggataggttgagtcagtctgtctcaggagttttaaaggccacacctctgtaggttgggtttctggaagctggcgatttgcacacaggtgggcccttggaagcagctaaaggagaggttgcagaggctccaccccagccactgatagtcccatctggaaggaactctggaactaggatagctcttcagattatgcacaattgcagcaagtgggcaaggcctttgcacccttgttgcccagtgggctgtcctcaggagtgggtgtaccgcctcagacaggtggccctcttaggctgaaggcagctctaggagagggccttagctgagggtcattgtcagccagcactcccagcacctggggtaaggggtgtctctgtctctgtgacaggcatttgaggagtgcaccatggcatccactgcagccccaaaggaaagaggtgctgggtccactctccttcccaggcttgtttactccatttactccctgcttggaaacattttcccatggccatggcagcatctgggctggtgagatgctaatcgggaacagagctcttgcagacaggctctccaggagaggaaggggccctggcccacagtccagcccgctagtgtcacctaactgatcagatgggggaagagtccctcaccccctttccccaaaacccaaccactaactactgagtttatcataaactagcaccgagtggacattttctttgtgctgggttctgttctctgtgccttacagatatgcattcattaaaacttcacaacactctttaaaggtggttactattattgtacccattttacagatgaggaaaccaaggcccagagagattaagttatagggcaagcttacagagctaggaagcatcagagccaggatttgagctgacacagtcaggctgtagagtctgtgttttttactcttatgtgatgaggtctcctgaaatacatagtaagcatctcctgtgtgccaggctctgcactagaccctggggatgctgtactaagtaagacagacttgctccgtgctgccacgcggctcgtaggtgggagaaacagagggtaatttaacaaatgaggtcatttcagatgccagtgcagactgtgaagaacataaaatgcagatgtggtaaagagtgactctgcctgaggttgctttcaatcgggaggtcagggccagggctgctagatttagcaaatgaaaacaaaggacacccagggaaattggaatttcaggtaaacatcaaataattttttagtggaaacatgtcttatggaatatttgagacatacttatactaaaaaaaatatgtgtctgaaatgagcattcacctgggcatcctggggtttattttatatctggcaacccaagggtgggatggcctttctgaggggttggaatgggatgatcttggggagggtggtctggaccaaggtgagaaagggcagaagccctgagctgggagcaagcttagctcatttgagagaagaagggagactggcgtggccagagcagagtgagtgatagagagagtttgagggtgtcatagtgggggcagggcagatcctgtagggctttgcgtgccgaggtgaggactgtagatcttattctgagtcagtgaaagccattgcaggttttaagcacgggagtagtgtggtctgatttctgttttaacccccctctccccacagctgtatggatgggtaaataatttggggagactgttgagaaactgagacctgattctcacttctctcctccccactggagaatatgtctgcatgggccagctccttccctcttctgggtcttagtcttgctggctgtgaaatgagtggtttggagctgatggtctctgtggagccactgtcacctgggtattgtggacagcagctgccacctctcacaatccttgagcctttcctgggggtgagctcccctcccctggctgtttccagccagcagctgtccccttctccccccaaacccacagccacatgttccgtacccaccacatctgtgtatgcacaactgtttgtccgtttcttcctggcaaagcaatcagagccccatgtcgggcctccaggaggaaatggaacacttggactctgagctgtcaagagcagcgtttccgtatttgcagggtctcaggcctgagatgcagctggggtcaggctggatgaaaggacacaggcgtgattgaactgggcacggtgctgcagaggggatgttgtcctttgctaaatttaacttctccaagcctcaagcgttgggcccctgcccttcccacaggctgaaggagaggaaaacattgcagaccttgtcgtagaagggggctcaggggatgaggaatgacaaaccagtggtgagcttgttaccccctctcctgcacctgtggcagacattcctaatcaatcacagcattctgtctctaggcttcctgtggggccccagaatcctcctcaccagtgttccagctggcactacccagtgactggggttggtatgtgggaagaaaccgatttgtccctgctttctggcccagtcccttcccttcatctctgtggagatggacagagagaccctgtcacctcactaagatttgggtccatgtctttcattttctgcctttaagagtgtgcatgtatcaaaactgtctttgctgtacgtgacagaaacaccagttcagataggcttaaacaaatacaggactttactgatgcatgtcagtgaaattgttcaggagtgtaggttggcttcaggcatagctagatccaggactccgtatgatgatttcaggaccaggtctttctctgatctcaggctctgcttttatctgtgcagtgctgatttcactcttggagaatgggaggggcttatggggtgcatgcctcacatggtggcaggggttcaacagcagctcaaagagagtttctcttcccagtgattccagctcgagtccttgcgggctcttgcggcccagcttgggtcacatggccactgttattaggacggggaactctgattggttttgtctgggtcatgtgctcacttatggtccctggggtggggtgggaccagcctgggaagaagcacagagctggtctgagggccctttagcctctccgttcctccttctcttttcttcctttcattcatcaaatagtcacaatacctgctctctgccagtggccgctgaccccattgacatcacagcagtgacctcaacagatgaaaacgccgtcccgatggagctgacagtcccaggagattcaggggagaaggacagtgcatgaatgagacgtaaaacatcctggggtcagggaccatcataattcccaaaatctgcctgggaccctcccgatgctttccctaaacccacgagtctatctgctgccttcctcctgactctgcctgtctttttttttttttttttttttttttttttgctgtcaaaaccttcccacctactgccctaccctgttcaataaaaaaggtaatgaagtttctgaaataatcatgctggtgataatagcaacaacattattaagcaataataatactagttaatatttagtgaacacttactatgcaccattggaagtcccttaatataaattcacctgccaatcctcacaacaccattatggtaatgatattgttgtctgtactttatggatgagaatgcagaggccaagaaatgttacttgtcttgaccaagagctggtgaccgggagacttgggctatgaacctagatggtctggctgcagaacttctccttggcacttacagggttgatgctgatagtggttggtgagagtggtcatggtggctttttatgtcactgcaagtcttctctgcaggagcaggtttccagacaggccagttcctgtcacctacaacaaaatagttgtactctttcttcctcttcctcttccctgcagcctgcatcaccacagtctgcagctgaaatcctggttccaggtgtgtccagcagcccccactcacaaggttttacctacggctgagtgatcccctgcagctcagacatctactcacccagctcttttggccttgatggtcccttaggcccatttgagacaagtgggaatagaaaaaggtctgcctgggcagtgttgggggtgctggggtcccctcttctccttccttgccatgtgttggcatctcagtggactgcagatacttgatgagtgagtggtggtttgtgactcagtgcatgtgtccatgtgcatgctgacattggtggtggtgtttggagcatgtagtttgcatgctgtaatgcttgagatcattgtgtggtttcttggaatatgcatcaagattgtgtgtcttgtggtatgtgtgtgtgtatgggggtgcactgtgggtaattgtaacatggtttgtctgatattttcccccattgatccatgtttgtcgattgtgtttatgtttgttgttaatacttgtagagtactttgaagtattgtgtggtattgaagtattgtgaagtattgtgtgccagacaccgttctactcatttcacatatattaagttatttcatcctccagcatcctaagtgttgaaggtcagttatgatgtccattttgcaggtgaggaaaccaaggcctagggaggagaagcacttgcccaaggtcaccctctacttagggaatgtggaactgggtttctggagtcactctgtgcccttcagtattctggtgtagtgcccttgggatgcagcttagtctagatttgtggcttgaaatttgtaccctgggtatttgcctcccactcccatccctaccctatgccatgaccttgagctgacactgtcactggggttaagggggtttgagtcctggttctgccactgcactagcggcgagaccctggggaagcaacttttccttggttttgtcatgggtatgtgagtctgttacagtagttaccatgtaaggctgtcgtggggaatgagtgagttcacccccattccaggagagcagcgtgcagcctgtactacatgctgggcagcctgtactacatgctgggcagcctgtactatgtgctgggtatgtactctgtgttagccatcagcactgacctgggcactttgtggctcagggtgtctgctcagatgatgcacacagagcccccagagtgagctggggtgggctggggatgcctgttaattctaaacccatcctcccttctctttggtttcctatttcctgcagcctcccatcggaaggccatctgggggcttgtttagaaacaagatgagctgcttgctttgtggacccacctcttccttccttagcttgttcgggtctcttgcacacccccatccctagctcaggattgaggccttgcaacccttcctcctccagtgacctcacccacgccatccttgtttagggtttggcgggttctgtgaaccatctggaaccaagaatgctcagttgagagcttcctgctaagaaggctcctgtctcttccagtacgggaaaccctgactgatggttctggacctagtgacccacaggtgacctttagtctggaaggagtacatctttgggctcaggggcatctggaggtcaacagagctagcccccagctataacaactctgacttagggacttttattaactctaccttacagataaggagaccgaggcacagggaagtcaggtaacctgcccaggttcacaggaaatacagagccgtggtgcaagcccaggctgctcttcttgagtctatgctcttgacccccaggccacactgcttcccaaaaagttattcaggcccctgagtgcagacctggggcaagagtggaggctgggaagctggtagtgagtggagccgctttacctgagatacctcctgctgtagcttctcctgggtcagggtagtccttacccctaccctaccagcccagtggtcagcatgtgtcagggcacctgcctgctaccatgacctgcctcccacaggctctgtccttgtcttgcagaaggacaagttctgcgtgtacgaggagtattgcagcaaccatgagaaagccctgaggctgctggtggagctgaacaagatccctaccgtgcgcgccttccttttggtaagttgacccgtcagccctggtgctcccttgcactcggcctcatccttgtggaatctgggcacaagaggacttcatgctgccccatggtgccaaatcctttccttggctggggtaatctcctgcctaaagcagggatcgccaagccttttccataaagggccagctggggaatatttttggctctgcgtaccatacagtttctgtcaccacgactcagctcatgccattgtagcatgaaagcagccctagagaatgtgtagaggagtgggtgtggctgtgtggcaataaaactttatttacaaaaacaggcagagggccagattagggttgactttgcccattcctggtctaaagtaagggttctattaaaaatggcagcaagagtagtaattattaatactactgtcattatgatggttattaggattactagtatttttaggattatttaattataaatgaaagaaaatccaattaaaactggcttaagcggccaggtgcggggactcacgcctgtaatcccagcacttgggaggccgaggcgggtggatcacttgagaccaggagttcaagactagcctggccaacatggtgaaaccctgtctctactaaaaatacaaaaaaattaactgggcgtggcggcatgtgcctctagtcccagctgtttgggaggctgaagcaggagaattgcttgaacctgagaggcagagattgcagtgagctgagatggtaccactgtactccaacctgggagacagaatgagactcggcctcaaaaaaaacaaaaaacaaaaaaacccaaaaactggcagaagcaaaacaacaacaacaacaacaacaacaacaacaacagcaacaacaacaacagagggatttacttttctggggagtttaagacctgagagggctacagagatggcagagtctgggtgttcaaatgatgtcatcagtaatgtatgtctcttgactctccttttctctgctgtggctttattcccaggcaggctctcccgaagtggtaacagggtggcctccagcagctccagacttatacctctgatagctgagcagcttcaggatagagagaacttccctttccccatagtaacagcaaaaatcctaggtctgatgctcgttggctcaaaaccttatccctgaaccaattgctgtagacagagtaattggtggtggtgttctgattggtcacttctggagatggaaggtggggtcaggtctacccatacaatagagcctaagggtagagtggatccctaaagcagttggtttgcatttctggggatatttgtgtttgcatttctgggtatatttgcatttgcatttggtcaggaaaaactgtagacatccatgatggtcttccctacacttgtagagagcctcacttatgtataaaacggattgtcatttgtgacctcctttgagcctttcaaaccactatctgttgtgtatgagtcaagataaacatttgtctgctttgcagacatctcaaaggacagtggtttgaacaaggtgggctcttatttctccctcttgttaacagtgtgggtgcagacagtctggggctggtatagtggctccagtgtcaggggctaaggccctaggttatgatgctcattgacctggtctcagatgacctttgactacatcctacttccaggtggtggggtggagggagggcgggaaggagagcatacccttctccttttcagggcgtaacaggaagctgcacacatctcctcccctcacgtcccatcggccagcactcagccacatggtcacccctagatccaaggaaggctgggaaatacaggctttattctgagcagccatgtgcccagctagaaatgtgatcactgtggaagaagaatacattaggggacactgcatagcctttgtcacaggtgattttgatgacttcacaatattaagtgactttctaggggtccatcctagaaaagtggttgagcttatcctgggtttcagtcccagtctttcacctctgaatcccttctcattcggtcacagacgtctctccacccccatactgtttgttttcccaacagcacataccgaattcagtatataaaagtagaacaattaactaacatagcatacggagtatgaaccacgttcccagagtgctaaactataaaataatattcctaattgcacttctccttcactcagtctccaacaaagtagttccagaatttcgattccaaatgtgtgtttccttcacaagtgagttcatgttgcttggcccggctccagtgaacatctgaggaagggcaaattggcagactgatttactgatttccatctttgtctcaagtgaattaagctttcaggactgttgcttttcatagccggtacctacatcttcacatttccatgtttgcacttatattcataaaatagtctgggcagaatgcaaagatgaagtcacgttactgcaagaccccacatggacagaaatggccatgtctgcattgacctgttggcttgcaggcagcaccaccctgtgacagtccctgctgcccaggctctgggctccctggctgagggtcccaccctctgacagtattccctcaggttcagctaggtcctgggaaggaggaagatgccaggaaggtgtgtgcagggtgtgggaagggaagggaaggactgacttctttctttctttccttcctatctcaagcagtcttcctggtgggtcaaactgccctattcctagcagcagctgggtgggccggtctgggcaggggaggatgcgtggggtgccagcacatgtgccatctgtctccctccttgctggcgtctcccagcttttggccacgtgcagaagagctgtcatgagtctgttatgggacattaaggctttgggaacagacagaatctggctttccatccatgttgtgctgggcaccagctgagtgatggagaatgatggagtagtgtcttaatttttctctgcctcagttttcttgtctgtaaaatggggatgatttattcatttactcatccagcaacttcttactaagcacctataatgcggtagggatcattctacgggctaaagatccgacatgaacaaggcaagaaaagtccttattctcatagagtggccattctagtcgggggaacttcaatgataatgtgatgttaaattctctggaggatgtaaaataagggtgacaggatgttttgaggaagttaggatggtggatgctgttttagattggtctttgggaaaactgcatcttgggtgacatgtaaccagggatgtggaggaagtgaaggagagagagagaggcaggggctatgtagcatttcagagagatagatgacctgcgtgtgcaaaggccctgaggtaggagtgtgtttgaggaattgcaagaaagccaagggtgactagagtgaaggccataagaggaaaagcaggaggagatgaggtcagagagattgaaagaaaccaggtaatgaaggagcatttagtcaatggaaagagtctgaaattttttgttttgttttgtttttgctttttgagatagggtctcgctgcgtcacccaggctggaatgtaatggcttgatcatggcccactgcagcctcgacatcctagactcaagccatcctcccatttagtcttctgagaagctgggactatagtgtgcaccaccatgcccagctaatttttaattttttttttgtggagatggggtcttgctatgttacccaggctggtgttgaactcctgggctaaagcaatcctccctctttggcctcccaaagtgctgggagtacaggtgtgagtcactctgcccagtccaagtatgagattttaaaaaagctttttaattaaagtgtagcatccatgcagtaagtccacccccaggatgacaaatgcttacatatgtctatagcatggaaccaccaagatcgaagaacattcccatcactccagaaggttccctcttgcccattcccagtcatggcccccagacctccagaatccctctgctgacttctcttaccaaagcttagtttttcctattctagcatcgtctatgaacggcatcattcaggatgtgcgtgtgtgtgtgtgtgtgtgtgtgtgtgtgtgtgtggtggcttttgcgcagcatgatgtctgtaggatcgctctgtgggatcccttcacgttggagctcgtggctttgccttagagaatgttccgttttattctgagtgggatgggaagccgtgggagggttttgagcagaggcatgaatgaagctaatttgcatggtgaaaggcccccctttagtatctgggtagaagtgcaggtccagggagggtcttgtttgcatttcctaggggaccgggacaattgccacagatggggttgcttaaaacaacaaaattgattctctttcagttgtggaggccagaagtctgaaatcagggtgtcggtgggtgctccctcctggggctccagggaaggatcctgtctttcctctttaatcttccagcggccgtcggtgctccctggcttgtggcagcattgctccaatctctgcctctgtcttcacatggccttctttggtgtcttctcccctcataaggacatgagtcattggatttagggtcccccctctaatccagcatcaccttattttaactaattaccatacatctgtaaagatccaatttccaaataaggttgcattttgaggttttgtgggggcctggcattttggggaacaccattcaaccgactgcagggctactgcaatgtccgggcaggaagcgatggtgtctgcgaacagcgtggttgtggtgggagaggtggttggattcacatagagcatgagggcctgagctgacacaatttgcctgatcattgactttggatataaatgaacgagaggagtcaaatatgactttagggttttgggcccaagcaactggaagaatggagttgcattttcccaagagggtgcaggctagggtaggagagggaaataaacattcccttttggatgtgtgaggcttaagatacctgcagtacatccaggtggggcattgggggggcagcagagactctagtcgggagtttaggggctagagagataaacctgagtgttttcaatataaagaaagatggtgtttaaagccaagtcagggccaggcacggtggctcacacctgtaatcctagcactttaggaggccgaggcaggcagatcacctgaggtcaggagttcaagaccagcctagatgacatggcaaaaccctgtctctactaaaaatacaaaaattagctgggcatggtggtgtgcacctgtaatcccagctactcaggagactgaggcaggagaatcacttgaacctaggaggcagaggttgcagtgagccgagattgcacactgcactccagcctgggcgacagaatgagattctgtccaggaaaaaaaagaaaaaaaagccgagtcagggtgggatcagccaggggggcagcatgggcagaaagggaggactcaggatagtccaggaacgtgctgccattaggaggttgggaagaccatgaggttgacgcctcatctaactcacttctgtgaattttgagcatttaaggacttctcagaagttcttcccatagtgcctgaaatgtagtgagaatagtgaatgctagctctgtgtgtgtttgcctgttttttttgtttttgtttttttttaaaagaaaataaagtgaaaccacaatctagagtgtttgtggggaagtgtccttggtggctgtgaaaatcttgtgaaaactccttgatcctggacaaagatgggcccttctcacgccaagccctgggggcttctagaaagcacttccccacccccaggcgccctgcactctgcccagagctgacatcaccagggcagcctgtggcaagtgctggctcctaggacaaaggcctgagtgtgagcagcgtggggcccggcatctcccagctgccgcagcctcaatcccccatctgtgccaggggtaaacactggtgggggccattcagctcagctagagctgggacctggggtccccagaattctgcttttccaggcagagcttattgtgatccctaagaggcagtggaagtagctctgagacttgggccagctcttcgtgccacgatttccccatgtgtggtaggggacagtggtccatgcttatttccttaggctttcggcatgaactttctgtgtatgtgaagcacaaggcacagcgtgtggcatatggtgggcacatggtatgtgttcttatggtcttattttcacttgaatataagcagggaatttgttttgttgggcagccccccagtgcttggaactgtgcacagcacacagcacacagcacacaatgtgtatttgttgaatgaatgaataaatgataggatgggaatcccttttcccaagagtctggattcatttccagtttgccagggtggtgttgaggaggaatggctggatgtgctggtgggtggttccttcattagttagttggttagttcattcacttacacataatgggcacatagtgagcctgagggacccaggactgtgaagggcatggcagggaaacacagcagaactcatggttcctgccaaacaaaaatggattcttaagttggagcctctctgaaggagagggtagtgcctgtaatgtgattgagagccacgtggaacaaatggccacctatgaaggctctaggaggaagaagtcctgggaattgagagcaggttgggtggcagggatggccttggtgcatgggtgggcttggggtaagggcacatgggcatcatggtttcaatcccagactcggtgtcaacccgcctggctctaggtcccagctctgtgactcacttttctgggatggtcttggagtaaaagactaaacctctcacaccccagggatctaagctgtgagatgagaataatcatagttttcagttgatagggtggttggtggttgggagccctagaggcctgctggacacatgattagctcttggtcagtgtttacgatggatgatagcagtattattattattattatttttattggggaagagaatacattccagagaagaggcatggaatgagccgagagaggcaagggggctgcagggcggaagtattgacatggagaacactgggttgattcatgtggacaggagcttagggctgagcgtgggagttagggtaacggtattccattcctaagagagctgtactttttaactctgcaagccaaaatagaggtatgcatatgacagaatcacgtacactcctcccagctaaagaactaggacattttcagtaacagttgaaggttcttggttcactttccaacccaaaactctccctccacagagggaacccccactggaattgggtgcattcctttaacacgcatgtctttatatttgacctcatacatgctctccataaacagcgcatagttttatgtgccatgtctttaaaagatctctgtaagtggcttcatactgtacatatccttctttcttttgcacaagagtacatttttggggttcgcccgtgttgctacgtgtggccctggttatctcattttaactgctgcatagctagctaccattgtataaatctgctgcaaacagactgaaacaaaaatacagatgtttccattctcaggtgatggatatttaggtcgcgtcccattttttactgttgtaagcaaggcatttttgagtctcctggtgtgtatatgtgaaagcttctctagaccaggaatgggtgaatttttctgtaaaaggccagatagtcaatattttaagttttgccactatatggcctttttttccccaacaactcagctctgccgttgtagcttgtagggggccacagccaatgtgatggatgtggctgtgtttctaataaaacttaccaaaatggggagtaggcaagatttggcccagtagggtttgtgttggttgtagatgatgcacgttttcacttctacgggtcgctaaatcgcttgccaagtgattgtagctgtgctctgagagcgtttctcatggttgagggtggctatgtccctgtgctatccttggtgggtttcatgaaggtctcctgtccctttgcagagctgcatgcttctgggaggccggaagaccacggacatccctttggaaggctacctgttgtctccgatccagaggatctgcaagtacccgctcctccttaaggtgagactttcccgtatttgaagtgacagaaaactctttggcttcagcataacataaaatttgttagttcaagtatctgagaagtctagcagcagtgtcagctttgggccgggctggatttaaaccaggaccctgcctctttctctctcgttcaccctgctttccaccattcaggcttattttcagtgtggcagcaggtggctgtggttctcctggcctcacatcctctcaagtttaaggtcagtgggaaagagtgaacctctctactaagagctgaggaaagtcctgagattcattctgtctttggctatctgcagccaggggaaggtcatatgccaaatggtttgggcctgagtcatgcgctttgacctggacaaattacatgaagcctttgcatgtaccatttatcatcctccagtcagcttagacccgtgctttacccctgaaccaatcactattgctgtgctctgattagctgagacatggtctcactccactctgatccaatgacagtgagcagggcagtgttgtgttctgattggctgagacctgggtcaggtgctgcactcctgaaccaatcattttgagcaagggaattctaattggctcagacttgggtcatgtgctccaaccttgaaccaatcactaggtcccacaggccatgagtgaggacagatgaaccccacgtgaccaaagtctgagctgtttgtggaaggcagggtgagggcaggcataggtgttggctgggcaaatgcagccttccatacacctgctgtttccttccctgccgccagccctggctttgtcttggctgggcaaagcagggaaggtttgctgcttctgtggggatggagaagtcttgattctaggcttcagcctggctgctggacagatcctgagcccaggggacggctcttccgccttccactgctctcagcccagggtttcagcccttggaaatggctgaacaaaatggctattggccggagcctgtcctggctctgtcctgaaggcagctgtgttttaggttccctgtggggggattaatttggctggtggggcctcattcacgcacctgctcacaggggtttgtgtatttttgctccatgaactggaagcaaaaggggaggggaagggtaccagggcattcttcatcttggttttctgctggagaaggtgggtgatgctggagcctctgaactgggccagaccctggggccatcagctctgcccacgaacacaggactttgctgtgcgcagccgtgggggtgggacgcagctctcccatgcctcctctggtctgctcctgctgttgatctctcccagcaatctcgaaaggaacttcagcacttgttgttgccatggcttcgatccctagataggtcttagaaatgctgtagctcaggtcttcacctggttgtggaagaagcttcaggtgaaacttataaactggtagcctgtggaccaaatcgggcctgcagatgtgctttgtgtgatctgtgtgatgtgtctttcgaacttggattagctaccagcattaagagacagtgtactgtagtggttagagacagggtgggcaaaactgtggcctctgggccaaatatagcccatggcctgtttttatacagcctatgagctaagaatgatgtttactcttttttttaaaagctttgttaaacgaacaagcaaaaccccagaagaatatgtagcagagagtggatgtagccagcagagcctaaaatatttaccatctggccctttacagcaaaaatgtgctgacccctggatgagagtcagccgttgcagccataagcagtctggatttgaatttctctgtcatttacgagtgtgtaaccttgggcaagtcactatccgtccctgtgcctcagtttctcattgaaacatagggttcatgttaatggtacttacggggttgttatgacaagtaagcatggacttagttctaacggcaactcagcaaggtaggcactgtgattagccccctcttggagatggggcagctgaggcacagagaaaggaagtggcctttccaaggccacgtagtagataagcagtagaatcatgattagaacccgggcattctgattccagaggaccacccctaaccatatggctctactgcctgctgagaaggattttggggagttaaactgccaaagtgctggagtgtcagcgatgctgcccttctcagttccctaaatggcgtctaaggtcggtggctctgtgttttgaggccagtgtccttcttctctgcgtttcaaaaccttgaacatctgacccataagaagaaccagcagccatggcccagagctgaactgaggtttggtttctggatcttgcgaaagtctgggttccagcaggcacttggagctgcagcttccgtgacatattttaacacatggtgtcgctggacctgtgtgtacggtggactctaggctcgatgtgaggcccaggcatttctgaggcctgttcccatctccccaggggccagagtttggtctggtgggattcctgggctctggattcccaggagaacagagagagcaggggcagaaccgcccggcgacccgtggaggaaatggcccgcaggaaaagcgatggggtggctgcggtttgctctcctggccagacggctgtttactctgcccacttgcgctccgtcggggcacgccttgtttccttggtctctagctgtgtttatcaagtaggagattgtggggtggggggtgctgtttgggagagaacaagcagggccttagactcccgttggggccatgccttgctccccgcctgacagaactcctcagtgtgtccggcctttggccccagagcgggaacatttgcatcagcaaacacccggggctcaggggaattctgtcccccccacctccggagttccttctttctgtcacattttccagtggattttcaaagatgatcccatgaacttgaagcagctgagctcaaccccccagcccaccccctctggcttctccagattcagatgcccttgcaggggtccccgtggccctctgagccctcttgtttgagctgaactcccactcggggtgggcacacaatgttgaggagcctgggtaggaagagggaagaggcgagaatgaaagcctttttgggaacagcccccaaaagctgaacttgaacgttgcctaagaatagctggaacattctatctcgactcctcagccgaggcccaggataggcagttggcatttcaggctttgttgacttttccattcacgttgccaggggaatgattcaggtttggggtaatgcccctggtgcacagctggctggtgccggtggggggcctgactgtcactgatcttcttagttatttcctggtgatgcacacatctgtgtcgctgctcactgtccacagctgagaacaagacagacccgggccctgccccttggagcttccagacttgggctgggccctgcaggagcttggagtgtgtggcaggggacatcctggggctgactgcaggggacataccctgtctcagggggcagttgccacctttgcccccagctctctggccgcttgatcttggtctcctttgctgcttcctcatctccggggcctctgaggagagatgggccctgggcttagtcctctggccgtttgtttacccatctagacttgctcctgtggtggccttatctactctgtggccttttttaaaaaagcatactcaagggttgtgcaaccattaccacaataattttagaacatttctgtcacccccaaaagaaaccccagacctataaacacttactgtccatcctcccctcctccagcccctgccgaccacttgtctactttctgcctctgtcagttcacctattctggatatttcctccaagtggaatcacacagtgctggtctttcgtgcctggctggcttcacttaggctcatgtcctcaaggttcagccacattggagcgtgtcggtgcctccttcctttttgtggctgaatcatcttccgttgtgtggctggaccacgttgtgtttatgcactcattagctgatggacatttgggtcgtttccactttctggctattgtgagtcatgttgctctgaaggtccatgtacaggatttgtgtggacattcccatggccttaaactccgtctccacctggatgacttcagcccggacctctcccctagaccctgggcttgtcttccggcccgttgagtttctgcatttgagtgtctggcaggcatctcttaccaagcatactcatgcctttccccagaccacctccccaccaacccctccatccccagctcagcagacagcccctctgtccttctggttgctcaggccaaaccttgggattacatttggtgtccctctttccccacccccatgtctcgccatgaggaggtcctgtcggctctgctctcagactctgtccagagtccagctgtttccgaatgccttcacttcccccatgctgggacactgccacggccccagcgggcctccctgcctctgttcttgtcctctgcaggctgctcccagctcagcagctaaactgaagtcagttcatgtcactcctccccggactaccctcccaggactctctgctcactccgagtaaggtccaagttctttgctgttgccatctgcagtgtcctaccgatctcacccatgttcctctctgaccttgtcatcttctctgctcagccaggcttgcttcctgaagttctgaacacaacaagcaggtttctgcctcagggcctttgcacctgctctttcttctgctgggacattttaccccatgtctcctgaggctcactcttcatctttgtcaggcttctgctgctccagtgcctcctgcccaaggccttccctggccacctctgcgatagaggagctgcctctgccattctctgtccccttcaccttgcttttatttttcttcatagcactgctcgctggctcacattctgtcctgggacgcttggtgtcctgattgattttgagacatcagctccccaagggcagggatatgggcctgtttcctcagtgcctggaatggtgcctgcacagggtagatacccctggtcacttattgaatgaatgtggaaaggccacccctgtcttcttgccaactgtttctgaatccagaaattgggacttttatgtgaaagttacttatgtccaagtatcagcttgattcagaacttgttaaacactgtgggccccaacaggacacatcctgggacctgtccattcggaacagctgctctagtggggttgcatccagggaggttttttgcagagtggctgcttggggtacagccttgggtctgtgcacggccgctggtgtctcctgcacctcccatgtctgtctgtgggtgatgcagctgtcacccaagtgcagcgcaaggaccttgtcattcggctgttacctctgtctacttggctgggaggaaagtggctgatactgaggtccgcgctcctgggatggactgagtgaggtccattgccagggaggtgttgacctcaattctcggtgaagggggacaactgggagtgacgtgtttcccggagcatggacgtatactactcatagctttccagaagattttaggtggcaccagagcagactttatgtaggatgggtggagggggaaggggagaagccaacattaaaaaacagtgactcacacagtagaatactactctcttagcaaatccctttccgtcttcctagtgtcctccgagagacagccatggttggtgctgcagtgtttagggtttttgaagccattcattcattcaccacctatttattgagcaactgttatgtgtcaggcactgcttgaggtgctagaggtacaaagtgaacaaaaccagcttgaacccctgtccccttggaacggacattcttcttgggggagatggtgacaaatgagtaagaaatgtgtatgcttgtttagatggaatatttggatgctgtggaaaaaataaatatcaggttcagaagatcagtaaggaccaggagtcactcagggggttgcaggtttagataatgtggtcagggaaggctggactgagaaggaaacatttgagcaaagacctgaaagaggtgaaggaggaagtcaagcaggtaccttggggaaaattgttccagagggaacagccagtgcaaaggccctggggcaggactgttgctggtgtgtctggggaacagtgaggaggccagggtgactggaaaggaagaggatagggagagagcgagggagtaaggttagagaggtaatggagccaggtcaggtatggccttgtgggccatcgtggggtctttattttccatcttggtgaggtgggagccatgggaaggttctgagcagggaggaatgggatctgccttagttctaatggggtccctctggctgtgtgtggaggatggaccgtggggtggtcaggatggagtcagggagaccagaaagtgcttggcttcagtggttcgggtaggagatgtcttgacctggtggtggcagtggaggtgggtgcatttcatgagagttgccttttcacatcctttgcccattttctattggacaattgtccttttgatttcccagagtccttctattattctggatactttgggttatctctttggagtttttgtctgactgatgttatgcagtgagctcctcatctgctggggatcgggcattgtcaccgtcttgctgagaaagcacaggaagtcagagatctcttcactgcagccccctctaccctgaccccatcctcccccaaccacagtgcccaccccttcatcctgtctctcgggccgagcaccaacacctcgcccacagctgccccagagactcaacctgtgtcagcctgtgcttaggctctttcctgtgtggtgagcactaacctcgggacaccccttgttggggagttggggggggggtcctgccatcacctcttcctttcaaagccatgctcagctgccccatcttcgaaggagccttcctagatcaccttttgtggggtccaacctggattctactttctcttgtactgtgtgtggttaagagtgaattcggaagtccaactccacttcttagctgtgtgaccaagggcaagttgctgaacctctctttgtctccattttcccatctgtaaaatgggcatggtagttacctcccaggcttgctgtgaagatcagatgagacaatgcatgaaaaaactcatgaaagcattttgcatactactgagtaaatggtcatgcttgttaaatgttggtgactcaaatattgtaatggtttttatgcttattaatcctagctcctgaccttattagcattgcctctttgaaatctgacttaaactctgtgtgcctcagttttctcctgtgaaatagtgccctagttattggttattataaagatgaaatgaaaaatatctgtaaaatgctgagatgtgcttaatattagttatttttattgtttcaacgtctgttttttccaatattaatataactacattaagtttcttttgactagtgttttcctgaaatatcttatttctccttttgtggttgacctatctgaatccttagactttaggtgctttttttgttaactccatagagttcaatttaaaatctgatctgataatatcttctaacaggagcgtttcgtccacttatatttattgtgtttattaatatatttgaacttggttctgccgtccttctttttgatttctgtttatcctctttttttgatgcttttgcgtctttccgtgttttattttggattgttttagtttctttggcttagttgctctttttcctttatttattttatttttatttatttttgcttccactaagttgaaatttatagctatcatcaccactaccaccaccattaccatcaccatcaatcaccaccatctctcaccattttacccttttctctagagaaatgcctgtgcagagcctggaagtgggagcaagaggtgtagaacttcacggtgagccgtgctagggcctctttgaaaggctggatatagagctcctgaatgtcagagcctggagggtcagtagagacctaccaccctagggtcacaaacacagatacctgcagggcacgtgcaggaaacgagtgagtagggtggttgtaacttagcgagttgggtgggaactgtggcagactagaggacacacatcccttctaaggaacagccactgctcagcccagccaactgttactgtaaggtggaaacgcaagtccagggtggccagagcttctgctttgctgacagaggctggcgataacatttagcttggtctcatcactaccttgcatacccaagaggcataggcacagaaaggggaggcaacttgtccaaggtcacacagcacatcctcatcaaagccagaacaggaacttcctgataggaaccctcttcccactttacccccctttcctctctgagtagaagaaaggagtttttaaaacccacgagcattatttcctttctcctgctaattcctaattggtgggactacagttttcctagacatgcagcagaggctgaaattgttaaaattggaaatacatttgcatgaagtctgcatatgatttgcatgcatgcagggtgtttgtgggtttttttttgcaatgctggggagctcttcacttctgggttctcttggacttccagatgtttttcgcttcttgttttcttttcctttttttttttttttaaagtggtggtgggtatccttagcacctcttcatttgcattctgctgtcaccctaggtatggccgcaggggacttcagcactgtgggtacaggagcaagccaggcttcctgagcttagatggcagagccttgggcaggcctgtgtgactggaggcaagtcactgagtgcaggatcagccccttcctggagttggctgaggtgtccccagaaagttggtgttgttctgcttgacccagaccctgttggtgacaccaccctcctgcctttttctctttgtggagaggacaatatggctttccaacccccaccaaccccaagtcacagagaatggtgggtattatcacatcttccagtgacaattgcagctttgttttcacactgtgggtttatgggttcattttcttatgatttcgcttgccagtgactgaaaatctactttattgtttttatgacattgttaattaaacttacttttaaaaaaagaatagaaaacagaaaagaccaagggtaggtctgacttcaggcatagctgcatccagggctcaggcgatactatcctgactccgtctgtccatgtcctgctgtgtttccctcagtgccagccttgtgctcaggaggctgctttcttacagtggcgtcgttggtcaccagcagcctcaggcctgtgtgtgaccagtgtacccacccagggagaggagagcatgcctttcccagcgtttgcgtaggaagtcccagcctgaggcccaccggctcagcatgggtcccacactctccctgtgtggctgggaggatggaaggtcaggctttagtcacagatccacactgggagctggctggggtgacctctcctggactccatggcccgagagaggagcaggtggaagcagtagacctctgcagctcatcctcctctctccttaccacctcctcttcctctgagccctttgttcttcccccagtcctctcctgggccttgggataaggctgagtgagctgggccttcggtgaagctgagtgagccagtaggagctggctctagccacgtttgtttgttgcccttgggtttgaggccctgcgcctcaggctgcctcttacggccatgctgggagctgatgacacagttttggggacatgaaggggctgctcagagcgggcacctttggacatcctttgagtaaatgtgattgcaggggcgagagggaggtgaggcatctcgcggaagcccaggcttctctgcgccaacatcctctcttctaggaagccttcgcttggggccccactcgcgaaaccacacaggactcgaggggcggatgctggggaaggccatcagcctggctcctggaggggctaatgctgctggttcacagggtagccctggcacacccctctcttccctgcactcagtttttctaaaggatccccaggacctgccctacttagacactttgtgttctaagagtctgatttggaggtgttcatttccagctattactatttctagaggggcctgtagatgtggttggcatctgccaagtcccactttctgtctctgtggccttgggcaagagggttttaacctctctgtgcctcagtttccttatatatagagtgggatgataatagtacccacctcactgggatgattcgaggatgaaatgacttaatacacttaaatttcgagcagtgcttggtgcacagtaagtacttagtagatgctagctattaggactattaccacgacttctattttcactattattcctactatgcagaaatcataagaaatagccactattaccacagacataatgacgatgatgataaatattgtgtccttattgggtaccaagacttttacattcatcaccccattggatccttacattagccttagggggtgagtcttagcctccttcacagatgcacacacttggctttagagaggtgaggccacttgtgcaaggccccacagctgagatgtggtggaggcgaagtagagaccatgcctcccttttcccagcacccattctcttgaccacagagctctccagtttcatcatctgataatgggtttgagctagaataaggcattagtgggcctgaatctatcattgatacttctattgatggggaacttactaccttacaaggtagccctctctcttgcgagaaagctccaagtggtgtaagaatggattaattcattcaaacagtggtctcttgcactggtcccattggactccttgaggtcttacagattcaccgggcctcttagtcatgtagttctcccaagacgcttagcaagcaagcaagcaagcacctcttgggttccttccagaaatactcttctctgggccaaaccctggaagttcatgtatctgttccactttggatatggattccagggttttcagtaccatagtatgtctcctttgaatgtgactctattctgatttattagtacagtctgttcagttctgaattgggcaggagccttctcacctccctcctttcgcatgttagacctttgttagtatcgctcaagctctcgttggctttgaagatacccacattttatgcctgtctgagaccagctgggacaccttcgagtttccatatctgtgcactccctctgagactgtgaagcagtaggaactttttcaaataagagatggaaaaactagcccaagctgacttacacaacatatatatgtaaaaaataaataggctcacataactgacaagccatggatagatggcttcaggtatggctggatcatggtgtctcaagggaattgcccaactgctttcctaagctgctgcagcattttatatttttaccagcaatgtaggagggctctatttttttcatatctccaccaacagttgttattcatgttttggattatagctattccagtagatgtgaagtggtatctcattttggttttgttttgcattttcccacatgatgttgaacatcttttcatctgcttattggacatttgtgtatcttctttggagaaatgtctgttcaagtcctatgcctgttttttacttgtattatttatctttttgttgttaagttgtaagggttctttacatattctgggtacaagttcctcatcagatgtgtaattgatactattttcctcattaggcagattgtcttttcccttccttttaaattttatttattttttggctttcacgttggggtagtgtcatttgaagcacagaagttttaaattgtggtgaaattcacgttatctattttttttaagttgcttgtgcatttggtcatatctaagagcacttcgcctaacttaaggtcacaaggggtttactcctgtgttttctctgacagttttatagttttagttcttacatttaggtctgtgatccattttgagtccatttttgtgtgtggcatgaggaaggggccagcctcattttgttgcacatggatattcagttgcatcatttgttgaaaagacagttcttttgtccatttaattgccttggcatccttgtggaaaattaactgaccataaatgtaaggatttatttctggactctcaattttttttgatatgcattgatttttacttttgattttctttttttttttttttttttatagttctgggatacatgtgcagaatgtgcagctttgttacatatgtctacatgtgccatggtggtttgctgcacctatcaacctatctctctctctcttttttttttttaaaagagataatagagacaggttcgttctgtcactcaggctggagtgcagtggcccgattataactcactgtaacctggagctcctgggcccaagtgatcctcccacctcagccttccaaaagctggaactacaggtgcacatcactgtgtctggctaagtttttaaaattttttggtaaagatggtgtccttctgtgttgcccaggctggtcttgaactgctggccaccgcctacaattcttttccattgatctctaggcctatctttatacagtactatgttgcctctttttttatgatggagtctcactctgttgcccaggctggagtgcaggggcttaatcttggctcactgcaacctctgcctcccgggttcaagcgattctcctgcctcagcctcccaagtagctgagattacaggtgtgcaccaccatgcctggctaatttttatatttttagtagagatggggttttgccatgttggctaggctggtcttgaagtccttacctcaggtgatccgcccgccttggcttcccaaagtgctgggatcacaggcgtgagccaccatgcctggcttgtgttatttcttcttttttcttttttttaagatggagtcttgctctgtcacccaggctggagtgcagtggcgcaatcttggctcaccgcaacctttggctcactgcaacctccgcctcccaggttcaactgattctcctccctcagcctcccaagtagctgggactacaggcacgtgccgccacgcccggctaatttttgtatttttaatagagacggggtttcaccatgctggccaggctggtctcgaactcctgacctcgtgatctgcctgcctgggcctcccaaagtgttgagattacaggcgtgagccactgtggccgttacttcttgagatcttgaggagtgtgccgggagaggaaacagcaagtccaaaggcctggaggcaggaatgggccctcattttttggagctccacagagtggagccaacatgccccgtgaaccaagacaccaaagctaacacttcccctgcggttttggtccagctatgggcctggccaggtcttgcttggtttcaattccctacccctaccactgacctagagcaagaatagagatagaggcggacagatagaaaagggaagcagcctttttttcacttttactaactactgggtgttggcagccccacagggaaccactggaggagggtcactgagattccaacttccagggtttgggaggagcagatatggtggcagtgcccatcagaggggtgccatggacccatcaggttttagcttcaagaataaaagtggtgagagcttcctatttgttgggggaggtgggaagaggcccagggcctcaggctggagaatcacagaatagtgattcagaaatgtgagctctggagctggaccgtgtagccgcttagctgtccgtgcccttgggtaggggaccttgcctctgtgtgagcctcaactttctcatctgtcaagtggggatagtaaaagcacctgcctgctagggccattgggaggcaaagtaatttcactgatggccaagcttaacagagccagcagaaggaagaacacagtttcatggtgaatttatcccaagtgccacaacacggtggggtcttttgtaataggatatgttttagctgcagtgacatagctctgaaacaagagtggcttaaacaacgtctaagcttatttctgtcaaggcagtccagggcagcatggtggctccatgctgacagcaccaagttctgccaaccctgaggtgtgcccctcaccaccagggtttcaggtgctcgcaccatgcccacattccagccaaggaagagggaaaggagaagggaaactgcacccggcacttctgctcgcgccccatccatgagaaccttgtgtccaggcagactgggcgtgtggcctttattccaggtgccctcatgctcagctaagaatcagttctgttgcttttaacaaagggccagcaaacttttccattaaaggatcagatagtaaatagtttaggccttggggtccatacaatctgtcattgtagtgtaaaagcaaccactgacaatatatcagtgaaatgaggatacttggttccgacaaaacttttttttacaaaaacgggtgatgggttggactcagtccttggactgtcatttgacccctgctttggatgaaagggatgatgggtagaacctggggcgggggtctcactaactggcagcctctgtccctgcccaccgggagctgactggccacattcactccctggcctcggctggcctcacaaaggtccagatgccaaaaaccacttcagggaacctgggactggggtagctttgcaggatcgaatggaattactgaatatggtcataagatcacggtcttatattgtaactttgtggacatgcctacaagcaggctgatggcttaggggagtgtctgccgtcatctgtgtacaacagagagcccaacatggggccaggtacactggagcctggctgagtggatacatgcatgcatggagtgaatgaggcacagagcttctgtgccaccctctgctcttgcctggactttggcagtagccataactggtcttcccactttatattcactgcacattccatcccgtgcatcctcctgtcagcagccagggaggtcctttaaagggtgagaaggtggtgtcaggcctctgctcatacccccatcacctccccatggctcttgggaggaaacccaaacaccccactgcggcctcatgtgatctggccttggcatgcttgtctgaatctgtggtccatccctctcgctcacttgctctgctgcagctccgctggcctccctgctgcttctcgctgcctcagggcctttgcacgtgctcttctccttcctggagtgctgttcctgcagacgcagtgtggcccgtggcctcacctcattcaagcttcgctcgcaagcctgtctttccagagagaccttctcagaccacggcacttccctcactcattgtccctttaattctataaattatatatttatttgagaggaaagtatttgtacttaactgtctgaaaagtcgtaaatagcacggggatttagagcacaaactctggagtcagactgggtgggctcagatgtgctgtgtgaccttggacaaacggtctgacctctctgtgcctcaggtcttgcatctgccaatcgagaagaataatggtgcctacctgatagagagttgacatgaggatcaaatgagcttgacaggagcttgagggcttgctgagtattagctgttgttactgttggtagtagtaatagtcattaccttgttgaccggtctactcttgaccatgagctcccagaggaccatcttgttctttgcccagcctccacagctcaggctcacaccagttgctcagccagtatttgctgagtgaagaatgagtcgaaatacactccgcattagcagagctggccctgggtgccctgcctgcctttgtgttgcttcctcctgaagccttctgggcttgcttctcttttgattgatcaccagcattttcaggatatggtgctgctctctgggcctttctcaagcccccagggaagtgcctttccagcctcattgctggggcctccagaggaagagcagggctccatctcccttcttttgcatcctttgggcacattgcctgggtgcgtggcaagagctcagcaaagtcccaggggcctgatgatgcagaccagctgggccttgggaatcttaggacctggtcttcagaaaataggatgtttgttttcggacagggaagaaaataagtgaatgaagaagggatgtgtttgaagttggtttactccagggagtgctcagaacaatacccttttgtggcaaattgctgctcacagttacagctagcgtgttgtcatacagcaaggagaatgctaatggctcgcatatattgagtgcttactatatatgtacttggtgcttttcctacagtacctcatttattgcttaccacaaccatgagcagcaccaggcagcctgggttcaaatcccagttcctccttgtacttcttcgaggccttaggctttcttgctgtgcctcagtccgcccatctgttaaatggtctaataacagaagccaccttaaaaccgtggggcgaaggctcagtagacattaattgctgtcatcgtcatcaccatcatcctcatcatcacaggtttgcagatgatgaagccgaggcccgggatagagaggggactggcccaaggtcacccagacagtgaggggcagagtcagcccttgaacctacatttgtgctcgtaactacgatgcaagagtgtcacatctgcggggatgttatctggatcgtcgagggagcagagagctagggcataggggagagactggagctattgggcgtgtttctgggtcagatgattaaagaaaattatctctgccagcacagttcgggatgaaagactgacgggggcggttgggtgatttgggtaatttggcctgaaaaatcttccttgatatctcaagtcccagctgatcccttcctcctcagttcctctcccatcacatttactggctggaatgttcgattaagactggcctggcctttgcaatgtcccagcctgcgtctgagttgaggggtgagctggcagtgggaaacggtgggggcagggggcttctcatggattaagagccacttcatttgctcagtcccatatccttgtgaaggtggggtattttttatgcccatcttatgataagaaaaccgggcctggggaggagcagtgttggggccgcctctgtgaccgcggatctctctgtttttctctctctcgtttattccaccccagacacactgcctcctttctgttcctcattacataccagacatgtgcccgcctcagacccttcgcaccacggtgccccctgcccggcaggctctcccctcgggtttttgcagggctctctctcttgctctgtccagggcctctgctcaaacatcacctccagagagaggcctcccctgacctccttgtgaaacaatgcttccctctccctcattctgatttgtctttctagtgtttaccactgcttgacattggattccatacctgagttttctttgctttggctcatctcctttactagaatgtaatgtccaccaggcgaggagtttttgtctgttttcttgggttcagctctggcctgggtctcctctggattgattgatgtcttgctttcttctccccacctctattctaccccaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggaggtgtgtacaggacaggagggggcttcctgggccgcagggggccaggaggtgcacaggtgcagtcatgaactgaggcctgggcacctgtcagtctgcaatgtattttgtttggcctacagtgtttgcaaaagattgcttaattatttttcaattaaatccaaatacaaatttgcatttcaagtttctcttaaaaacttggtgacactgggcccctatatctcatggaaatagtcactggagcctctagtttccttcagtccccaccaccccctgttatctccccaccccttctctttcatgcattgcctggtatgtggaggcctttgagctgttgatgccaacgtcaagggtcgggttctagtgtccactccaggacagaattctggctttgacactcctttgctgggtgactttaggcaaatgtcatcacttctctgaacttcagtatcctcatctgtacctggtacatagtaggtactcaataaatggtagctgttagtattactatcatgattattaggggatggggttcttgagatcattggatttaagcccccttgccttccttagattattagaggtttcctgtgaatccgtagaaggaaatgggaaaatatgaataaatgaaaaaaatccatatcagagtaaatacagctggaacaggagattaagagggaagatgaaagtctcttgggcagagattgttacgtgaatcatatgccgtaggccctttggattttctggcctttggagtcacttgccatatttgagatttctagttcttttctccgtgctggggaatcctaaatgtgaggctgtattgctgtgaggttacgggtttggctgcagagaggagaggggctgcattcagggaggggtggatattgtggattggtcaatccacttgccatgtcccctgcgctctttctgctgggccttcctgcccagccgaggctggagagtgaagagctctatttcccggcttcagtttgggatatgatttggggtctggccaagatcagatccagctgcttgagatttggaaggtggaagtggggtggaggccaccccttgtgctatttttgcagcaaagcacagccatggttgtgtttggctttccgtggtaacgttagaagagggcccgggcgccagcttcctgtgcgtcagatgcatggcctaggctttccttttttattgttggtggggtagcagccatgggatggctttgcagttaacagttgaggcaacaactactgaatccttgatgccacctgaggagccttttcctggagcctgagcttggacaggtgatgttctgattctcctttcccacctggggcaggggcagtggctcccctggtgggtgagttctgcattgtggctggtttcctggggccctcggcctggattcctggctcctctagccccttcagtgaataagtaaagcccctcattcctttttgcttaaaagtacatggcttggtttctgtttcctgcatctgaaagttgcctgatcctcaggtgcgtcagttaggatgcatcctcgaagactctcatctcagccttgtgatgtcagagctctgatttggtctctggtgagcctcttctttccctcatgcttccatgaaggcggcagctccaggcaccatgtgttcaaaaccggaggagacaggggcatggccagggtagttagtggggagatctcttccctggtggaggaaaaccttttctagaagccccatacaggtgtcccctttcattgcattggccagaaatgggtcacatggccactttgaacttcaagagcaaatagaggtgactaatttaaacatctgtctatatgggttttgagtttcctggaagccaaggtgaaaagagcaacatacataagttacctaatattgtcagaaaaggaagaagcagagcagttcttctgggagacagagagtttcctggcactcagttggaaaagaaatttctcacatgggccccaaaggagagggtattgagcaagctcctcagcagctgcagcagaagtgatttccagatgccttttttctggtaagggcctaggcaaatggaaaccaagggtctctaaaaccctttatgaccctaaacatgtacagtttgagaactcagtggccctcagtggccagtgttgctggatgcaataggaaataaagtgccttaaaataagaattgttggcagttatttagtacctgttacaagcttccaaccctacaagggaggtgctattatccccattttacagatgaggcagctgaggcacagggacttggttttgaggcccagccctgtaacttatagactgccctgtctcgagtaagtttgccctgcctcgagtaagtttgtcctgcctggtgtgccttattttctcctatttgtttaattttagtgataatatctctgaagttatttttttggtttcatttggaagataaagtgaggtgtggaatatgaatgtcctttgaaaaacgtgaaattgttttctatgaagtagaaaggtttttaaaatgcagtttgttcctcaaggtgacttgtgaaaataatacgttctagctagaaaaaatgacgtctaatagtggagttgcttccatgctatctgttagtagttacagtctctgaggacagcatgccttagggggtagttcatgttaatgatgcgattgcacatctttatttgacatattcttttgatcctttcccatctttctgtgtgacctcttgctgatctgatcagatagctgtcatctctctcttgaaagatgtctgacaaggggcttgtttttggagcaagaggagtcttgttttggccactttcttgctgtgtgcttgaggttgcatcattcatgaatttgatctcccatatgtgtgttttttaccccctgatcctttgtgagccactgtttgtcgtgagactggtttagataaaaccagataagtgaatccacgaatccattttgctgagcacaaggaaatggcagtgtgtcacaataccttgcaagtgagtgaatgagacaaccccctccgtggggagagattcctttgcctcagtttcctcatctgcgaagtcaggatcatgggagtacccccgtcatgggtcacttgaggacgggggagttgatgcttacagagtcctcggcagtgcctggctcagagaaaacgcccaatacatgtcaggaggagccctggcagcaaagtgggatctctttatttatttatttttttagatggaaaaagtatccaagagctttgactggaacttgtgcccagcgtgggctgcgcctcctcagaggcacactccagatgcagccgcatggacttccatgtgaagctcacagtgataaaaaaggaaatgtgtactcttaagaagaaagaaacaagcctggcgcggtggctcacacctgtaatcctagcactgtgggaggccgaggcaggtggatcacctgaggccaggagtttgagaccagcctggccaacacggtgaaaccccttctctattaaacatacaaaaattagccaggtgtggtggagcatgcctgtaatcccagttactcgggagactgcggcaggagaatcgcttgaacctgggaggtggttgcagtgagctgagatcacaccactgcactccagcctggtcgacagagctagactccatcaaaaaaaaagagagggagggaggaaggaaggaaggaaaggaaggaaggaaaggaaggaaggaaggcactccattttctggctctggctctggctctggcagccctggtttaagagatgatcaactgctcactcgccctcacccacaaggggagagaaggaaacaggagtgaggaaacaaaatcaatacaaaagctctcatatttttttcctaccctccctggagtgctttgggctcccagtgggacatggtctctccccttggagactcctgctctagactatcgattgcaaagaaaaatcttcaggttgtcttcgaagagcggcctgagttagaggtgagcaggtcgggggagtggaggctgcttgtctgggttcaagttccacctcactgccttaccacctatgtgaccatgaacaagtcacttcaccacgctgtgcctcggtctcctcatctgtaaaatgagaattgtcctgaggattagctgagtttgtacaagatatttagaacagtgcgtggcatgtggccgcccctacgcatgtattggctttgagtgtgtaaggttttgtcatctccagcgtggctgagtgtgcatgtctggaaggaaggaggtctctagtcctgactggtccacatgtcttggtgctcagcctcttccctgtgcatccaacccctagcaccacccttgacctagattcaaggatttcagggagatcaagagtgcggctgggcttctcagcagggctggggtggagggggtatccccctgtagtgtgctcggcatttcagctgcagtttgccaggtggtgcttggccaaggctggagaggcagcttcccaggctggcggacttcctctcctaggtcccccgagacggacttggcagcagggttctagggctgtgtgatcttggggcttggcagctgggccaggtaccagattcttcttcaacttcccctttggagcctggaagagctggtgggtgggcataagggagccaaggcaaaaggaaggggaggcacgtgggctccagggactgctgaaccggttgtctgccgtgtgctgcgcatgggccatgatgaagccccagggagttcgcgaggatgctgggggtcccaggggctcttcctcatgacagccctgagtcttggtgcggcaggctgctacctcactggaaagctgagatctgcctgtgggcatgccagcatccatgcccacctggcccccagccaagccgaaggccgtgatgtgtgataacgaatgcaggctcctgtcccggctgcacagctctcgaccacaaggaagctgcttccccagtctccagaggggtctctggcactgttgagtgaatgggtttgttgtacccaactggaccacggacacagagcagaccagccctaacagcagcgagagagccccttgtaggccgttagcagacagcctggcttctcagctgccggaaccagttctccttactgggtctcagaaagaattcagtcagcaggtcccagtggggtaggagctccatgttggttctgggtgttgactgtttggggaaggagattttgtgaataattctccctctctcctccccaagttcatttccaggcagggacaacatcacttcttgtttctttgttcagtgtaatctgctggtctgtcacgtgaaactcccttaaaacactgcttttgcataatattccttgggcctaaatgtccgtggcaccctgttgtctgtaccttattgtattaattaaagtctgtggttgactgctgtaaggaagcgatgcagcggcctcagggaggtggctcattagcgttgcaacgctgttctcattagcagtgcagaggcggacagtcagactggggtgggcagctttgctctgccaggacccaggttccctccagctccttgccccaccatctgctgcagtgtatcccaccacccgctgcagtgtatcccaccaccccagcctctggaaagaggaaagggaggaaagccattttctttcgaggatgtgccctggcagggaggcacattggtgatgacttagtcatgtgaccacacctggcacaaggggggctgggagatgtagtctgtggctgggcagccaagtaccagggaagactccattccccaaaatcacagaagagggacgtggattgagggtcagcggaggggctgcctcatttggcattctgtgcccaccaaggtctcttttcttctctctttggactttgggatctctctgcccttgcctgggtcctcttggtttcagggagacctgtgtgatcccaggctctaaggatccctcccagctaggaccttcccatccctgccctcagcctctttatcttttttttttttttttttagacagagtcctgctcagtcgcccaggctggagttcagtggcgttatctcagctcactgcaacctttgcctcccgggttcaagcgattctctgcctcagcctcccgagtagctgggattacaggcatctgccatcatgcctggctaatttttgtatttttgtagagatggggtttcaccatgttgccaggctggtcttgaacttctgacctcaggtaatcctcctgcctcaacctcccaaaggattacaggcatgaaccactgcgcccggccagcctctttatcttaatttttgtcttccaaggtctgctcactcctccctgatgcctttcccagccacgctgcccggaacctcactgacattcagtgaacttcatgcacgtctttgtcaccccttcccctgctgctcaacataggtgaccaggtttgggattgacgtgtaaatctttagcttagctagatgaaatgcccacaggatcctgcccccgatggtttgcacattgcatttgttgagcacctactgtgtgccagagagtgttgtgggtgctgggcatacgtagggcacatagttgattcgggccctgtccttaccaaaggggcatttaggtgggggagatatagtaacaagtcaagacataaataagtagtggggaaggaataggtgaaaaaaaaacccacaataaaaactgaacgaggccaggcgtggtggctcatgtctgtaatccctacactttgggaagctgaggcggttggatcacctgaggtcaggagttcaagaccagcctgaccaacgtggtgaaaccctgtctcttctaaaaaaatacaaaattagctgggcatggtggcgcatgcctgtaatcccagctactcgggaggctgaggcaggaagaatcccttgaacccaagcggcggaggttgcagggagccgagatcgcgccattgcactccagcctgggcaacgagtgaaattccgtttaaaaaaaataaacccaaaaaccaaaaactgaaccaaaatatacccagatgttgactaggacctactattacctgtatgagctgggtgagtcactcctccctgagccccaagtccctctcctgtaaaagggacatgcggtcatatcagtgtgccctccccaggattttcatggcatgctcagcagatagaagccactaatcacgttgtgttgattttctgtccattgacagacttgctggtggagtttttggcatgtggcaggaggtggtagtaggttctgtctctgggaaaggaaggggatgttcctgggttggctcattcactgtgtcctcattgcgcttccagggttccaacctcacagacatctgcactcagctcctcctgcaagggactttgttaaagatctctgcgggcaacatccaggaaagggccttcttcctcttcgacaaccttctcgtctactgcaagcggaaatccaggtgagtggccaggaggctgggatggggtctggcctgctgccttctccaggtgatgccttgggcttgtcacttccctctctgggcctccctttcctgtgagttgaggggtttgttctacatcagtgctgtctagtaggaatacaatgcaagccacgtgttatgttaaatgttctagtagccacatttaaaaaagtaaaaagaaacaggtaaaatgaatttaaataatatattttagttaacctaatagatccccaaatatgagaatattttattcaattataattatacatgtaattattatttaaaaaaattattaaagagatattttgtgttgttttttaacactaagttctcaaaatctggtgtgtatgttatactcacaaaacacctaaatttgtcgtgggtacgtttggagtgcccagtagctacctgtggctcgtggctaccatattggatagcacaggtctagatgactgtggaaactgagaggttctttgtgacacccacatcctgtaattctaagctctaaaagttgagggttcaagaggagcgaagctctttcactattcagtttttggagggtcaggatagtttcttcaccttctttgtgtctttcactggtgcttcttgcgctctgtagagtctaggagtaagtagatggttggctgagtaggtagatggaggcaggtgcatgtgtgatgggaagtgtggtgacgggttgtgtgggcacacgggatgaggcgcagatggctgggggtttgggaggtgaatggatggtagaaggaggcagggagggaaggaaggaatgtggacggatgttggaattgacgtgtgtgtgagtgaatgagtgtttgaatgcttggaggtttaggagatggctggatggaggaatagatggaaagctgggggcatgtgtggatattcaggcagttagagaaatggatatgaagactggcagatatgtgtctagatgaatggtagattggggccttcaggtatggtgtgttgagtgaatggatagatggatggaaggctgggtggttatataattgggaaggtgggttggtgacggaggtttggagattagtagatggatggccaattggttggcatgttgatggatgggtaagtggttggttgatagttgccgaagtggttgggctctgggagggaaagtgggacagttggactactgagtgaatggatgggtgaatgattggagagaggggaaattaggagatggatgtgggggttggatgactgtagtagctggtgggaactgatggttggatgcatgggtgggtgggtggattggcacagagagattcctgaccttaagttttcatgttcagcaggtataggatggtctcagctgacccctgcagcacttttcaaattctctttgctgttactttgtcttaggaacaaaatagtgatgttccagaggcttcttaactcctctgtctagcaaagactagagctgaggcctgaggtccaggtcttaggccctactttcagcattttcctgtaacttgctttgtgtcctaggccatgccactgaccgtctctgagcctcagtttccttgtctgtctgtgctggcctcctaaggtgtggtgagaaaccttaccactggatgagtaatggatgctccatgcccgtgtgtgggcttcccactgtcctcctcctctagagggcctccctgagcctttgttttctcttctgtaaagtgagacgatcagcccctccttgtagtagtgtttggttaagagctaggcccgccattggatccccgtttaacctcttttgtagctctgtgactttgcctctctgtgcctcagtttcctcatccgtaaaacagagtgaatgatcgtatgtacctcttaggaccacggaagatcagatatgtgagtgtgcctgggacatagtgagtgcacagcacagtagctgccagcaccattgttgttaacttggctctggtgtggtcgcacaggtacagcacctggtgcacaggaggctctgaaaccacaggcccttccccattgccctttcccccctgttctgggcttgacccttcctgtgagggcctggacctcctgcttccgctatctcccagtggctggctcagcatggctctttctcatttgctccttcattctcgcccactccttgaggtctgtctatctcacgtcctgctgtcccctcatgaacgcccccttcttctctttccctgcctcctttctggtctctctggggctgtcctcagagtccttcttgggtagtttcagggctgctgccaatgtccaccctgagccctgccccgccgctctgccccaagcagtctggagcaggcacttttcccagaacactggggtttggaaaacagaacgtccctttaggcctctgtgacctgctcccaacttttagatgagtttactcaacctttggcttccgggtgcaggctctgcctcctctggggccgtctcacctgtgcagggacagcagctgattctgatactggattccaagtgggctccctggggccttccttgtgggcaccctgagctctttcaaggccattccccacctcacttccacaagtgagctgggctggctgcagggaaagggcgcatgtgtctcttgagagaagctggcaggcggccagcattcctgcctctggatggagagccagagggctgagctctgagaggcccaggagattgggcaatggtgggtggatctccccacctgagtctgatgtgggtgcaggcaatgcctggagtgacttggtgactgctgactgtgtttgtccttgcctgggtcatgcagggcaccacccatccaggatatgggtcaggggaggtctctgactcacagtgcttctgggcgaattcaaaagcagaggctccttgggtgtcagaagtggaaaacgggagggagtgttttaaaaacccacctcccatcctccagaaggggaaaccaggacccagaagagcaaagtctcatgcatctcaactacctgcttagcatcttagaggcagcagtagtgtgtcgccattaagaacacagagggccgggcgcagtagctcacgcctgtaatcccagcactttgggagaccgaggagggtggatcatgaggtcagaagatcgaggccatcctggctaacacagtgaaacccccccatctctactaaaaatataaaaaaattagccaggtgtggtggcacacgcttgtaatcccagctactcgggaggctgaggcaggagaatcacttgaacccaggaggcggaggttgcagtgagctgaggtggcaccgctgcactccagcctgggggacagagcgagactctgtctcaaaaaaaaaaaaaagaaaagaaaaaaagaacacagaggctctgcttactatctgtgctaccttgagcaaattatgtcagctgtttgcgcctgtcttttcctacctgttatatggggataaaagtagtcctcatttcatggggttgtttttatagagtaaaacatgtaaaggtacacatgtaatgtggttagaataaggcctggtgcgtggtcaagtggaagaaatacaaatacatatatctttatttgggtgtctcacacatagcccacacttaaattgtgtctaaaggggctcttgttttttgtcttaacttctgccccttggatcttcctcattaccagtaaatggtaccaaaatttgtattaagtcaagattctccagatagacccaatagggtgtgtgtgtgtgtgtgtgtgtgtgtaaagagatttataataagcagttgactcgtgattatggaggctgacaagtcccaagatctgtcgtctgcaagctgaagacaagccaatagtgtcgttctgatcctaggattggcaggctcaggaagagctgatatctgcttgagtctggaggcaggagaagaaatttgcccaggagccgaagccagaatcttcttgattttgagctatcattatccccataccaactacatcagcaagtcctttccatcctgtcatcaaactttgcccagaacctcagtgcaattccaataaatactctaggagggggtttgtgtacgtgtgtacgtgtgtatgtgtgtatgtatgtatgtatgtatgtatgtatgtatgtgtgtgtgtgtaaatgatcagctgactgtaaaatttacaggaaaatccagagatagaaatagctaagacaattatgaagaaggtcaagctaggggaccgttattactggattccaagtcctgctgtaaggtcgtagtaattaagacagtgtggtattggtatgaaaacagacacgtagagtaatggaatcgaatagtgagtttaggagtagacccacatgtaagcagtcatttgaatttcaacaaaaacaccaatgcagtacaataaatggtgcttggtcagtttgatatccagtgggggaaaaagtgattcttgacccttatctcataccaaacacaaaaatcaacttcagctggattatagatttaaatgtaaacggtagaacaataacacttctacaagaaagcatgggagaatatcttcatgatttaggagtaagcaaatatcttaaacaggacaaagagtatagttataaaggagaactaaattcattagactatactgtaattaagaatttcattaaaaaatactgtaaggagagtgaaaagacaagccacagactgtgaaaaggtctttacagtttgtataatggccagagtattcacatccagaatatatgaagaggcccttctgtagccagacttggccctgtgcctatttttgtcaataaagttttattggaacactgctatgcccatttgtttgtatacagtcttagctgctttgatgccataagggcagagttgaatagtttgtaacagagaccatatggcctacaaaactgaaaatgtgtactatttggcccttttcagaaaaaaaattgccaacctctgctataagtaattaagaaaaagacagacagttcaacaaaaagtgacaagggacagtcatttcacaaaagaaggcaccagatcgccaataaacatacagtggttgaggttatttactcatcagggaactacaaattaaatattaatgagctcctactgtacacataccataatggccaaaatgagacataaaataccagttatagaggatgtgggacaactggaatgttcctacactgttgggcatgggaaaatcagtacaactattttggaaaacagcttggcagtatctcctaaagctaatcattcacattccttatcactcagtaattcagctcctcaggtatctaacccaaagaaatgcacacacatgttctttgtcaggcacgtgcaggaatgtcacagcagcaccacactggaaggaagccagatgtctggccatgtcactatacccagcagcacgggtaactcacagccatgaggttgggtgaaggaagctggacacaaaagtacacacttgtgattccatttgtgtaaagttcaaaaacaggcaaagcaaatctatggggttagactcaggacagtggttacccttgtcaggggaagagggcagtgatgggaaaggggcataagggggtgcctgtggggagctaaacatgttgatacaggtgtgttcacttgcaaaagttaattgagccatattaatgcttctttgggcattttttttctgtgtggattttatactttaatacaaagtttacaaaaatatgtatatgcacatatgtatgtatatgtttatatgtgtgtgtatacacacacaaacacacacatacacaccctcatcctttctcatcttgttgattgcagtggtctcccctctggttctagtcccttctccaccggcagacacagggagtctcttgaaactgaagtccatcccattctgcctgtgctccaaccctccgtggctcccatctcacacacagcagaagcccacatcttcaccacttacaacttaattttcagagagataagtctcttccacgttcctgaatcctcagcctatctcctatttcatttacccacttacagtaacaagtacacatcagccaagtcggcgtgggaacaaacccactggctcttggtgagcatacagcccacctgctggagcagaggcctgtgcacaccaccaagtggcctttgagctctgggagttcattttctgccgtatcttcaccagagcgtttagtacctctgacctgatgtatggtttaccttgcttagggactgtctctgtgccctgcctccaaccccatgttagaagttgagttcccagagatgttttgttcagcagtgcaaccccagtacctaaaacagtgcctggcacatagtaggcgttctccacatgcttgttggatccacagatgagtgacttcccgtggctcctgacttggtatcctcctcataggaagctctggccagatgtttgttgagtgactgttttagtcccttcaggctgctataacaaaataccagaaactggggtttttaaacaacagaaattcgggctgggcgtggtggctcatacctgtaatcccaagactttgggaggccgaggggggtggataacttgaggtcaggagttcgagaccagcctggccaacatggtgaaaccctgtctctactaaaaatacaaaaattacccggccatggtggcacatgcgtgtagtcccagctacttgagaggctgaggcaggagaatcgcttgaacctgggaggtggaggttgcagtgggatgagattgtgccactgtactccagcctgggtgacagaatgagactctatctcaaaaaaataaataaataaaataaggccggcacggtggctcacacctgtaatctcagcactttgggaggccaaggcaggcagatcatgaggtcaggagattgagaccatcctggctaacacagtgaaaccctgtctgtactaaaaatataaaaaaattagctgggcgtggtgagacatgcctgtagtcccagttactcgggaggctgaggcaggagaatcgcttgtaacccagcaggcggaggttgcagtgagctgagatcatgccactgcactccagcctgggcgacagagtgagactccatctcaaaaaaataaaataaattaataaaataaaataagtaaacaacagaaatgtattttgtacagttctggaggctgtggactccaagatgaaaggtgctagtagactcggtgctggcgagggcctgctttctgcttcatagatggtgccgtcttgctgtgtcctcccgtggtggaagaggcgagccagctctctggggcctcttttataagggcctaatctcattcatgaggtccttttccccctgacttcttcatctctcaaaggccctacctcctaataccattaccttgggggttaggatataacatgaattttggagggacaccaacatttagactataggagtgggtgaatgatagaattcactcgagtgaatgattgaaccctgggaaggtggatgatggatggatggatggatggatggatggatggatggatggatggacggactgccaattccaagccctccttccattctggtcgtatttcaggaagttcctgtctttgagaaacttaacaggtctttcctcattttctagccaagaagaatgggtttctgttacctcctgttggtctcccatgtctccttttagctgaaaagtagctttgtggggtcagcaaggctattagcctgttttccagatgagaaagctgtggctggaagagaagtgacttgttcaagttaccccagcaccagccaaacactcctgctcctgacccctacctggggctcctctctgtcccctggatgcccctcagtgttgtgttcccctttgcgctgttgaaaacagttgcatctgggaggtgacgtgtaggggacactgacttctcactgtctatcagggtcaccgggagcaagaagtccaccaagaggaccaaatccatcaacggctccctctacatcttcaggggtcgaatcaacactgaagtcatggaggtggagaatgtggaagatgggacaggtagcccctcccccagccttgcctgagccctgcctgagccctgcctgctccctggcactctctctgtttcatttaaatatatttttttcttttatcatgagatgtaatctacctacagaaaagtgcccagagcatagatgcatgaagcgaacatctgggtggttagcattcaagttaagaaataaaacactgcaccccaaatccttcctccttgcaatgccttcttccccctagaagtaaccactgtctgaattttgtgatgatcattttcttgctttttaaagacatttttacctcctaagcatttatgactaaacattttaattaaaatttctatttttgagccttatgtaagtggttacatgattacatatgtttaagtggctttacatatatgtaattatatatgtgcatgtatatacagcccacctggtcatataatggtcatgaccattttacttaaatggtcataaaatatggtcggctgggtgtggtggctcatgcctgtaatcctagcactttgagaggttgagatgggcagaccgcttgagcccaggaatttgagaccagcctgggcaacatggagaaaacctgtctctacaaaaaatacaaaaactagctggacatggtggcgtgcaactgtggtcccagctactgtggaggctgaggtgggaggatcatcttagcccaggagttcgatgctgcagtgagccatgatttcaccagtgcactccagcctgggtgacagagcgacacctagtctccccgcccagaaaatatggtctacatttttttttaaacaaactgctttcactcaacaccacgttagtggggttcatccatgtctctgcatgtagctgtttgcagcctgttggtttccattgctgcagagtgttccgtcacgtgaacatttcacacttcatccattctttgggtgatggatgtttggcctgttgccaccactcacagtcatgcagtcactgatggctcatgtgagcatctcctagtatgtgtgcttttgagcttgtccagagcaggggttcttgcttggttttgagccacagtcccctttggcagtctcatgaagcccgtggagccctcctcagattcaggctttcgcttccctagatcatgccaatctgtttgagaggttttccaggtcccatcccagccagcactgggtaagggtcccacgtttgacttggcttgtcaggctggcactaaggttttaagtaactccagtgcccgagtgagatgggaggagcccaggaagcattttggggctccaagcaagtgtctccccatgagtcactgctgtgtttgtgcctagatgcaaggtcttaaaatgaagccccctgtcattgagtggttgagaggggtctttgtttgcagaaggtcttccttgcccactggaaaaggataagaagtgagcgtttgaagggctggaagtccagctccccatcctgatccaggcgagggccctgcctgtgctggggcggaagggcttggcaatggggagtgttgaaggtcacgcggctgagtctctgctgcacctttgcctcctgcccccaccagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagtgagcagcagctttggggtgctcgcctgggatccctgagctatgcgtggcttcttctgagtgggggctgtgtctagggaaggggcatagggtccttttcaggaggatcagagctgtaagaagcaggtatttgaagggacagggagctctgggactattccaacttggtggtacctcagagattgcccactagacaaatggggaaactgaggcccaaaagaagggtcttgcccgaaggtcttcacccttaagcattaggactcaagatgctcccctttcctgcgcatagccctgtgccctccgcctgaggttttatttgatattcactgaatctaattctgggaggagggtccattggagctgcccattaacctcagtcaggagtccctctgggcacaggcacccccgaagcagttcacatgaggaagtgcaggggctggatataattggagggtgggcttgggggtgggcgtgcaacaactgtgtggaggcaccgggctgttttgtgcagagaccaccaggctgggaaaaggaggctttggtgtgttttggggcaagttactccagctttccagacctcagtgatctcatctgataaatggggatccaagttcctgctgtagagggttgcaatgctacaggaggtcttggatttgagcacatttcaaaatctgacatataaccctaaaaaccctccccacctcccagttttactgaggaggaaactgggcctcagttttctccaaatgtgtatcctgcttacttgaaattgccacttggaggtgtcgtagatgctcacacttgctgtgtctaaatcatagctcttcatttcccccggccttctgccccaaacctgctcttcccctcgactgctacataccagtcagtggctcctcccttcgccccacagctcagagtcaaactcttcgtatcacccctggtctcccctgcaacacctgctccccaaattcaatagatcaacaagtccctgtaactctgcctttcacatatatgtcacacccatccgcttctcctctcttctccctacttccacccaagacaagccaccatcctctctcaggaatatgggcccagcggggccaaatccatggattatttgtctagaggaactagacatctggatttttaggtggcattttctgatcctaaacgttgcaccaacatttattaaaatgatattaggcccgataaaccactgaactgggggcctggttaggcagtgttgtgacttctgaaattgatcggggctgagtatgtggtcaggactgggatggggttcagggatgtggcctaggtgaggccgatcagtatctttgtggtctttgttgggcacatgggatcacgggtggggatgtggcccaagtgggtcttagttgttagaattgggtgttgtccacatcctgacctcagggctggggtggtcacgagcacgaatatggaaccaacttcctgggtctaaattctggtttcaccacttccaattgggcaaccttgggcagagaaccgaacttctctggacctcagtttctttatctgtaaaacggggataattatggcaccttattattgcgggtttctcatgtggcgtactggcatgtagtaggtgctataaaagcatttgctgttgtcaaaattagatgggggtcaaaacagaaaaatgtgggcagagattagggtcaggtcctatgagtgttggctggaagaacgaccagacttttatcactgggctggaatggagatactgacaagttttctgataacctgtgaatctagaaacccaccctcaggttggggaggcagcataggaaagtgatgaagaacatagcactagagcttgattcctgggttgaaggcatgaccccctgtcatcccaggacttaacctctctgggtctcaactttgccatctgtaaaatggttgttttgaggtgtcattggcaggtgcctagggcagcgacagtcagtgccctctagctgctgctggcgtggtggtggtggagggcaggtggtggggcaggtggcaggccagctttcaggagctgtgggcctgccccttgtctccccctaccccccctgccctgggcctggtgctctctccagtgctgaccgtgcccctgtgtaggcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaagtgagtagcctcactctgaactccctgggtccctgggctctcagctggaggtggggcagatcatccccatccacccatgcagcctggccctgcccaggagccatcctgggcagagtgacaaaaggacctgaatccttatggagcagccctcagagatcaagaaggctagtggggtccctaaatcaggtctttcaacctactaccagacataattttccattgtgacctggtacacccattcatgtaatatatgattgaagctgaggtttcacagagcttactgtgcttgatcccactctgaaaatatctgtttctgttctcttctgttctttctattctattcaagttgcttcttcattcatttcaaaattaatgctggcaagacccatgacattgtttcacaaagcactaacggtttgaaaaatgctgctgtagcacttgggaaaagagaagccactctaggcatttcaagcagagaggtattgaacacaggtaattgattacaaaggtgttttaagggctggaagaataaaggtaggccccccacccccaccccattttttttttggctggggctgccataacaaagtgcacaaaactggtgtggcttaaacaacagaaatgtattgcttcacagttctggaggctggcagtcctaggtcagggtgttggcagggagagtatctggtgaggcgtctcttcctgagttacatgtgaggggcgagggaagcttctataaacttctcagtgcccagagcctccactttctctgtttgggaaatacagccccattttataactggagttcaaaggggtcagaacacaggtgtgacaggctggctcttacacgcaggtcacctgagggagagggctggggcacgggagaggtagaagaaatccagtccttgtaaaatggtcaggctgttttaaggccctacaatgtgctagacactccggagaggacagtgccaagggcttgcaacctcatgaagcttgtggtgcagctggggagagaggtttgccggcaatgcgggaactttatttagaatgtaaggacttaaactccccccaacttccctaaagcctttgcagaggcctagggtaaaagctgccactttatcacagtgctgtggaccaggtgagaggttgtgtgggccaggcttgagccaggatggtcattgtggagacagggagcagtggctgtgttctggataacttgaaaggcaacagcatttgctgatggggtggaaaagtaaagggagttcaggactttaaggcgctggaaagctgcagttgctcctttgagaaggagaagaagatggcgggaggagcaggctgcagggggccgtgggaagcccacgagtgcagttgtggacgggttatgtcaggctggtagacacccacatggagatgtgggcttgttggttggttgcaaaatcttgacttggggagaaaggtctgcattggggacctacacatgggagatggtgttaaatggtctttaaagccatgagacggcctgaactgtgcaggggaacctgaagggatagaagaggcaggcctgggccctggggcccgatgatggcattggaaggaggagggggcagagacctctgagtggagctgctggcgagaaggtggcactcctccggaagccaaggggaggaagaggcggggaggcaggagcaggtccctgggaaggagcaggagcccggtggaggctgaaatgctgatagacattcagggtgcagtatggatgttgggcaggccacggaggcttagtgtggacttggggacagctggcactcatggcctgaggcttgtggtggaggggcagcaagtagaagggttcaaacctgcagggcgccatggactctattgccctgttgccctcaagggccttggtgccctattttcctcaaagatcaggaactccagctctgagcttccatggagaggagagtttgggccttggagtcctgctggctggggcaggcggggcggggcagcctggctggccttttcagccaactcctaatcccacaggaaaggaggtttttctctcaggaggggcctgcttccgggccccctggggccagagaaccttcccatctcctgccaaactgctcagtccggaccgatgaggcagcctgtctgtgatcagaacttcgaggagttctgcctcctcaggaaggattagagagatttcttttactgcccatttgaaatggggccaagatagcagcttgttttgtaactgcaggtccgaaagggccagcctttctgcaggagattattctgataaactcttctccctgcacggctttgctctgcacacagccgtagggtgtgtgatcctgctacccccgccagggtcccgctactgaatcttcttgtccaagatgcgtccctggtcctccagggtagaaggacttggtagcctccgagatattgatcaagccctttgctgcatgtgctggcattcagccatgtcttttaatccccacacaacaccgtgaaacagtcactgccactacccccattttaaaagtgaggaaaccgaggcacagagaggggaagggttctgtacaagatcacaaagcgacactggtgctgtctcccactgtactttgcctgtctattcatttttatttctactcagcacattttatttttccctagcagttcctctctctacatctgtctccactgttagggaactgcatgaatataaaaagtgtctgatttatcttttggtttttagagacagggtctcgctctgttgcccaggctggagtacagtggtgtgatcataactcactgtagcctcaaactcctgggctcaagcgatcttcctgcctcctgagtagctgagactacaggtgtgtgccactgtgctaggcttctatagctaatttttatttttttttgtacagatgggggtcttgcaaatgctctcgccttggcttcccaaggtgctgggattacaggcgtgagccactgcacctggcctgatttgtctttatcacccccaagggttggctttgagttagacttggactcaagtcttggttccctcactttctagctgtgtgacattggggaagtttcttaacctctctgaacctcagtgaacgatcagttaaagggagataataaaatgtgcctctgaggactgtcggaggatacagtgagagaacacgtgacgtgtgcagcacagtgctggtgagactcgtgggaatcgtactggctgtgcatgatgagtgtatgaaggaggggcctctttctgccctactcagagaaaaatctcttagatgccacatttaaaaagcaaagaataaaatctgtgtgtattaatgtggagggtgtcctgggaggagcatggcctgtgccctctggcatcgtcagattagtaggggagacaaaacagattcactcattcattcacccactcagtgttaccgagtccctgctatgtgccagtcgggaataggacagatgaagtccctgccctcatagaggtaagcatccagtgggggaaatcagacaacagaagaggagacagatagaaagaagggaatttcagcaacttgatgaatgcgctaaggaaatacttagcgtgaagtcaggacaagaggaaatggggctggttcagaagagtgggcagtcaggacctctcaggggaagtgacatttaaccacgatctgaaagacaagcaagagccagccatgagagggtgtggggaacagcattcctggcttaggaagcagtaggcgcgaaagccctgaggctgcagtgagctttgagtgatggtggaacaggaggaggccattgtggctggagcctgagtggtcagaggggcaggagatgtggcctcagcagttaaagtgggtcacctcaggcagggccttggcaggcagctcacatttccgtcttggtgctgtgggaagccactggaggagtctcggtagtggagtgagatgaggatccagatcgagggcattggtggagctgtcggagctcagggttaccaggtatgacgcggcgtgtctggcaggggccgtcaggaaaagcttcctggacgaaggccttgggtttcacccttggcagagattagatgctgttcagttatggacgtctgccagagggaaagctccaaggtggaaggggccttggtgtcttggccacctgtacgcacaggtgcagggtgttagtgtgcacgagagggtcggtaaggatttgtccaacattgtcatctccaggaggcatccctgagccgtggagtcacagggatgggtattccactgggtaccccccagtccctaccctcttggagcccacggcccatggaggaatcaggcaagaacaagggattcttgtgttgggtcataagtggtaccttgggcctgagctcaggcggctttcttaggaagactgcagaatgtattccttgtgcctcaccctggccgtggcccattgtaggctaaatagatgtttagtgggtgaatgattctaggaggcgggaaggaaggagggatgaaagctgacacatcctaactctcagctcaccatgccatccctgactctcagactgcccatcaagctagattgccttctccttgtatctccagctctcctcacactgtcctgagctgtgtctttctgggagcttggacctagctgccctttgcatgccagcgcccctccccactggcagatcgctggtttcctgaccttacctctcagggcttctgtgtgcgctgatccccttgcccagaacactctcccctgtaccccagaggtggctagcagtgccccactgacctgatagagttagcagacatgttttcctcggcccacgtagtgctttcagaaaatgttggactcgatatgaacatttaatgatggggagatttcacaggaaatgctggatttcctcactctcccgagaagctgttagatgcgttcgtcttctaacataatgggccatgatgggctacactgaagagtggctgccagctttagacacggcaggccccggctggttctgcacagtctcctcctggcctgttttgcctatttacaagtttgagacccctgcactagagatgaattttattgggtttttgcatactgcatcccagctcaggatttcatatgactagaaattttgcctgctaaatccagaaggtgactgagtgagccacttcccaggtgggccctgatgaggcccagagaggcacagggacccgcccagctttgcccagcaagctgtgaaccctccttgatccaccagaagatggcaagacccagtttgggcagaaacgtagggcagagttgctgtcctctgggccgtcttcttctgccccagcagctgctgtgggatacttcctgtcccctaaccctggccagagagttgctgatcagtgccagaggcggcccccaattagacagctggtgggcttccgagagtgggcactcaaacatctgttcccctccttcagctgctggcagcattctccctgtccctgagttccaagactttgagaatggaactgggggtggacaggacccagaacaatcccttccccacctggggcgcctgtcccacaaagcagatgcatttcttctgcagcccactctgcctccagccagggcattctgaatgctccagcacgcaccgctacctacacaccaggcaggtctttgctctgccaaacactaggaagctaaaaatagccctgcccccctctggccctgtaattggaggcgggacagctggtttcgataagcagggtgctcaggctctggccagctgccacctgctttcattgaacacagattgcctcggcggaaacagccccattccaggctctcccttttcctgctgagtttgagtgggttgagctctgggctgagcctgagaagcacccgcaagaactaggacctggggccccggctgagcctctcaccaccgggcagtcacgtgggagctgggaaagctgcctgtcttcctctggcctgggagcacttctgtctccccgagaccttcctgccgacctcagaacattcctttctgtcggatggttcattacttcatttgttccataaatgatcattgagccctgctctgcatcaggccctctggtaggtgctgggatagtgccatgaataagacagagaaaacaccctgttcatgtcattacattctggttgggggagatggccaataaatacgtaaaataaatctgtaaacaagaccacttcagacagtgaaaagtgcaaaaaaggaagcaacacagagatgtgatggattggataggggtcggggaccattttaaatgaggtagtcagggaaggcttctctgaggaggtgatgtttgtgctgagacctgaaggatgagaaggcacagttgcatgaagagctgaggaagggcattccaggcagaaggaacagcaagtgcagcagccccgaggcagggaggagtctggtattttttaataagggaaaggtggtaggtgtggcttaggcataactaatgagaggtattgggggtgagatcagtcagggtgggagtgggtcatgctgggccttgtttatgtccgtgtgggaagagttgggattttttttgtgagtagtaagcctgtgggagggttttgaatatggaaatgacatggtttcatcactgttagctcgcctgactccccgccatcatctttctggccccctattatttcttcctgcatgtttgtccattccttctgttcatctgtccagccaccactccatctagccatctgtgatccatccctgacccatccacccatctactcactctcttcttcatccaccccatattaagtcatctgtctgttcattcatccacttacccacttacctacctgcccatgtgctgctggctgtctgtctggccggacatccatccgtccgtccatccatccatccatccatccatctatgtagtcactcatccaccaacctgcctgcccagcttccttccctccttccctctctccctccctccctctctcccttccttccttccttccatccatccatgcatccatccagtgagcctgaggcagacctggaatctggtcacactctcctctctgctattggtaataagcatgaagcctcagtacaaccccaagggctatagactactacactcggcttccctgtgggaagttctagctgtcattcccaggggtggatgtggccaggccagcttagtgctgattcctgtggtcccagaattggggaaatcctctcaaccacatattgtgttcctggcagtgagttcgttgcctggctcctagaaattggtgaaatcagcaagacggaagaaggagtcaacttgggccaagccctgttggagaatggcatcatccaccatggtgagtggagggctgggcccagctgggccaaggggtgggaacaggtcagaccccaactgtgccatgcttccactagctcaggcagctcctatcctttcgtgcagccgccgtgttttctgggcacagtgtggcccgcaggaacatggatgcccttgtaaaactgcctcttaggcaccagcaaatcagggatacctcaaaaacctgggggcaggggagtagaatcttttatctgtcccttcaagaaatgtcaagaaccatttggttaagttttagttattcagcaaatatttattgagtgcctataatgtggcaggcactgttcacaccacaatgaacgggaggaggacgtgcctgtcgtcatggagccgaccttgtagttggaggggacgataagatctttacttgcttatctttacaaagcaagatagtaaaacatgataggtgctagggaaggagggtaaagagtgtggtgttggcgttcacttttgaataggggagatggggaaggcctcaccgagaaggtaacattggaaccaggacctgagccaccagtgagggagggacccaggtgggcatgatggttccaggcagagggaacagccagtgcaaagtcctcaggcagagtctaagtgggttgtgcagggaatagcagggagggagtgtggctgcctcagagtgaggagggggcgtggtaggagacgaggtcagagggcacagggctgatgggagagtccaggaggtgagatgagatcctatagagaattgtagggtctttggcttttactctgagtgagctatgaagctgttgctgagctctgcgtagaggaaagacctgcttggacgaacacgctggcagaatccctctggctgccctgtggagactgttgggaccaagggtgacagcagggagcccagcaaagaggctgctgtgatagtccaggtgggaggcgaaggtggttcgggccagtgtaggagtgaggtgattggtatcttgaaggttagggccttataggcattgctaatggatctgaagcatcaagcatgactttgtgggatagagatggctccgtaaatctcagcaatgtggtctcaggccccagcatgcttgtccccacccatccattggtgatctagatctaaggacatgctgagccagaggggtcccagtgcaggctggatcaggggcatttctgggtccctcacccctgtagatgccccaccccaagctgcgagtctcagcagggtcctgcacgtagcaggaggatggggtatcctcatgtgcaaaatggggaagtcatagcacccacctcgtggggtttcagtgaaaaaaaagcctggccagcagtgaagcctgatgctggtgggtgtgactgggaggggcagagggggcgtggctggcagtgaaggccaatgctggggggcgtggctgggaggggctgagggggcgtgcccagcgtcacaggtcctcctgtctctccagtttccgacaagcaccagttcaagaatgagcaggtgatgtatcgcttccgctacgacgatggcacctacaaggcccgaagtgagctggaggacatcatgtccaaggtaggggccctccgcccctgtgactctgactcagctggcctcgttcacctccaccctgggttcgcctcagagcaggcctgtgccccttggcttgtttgccttctccactgcccacaactcacccctgcccccattaccctgccctgccccgtcctggaagccatctctcccatcagcctggatttggaggctcgtgaaggatgtggcctgatcccagaattcctccccttttttctttcagggtgtgaggctttactgccgtcttcacagcctctacaccccggtgatcaagtaagttactctttccaagctccaatttcacctctacctcttctcagctgtgtggccttgggctggcaacttaacctctctgagctccagtctccttctccattaaatggggcttgcagtggcacctatcctttagatttgtcattaggattaactgaattaaattgtgggaagcactgcagtgtagtgatgcaggtgtcagttctggagccagacagactgagcttgaacctccctcctagttagcagctgtgtgaccttgggcagagttacttaacctctctgtgcctcaaccgtttcctctgtgaaatggggataataatgggctccaccttagggcctttgtgcctgctgttccctttgcttaggatgcctttcctctgcataccttcatattcgttccctcacttccttcaaacgcctccatatcacaggggtcttccctgcctacctgcataaagtgtcaccaacctggtactttctgtcctctgtattagtctgttttcatgctcctgataaagacatagccaagactgggtaatttataaagaaaaggaggtttaatggattcacagtcccacatggctggggaggcctctcaatcgtggaggtatgtgaaaggcacgtcttacctggcaggcaaaaggaaaatgacagccaagtgaaaggagtttcctcttatgaaaccatcagatcttgtgagacttattcactaccacaagaacagtatgggggaactgccccacgattcagtagtttcccactgggtccctcccacagtatgtgggaattatgagagctgccattcaagatgagatttgggtggggacacaacccaacgatatcagctccctttgttcattttaattttcttcttcttttttttttttgagacagggtcttgctccgttacccaggctggattgcagtggtgcaatcacagctcactgcagtctcaacctccaggctcaggcagtcctcccacctgagcctcctaggtagctgggactacaggcgtgcaccaccatgcctagctaattttttttttttgagacagagcctcgttctgtcccccaagttggagtgcagtggcgcaatcttggcttactgcaacctccgccgggttcaagtgattctcatgcctcagttgcctgagtggctggcattacaggtgcctaccaccaggcccggctaatttttgtatttttagtagaagtggggtttcaccatgttggccaggctgggctcgaactcctgacttcaagtgatctgcctgccttggcctcccaaagtgctggaattacaggcgtgaaccactgcacctggcctttttttatatgtttggttttttctttttcttttttttctttttttgagacggagtctcggtctgttgcccaggctggagtgcattggcatgatctcggctcactgcaacctctgcctcctggattcaagcgattctcctgcatcagcctcccgagtagctgggattacaggcatgcaccaccatgcctgggtaatttctatattgttagtagagatggggtttcaccatgttggccaggctggtctcaaaactcctgatctcaagtgatctgcctgcctcagcctcccagagtgctgggattacaggtgtgagccaccgtgcctggccttattgattgaaatttaaattaaaatggctacctattggagagcagaggcctagggactcagtaaaagcttgtcagtgaatgttgaaagatgattaacttcttttgcttctgtttctgcatctgttaagtggacataagaatagctctcacctcttgggttgccatgaggattaaattcacggaaggtgctttgaatggctcctggcattgtataatgaacgccagagattggttattctttttaccacaaagctcacagttgtggatgaagggagagagggtgacctgattcttatcccagctgcagatttttctgtcctctgacctgatagctcttatcacctctcggaagagtggagaggaaggaccatttcctagcatttgctggccccgtgggatgtcaggccctgggaaccactttcatctgccatcctgcctccgccctcctgggctcctctgctgctgctcttgtgcaagccccagaaggcaggtggggctccttggccagcctcaaagaaggaagcggctggggaaggtagcagacccccaccaactgcacgtggagcctgtcagacccccccagtcctaaagcctgagagaaatcctccaactagactttatcagccttggcatggactggccacagaagcgcgtttttgtcacagcttcagaggctgagaagttgttgcagttcggctgcaaggttagcggaacccatgggatccaggctcggcagggattcagatgctgtcacaggccagggcagttacctcaggaaagaaccgtgaaactcacaggcctctgtgctgctcggccctgatagaccacaccagccccttgcaggggctttccacaatggtttggtttaaatacatcaatgtcaaccacaaaacaaaaaggaaaaaggaaaggaaagaatggagggtctcccctgccactctgtgagagtcaacatggctccccagcctcggcgccggtggcatcgtagccaggatgagtctctgttgggggctgcctggcattgtaggatcttcagcagcatccccggcctctacacacgggatgccagcagcacccctgccctagcccctccaggtcttgacagccaaaaatgtctccagacataccctgagggcaaaatcacccccagctgagatctcctgggctagagacagaaagtttccagagccctggagctgctgcctcctgcctcccactctgtaggtggaaggaggcctggtttggaacagccctgccctcggtcacactgcaagtgatgtgtggagtctgggctgagactcggacccctgcccaatgcctagagagcctggagatccttgactcgtgggcacgtcctgcagggaagtcaggaccacccccacctctgtcctccccgccctgccctgctcactgtgcgctcaccttctccacagagaccgtgattaccacctgaagacctacaagtcagtgcttcccgggagcaagctggtggactggctgctggctcaggtgagggcctcctcaggggtgtgtgaccagtgttctgctttgtccgtcagtgtggggctttctgttttgtttaaagattttttcttattgcttttaattgtggcaaactgcacagaacataaaatttaccatcttgatcttttttttttttttcttgagacagagtcttgctctggcacccagactggagtgcagtagtgcagtcttagctcactgcaacctccgcctcccaggttcaagcaattctcctgcctcagcctcccaagtagctggtattacaggcgcacgccaccacacccagctgatttttgtaattttagtagagtcggggtttcactgtgttggccaggctggtctcgaactcctgaccttgtgatctgcccgcctcggcctcccaaatcactgggattacaggtgtgagccaccacgcccggccatcttgataatttttaagtggatagttcattaggattaaattcattgataatgttgtgcaaccgtcaccactacccaaccacagaccttctaatcttcccaaactgaagttctgttcccattcaactctccactccccctcctccagtcccgatgagcaccattctactttctgtctctatgaacttgactactctagttacctcatagcagtggaattgtgcagtatttgtccttttgtgcctggctcattttactgagcatccatcctaaagcctcatccatgttgtagcgtatgttggaatctccttcctttttaaggttgaataatattccattgattgtgtgttagtctatttgtgctgctataacaaaatacctgagactgggtaatttataaagaacagaaacttctcacagttccggaggttgggagttccagaccaaggtgccggcaggttcggtgtctgtcgaaggctgccgtctgtttccaagatgctgccttgctgctgtgtcctctcatggggaaagggatgggaggggcagactccctgcgtcacacccatttctaagggatgcctaatgccctcctgactcagtcccctcctgatggccatacctctcaatactgttgcattggggatcacatttcaacaagaattttggaagggacaaaagcattcaaaccgtagcagtatgtctgtaccacattttgtttatccattcattcctcagtagacccaggggttgcttccacactagggctttctttcagttttaaaactgggatggtcttgggcaaactaggacaagatggttttattctggtaccaaactgcagcctctgtttggagttggccaagttactactttcaaaaaagttcccagtgggtaggggttgaccagaagcttagaaaatctatgcatcagttttggtgcaatatcccgaaggtgtttgctccattcaggtgccacatacaggcctgttgcctgtctcttctcctttattgctcaggattatggatgcttactctggataaggccccagcaggcattgtgtgttatccttttgagtcctctaacctacttgcagatggggaagtgggcccagagaggctgagtgcctggtccaagggtgcacagcttcatagtagcaaagctgggactcacccactgtgcctcggttctgtgaatttttcagcgagtcctcaagaatatctattcatggtttgtaaaaagaacacattggctcccaaagatgagaagaaacctgtgaaataaaaatggataaatgtttaaacatctacagagtgcagctttatgttggcctcattaattgttaaacattcataaaaacttcatttgaaaacaatttgctgcctggattttctcatgttgcacaaattcctgatacgtgctgataaatcacagccaatttttaaagtgaatgtttttcagcaccaaataacttcaaaagaaagttgagaaacatccttgaaaataagttatctagcccaaagagatatcaaatgtgaaatatgggtgcattttaatatgtttgctatgatatgggaccctatgtcctgggaggtcttgaaatatctggatttgaattccaatttgcatgtctgtgaagggcagagctgctaaccattgtaccacactccccagccctcgtgagaatcacatgcagtcagcccagaactcatgcttttatagccagacagacgtgggttcaagtcccagccttgctacttcctaggttagtgaccttggacaagttgctcagcctgtccgggcctcagttgtagaatgaagctaaaaccaataccttctcctttagattgttttgaggttttgatgagataattgtgtaaagtgcttagaatggtgcctgacatagagtaattgctcaataaacgttaactattactatgattcctcatctctttcacaaaagattcaaggtggcccaagattacatgcaatatagaagactaaagaaattgtgcaagggtttggggaccacgagaccagtaagaccaggaaacaaacagaggtgggggggttagcaatctgcacagagtcccgccttctgaatttgctacaaataggtgacaggggtgccatgtgggagtttcttttgtggtttaggtgcttcagtcagagcccagaggagcctgggtttcaaggctctcagagctgcccacttcttactgctgtggacgtttctggggcctcatatttcccaagctccttcagtgctcagagctgcctgttggtgtcaaagcataggggaggcattgctcccagggtgaatcccatgcctaactcagggtgggttggctcacggagacaacaggacgtcgggtctgagaggtatttggagatagaagagacgggttgcactgctgtgggaatggctgggaatcaaggatgagccctgagatttgggtgcattaggccgatggaaataccatttgtggagatgggaagatgggcaagaatgtatggggaaaatgactttctccttgggcacgcaagatgccatggggctttccagcggatgggcaggggagagggtgggctttacacacacacccagacctcaggcagcccccactgcagagtccgctccttgtcagcttttgggtaacatttgacacaggttagaagagagtgtagggaagttagacaagcgagctcattagctaacttttttttttttaattatttttgagcacctgccgtgtatcaggggctgtttttggttctagagacacagcagggaacaagacagacaaaagctcctgttctcccagatattacgttctggtgaggataggagagacacttaataaataagaataagaggaatacatcacatgcccgctggtgctaggtgcaatgtggtggagggaacggtgtgggagcgggggcaggggatctccccctcacatgggcggggtggtgcagtttacacagggggtcagggacggccatactgaggagggacatttgagcagagggctgagggaagtggggagtgagcccaggccacatctggggagcagcagctcagaggctcttaggcagagcgagccaggtatgtctggggagcagagagggggccagggtggctgaatggagtgagaggggagaggagtggcgaggaagccgcgtgggcgcaccatgccaggctgtgtccactcctggaagggcccagacccctgcccggctcggagtacaggagcagtgtgtgtggcttcagttcagacaggtcccctggctctgtgtggagactttagggatgatgctggcagcagggagggcagtaggaggcaacgctagaattccagcaggggaggatgctggctgagaacagggtggtgggggtggcaggagaaatggtcagattctggatgttttgaaggtggacctaataggttgctcatgggtgagtagggcgttgcaggtgagagacagaaaggagcagagaatgactccaaagcctttggcttgagctgccattgactgagctgggatgctatgaaagaggcaggtgtgcgggaggctcaggccttcaccctggaacactccagcatttagagactggaggaggaggaaccagtaaaagccacttccagtgttggtggctggtgctgggcatgcggggggctttctcgtggccagtgctggccgaggagttgtgggctcggccagaggccccttggagtagcttgcgtcactgtcactctgtcctgagccccccaaccccaggcacccgcatcttgttgcaagtggagacggggaggatgtcgagcaaaggctgtagccgaccatgcaatgtgtccatccacttcagcagcctatctgtggcttggcctggtgtggggacacagggtgggtaactggagctgacgcaggaggatgacttccaggagatggttggaaaggcaactggccttcggcttgggtcagggaaaggggaggagggtgtgcccgcgtgggtctttctgtgcgggagagatctgtgacaaggatgtgacctcggagtgtggttacagcccgtcttgatttcaggagtcacccccaccttgcatcttagcaggaaagtgggaagaacacataattgtgtagggcgggagggtattttttggacacgtcttcatttctaactctaggttattttaccccttaaaataaaatgttgattaaatccctgctggatcagttacacatgcgtttggctgcacataacaggaaacctgacttattaatacgatattcttctctcacataatttattgtctggagtttgtggtcctagagctcaacaatgccgtctgtacccaggcatctcctgcctttctgttctgctatcctggtatcttcttatgagttgcctcatagtcacagtgtggcagccatggctccagacatcacatctgcacagaactatggccaaaggctgtcctgttggagaacattttttctttctgtgtattaggggaggaaacttcctacaatcctcccttcccctgcatggtcttttccttaggtctcattggctggatgggtctgacatacacccctaaaccagcccctggggaagagaaccgagattgctgatagtggcttagaattcctcgggattcatttcttctgacttcgggaggtggcttgctaggcactattcagacaatcagagttctttaaactctgaggatgaggtgggcattggccgttggagagacaacttgcactctctgtcagctccggaacggcttggtgcattatcttatttaatcctcagaacaacttgagacaaatgcagttgttcccattttactgatgaagaaactgaggcttgggttatgtaacttgccgcagggcacacagccaccaggatcctctgtgtgtttgtgtgtggcaggggttgtcctgatgccttcatagtcaataacaatcataacgcttggtattaatgatcgctgattgagtctgagcagagaccacctctcaggggtgtcagaggcctaggagaatcaagggcaaatctgagaatgaaataaaaatatggatgaggaaaggatactcagagaggctaagggattgcccaaggacgtggccagggcagagcggggctttgaatcgggggaagccagctctggagtttgctctcttcacctctccactgggtgatttctgggtctgtgtcacttgggctccaggatgccccaggctgcgaccgtcacatgcagggcagggggtcagcaggctgagcaggagagagcagaggccaggccaaggagccaggtgtggggcgggcacagatctgcatgctcccatgctggctctgcagaaatgcacctggaatgcccgccacgtgggctcccactaccaggcagatggcaggtactgatggtagcagggttctcagcaggggcaggggcagagaggggttggggtaggagaggcgggggtcaggctggcagcttgaggtactactgggagaagagacgcaggagaaatgggaacaggaaacttggctgcaaccctaggcaactaacctcccctctcagcctcacttcccctctccatggcatggtggcggggggtgtccagctctgagcagtctccattgttactgtgtaagcttgagcaactgccaagtctgtctatgcctctgtttcctcctctgtcgagtggggttaataagagtgattgtctccaggtcaaccatacagtctgagtgaaatcctgcagctccttgtacatggtgggtcggtgagaggcatccttgggcatctttatggggtctcggaattcatgggtaaagaggctgtctggggtcctgtgtaactgacacctctttcccccattactccgtctctccaccccactttgccttctccatcttcattcctcagtggttctctccagtgaaaaaataactaatcaggaacagctaacatttatcaaatgctgcctgtgtgccaggctttgggccaagggtcttgcacagagtgtctcattcaatcctcacgagaacttggtgggatggagacactctccccaccactatagacagagaccgagacagggaggtgagttcagaatcagttttcaaactaggtcctctcttctcccttctttctgtccctcctcccctctcccatcacatcccttttcttcccttccttccactttttgtgccccaccaagtaggagactttgaattttgatgtgggatgatgaggtgaacatggcaggcagtgtccctgcccgcatggagcttatacccggtgggcaacagaccttaagcaaaatgtatacatgggtgagttaatttcagactgggacagggtggcacagatgccttgcagggtactgagtgtgtgtgactggtgagcgtttattgagaggatgggtggaggaatgtttggggggctactttcaggtagttaaggatgggactctctgaggaggtggtacggccctgagacctgcaaagccggggcagggcattccaggtgtgcaggaaaggacgagtgcaaaggccttgaggtgtgcagagggcacctgggggtgggcaggcgggtgggggagtcaaggcagggaagcatggcgggggaggttgcaggggtctcgtgtgtggcggcttcctctgggagaggagaaattgcatccttcccagagggctgcagggaggtggcagggcttcctgttcaggtggcacatctgggccttctgtatcactgttgacctgagagtccctgctggcctagctttaggagctccaagaccctgtggggaggctgggactgtgagcgcctcagaaggccaggtggctccagctgcctgccgggcctcccatctgcagagctagggcctgccgccattgggccctgctggcctccccactgccggcccctcacggcgtgggggaggctgctctggatatggcctctcatagccaccacccctggcagggttcccaacccgcaggccctccagctactggcttggggtcctgtgggagaaatgtgtctttatggagtcagccagggcaggcagtgtggtgaaatgccaaggccagaggctctgccccaggccttctgcccagggctgagtcctgctgcctctgaatagcacccctgtctcctctggttggaaaatcccctctggctgtggacgggagggtacaggcggggcctctcagggctcctcattctgggaggcgtttcagtgagactaggtggtgcctgtggctttctctttggagttcaagctcattgacctggctgcaagctcctacacaatctggcccctgctgaccactcctttattaaatcagcagacagctattgagcagggactctaggtcagccccgttcccagcacttaggattgagcggggacacagcagtgccggctcctggcccccacgggcctgactcagcttgtcctcccctggtcggccgtgctgccttctggttcctctgcgctccaagcttctgcccatctccagacctttgcccctgctgtttcctctgcttgacagtccctcccacctgcacatgcgcatgcacgcacacacacacacacgtgtcacacacttggccgggacgtattgagtgtatttgggttgcaagcaacagaaacaggccctggctaattgaaggggggataacaaaggatgactcactgaagggaggtggggcactcagaaagccagggcaggcctaggaggccttaggaagaactggcaccgggaaatgctgagaagctagcaggtggaggctctgtccagcacaccgctgtgagggacaatcagcgctgcttttccttgtccttggggtcctccactcaagtgtcatgttcttggggcagggagcatccctttggcctcagcctggcctaggagggctgcaaaccttgatcaactgccccaccaagatgacatcccacctgggagagttggccccaaaggccaaacccgcagggtccagcacacgggccgtgcctgttcattcttcacgtttcgggttggatgtcacttccttcgggaagtcctgagatgagtcagattgccttggttcaaattgtatcagtttggaatattttcatttgccaggataacaagcccaactgaacagtggcttacagagatgccacctatcaagaagcatggagctaggtggttccagggctggtttgtgggctcagtagcagacagaagaatcttccattcttcaccccaccatcctgagcatcacttcctcacatgactttatcccaggcagggaggagtggtgctgcttttcccttttacctgggggggaagatgtttttcagaagcccctggtaggcttccccagtcgtcttattagctggtgcttggtcagttagcaattgaacttgatttctagtattagagacacaattatggaagctgagccaaattagggtttgtgtttctgtagcatgagagaagtccagaggtgggtggttcagagctgctggagtgtctcctgatatctttggggaccacactctctgtgtctttctgctctgccttccttagtgtgtttccagccatgagggcaccttgtagtctaaagtgactgcaagagttccagccaccacatctttgttccaggcgggaggaagagaaagaaagggccagggacaaggggtttttgccagagcatcccaccagtgatttctgcttatagctcattggccacctgtagctgcaagggaggctggagatggatgagggcttcttgaccagggaggaatgggaaaggtgttgctaggcaaccaacattgtctgccgcttaaaatctccattttttctttgcggtattgatcacagtacaataaaatagtcttgtttggagtttattaataataatcacaaatggggccaggcgtggtggctcatgcctgtaattccagcactttgggaggccaagacggacggatcacgaggtcaggagattgagaccatcctggctaacacagtgaaaccccgtctctactaaaaatacaaaaaattagccgggcgtggtggcaggtgcctgtagtcccagctactcgggaggctgaggcaggagaatggcttgaacccaggaggtggagcttgcagtaagccgagatcgtgccactgcactccagcctgggcgatagagtgagactctgtctcaaaaaaataataataataataaaaaataataatcacaaacccgttttggggttactgcagtaaacaaaacagacaacccctggccctcgtggagcctaccttcttgggtggttgtgggcttctcgttggccatgcatggcctctcggatgctgccacctaacaccctccccttcttgttccattccagggagactgccagactcgggaggaggcagtggcgctcggcgtgggtctgtgcaacaatggcttcatgcaccacggtaaccacccccacctgcagcccagcccccgggaccttgctccctggagctgatggtttgggggagtatgggaggactgaagccaggtctgtggctctctagacccccgggggtttggggaggctcacgaatcccacctccctccccttcccgttctgaaccgatcgagaaatggcttctggtgtccactggggaccaaaatggctggaaggacatgggctagatttgaagtccaacccatgggtttcctgtgcccttcttcctgggggggatgtggccttccagggtaggcagcaaggccagatgaggcaggcctggcccgaaggcctccgtgaggaaggaggagctgtgccctgtgggacagtgggcaggtgggttgtgaatgtgagaggcaggaagcccttcctgggatgtctgcctctttccccggcctcctccctcagataagtgacttttctttccattgggagagaggcaggtattggggggtgagttctgagatgttcctgaggcaggaagatggcaagaaggaggacgaagtggctccatggacaccggtttaaattacaacaaaagttagtgttcagtgtgcctgggctctttctagacacttcacatatatttattagtttaatacagcagccctttgatgtgagtattaacatcagccccattttatagatgagggtatagaagctcagatagttaagaaactttctcaaggttacatggcaagtagaaatcgggattagaacgcaggccatctggagccaggattagaactcaggccgtctggagtcgggattagaattcaggccatctggagccaggattagaactcaggccgtctggagtcaggattagaattcaggccatctggggcgggattagaattcaggccatctggagccaggattagaactcaggccgtctggagtcgggattagaattcaggccgtctggaaccaggattagaattcaggccgtctggagccgggattagaattcaggccgtctggggcgggattagaattcaggccatctggagccaggattataattcaggccgtctggggcaggattagaactcaggccgtctggagttaggattataattcaggccgtctggggccgggattagaattcaggccgtctggggtgggattagaattcaggccgtctggagccgggattagaattcaggccgtctggagtcgggattagaattcaggccgtctggagtcgggattagaattcaggccgtctggagtcgggattagaattcaggccgtctggggcgggattagaattcaggccgtctggagtcaggattagaattcaggccgtctggagtcgggattagaattcaggccgtctgggccgggattagaattcaggccgtctggagccgggattagaattcaggccgtctggagccgggattagaattcaggccgtctggagccgggattagaattcaggccgtctggagccgggattagaattcaggccgtctggagtcgggattagaattcaggccgtctggagctgggattagaacccagatcgtgcgggtttagaggctgcacactcaactactgtgctatgtagcctctccccttgaaggtcctgggggatccctgagtttcctgtcctttcaacaggacaggtaaacctttaacccccgccaaggtgccattttcctgtttctagaacattcctcagagcctttgcacttgcagtttcccttgccagggtgccctgcctgcctcatccctgcaggtaactcagtgtttctgctcagttgacccctccccagtgagggcctccccacaaccccagctaaaatagctcctccccgtcatcactctgctcctagctcggattctctctcttttttttttttttcagacggagtcttgctctgtcgcccaggctggagtgcagtggcaggatctcggctcactgcaagctccacctcctgggttcacgccattctcctgcctcagcctcccgagtagctgggaccgcaggcacccgccaccacacccggctaattttttgtattttttagtagagatggcatttcaccgtgttagccaggatggtcttgatctcctgacctcgtgatctgcccgccttggcttcccaaagtgctgggattacaggcgtgagccaccgcgcccgaccagattctcttttttttaagggcctgttctctccctgttaggcagatcccatcactcctttctgtctttgttcattctgacatcacgtgtggtgtctttggtgttccaggcaccgtgccaggttctgggagcagagtgtgatgaccaggacagataacagtcccgtgtgtgtgtgtgtgtgtgcgcgcactcacacttgtatgtgtgtgcacacatgtgcatgtggtgtgtgcaggggaaggaaacagggatgccagcgaggaggtggtcatgatagtccaggggaaggaggatatggctgggacctggtggttgcaaggggttagaagtggtcagattcagaaaaccctgagccacaagaaggccttttggctgtttctcctttctgatattggcttttttagttctaactcagagatctgcaaactccgtcacagctgcttaactcttaactcttcctttgtagcacaaaagcagctatagagagtatgtaaacaaatgggcatggttgtgtgccaataaaactttatttagaaaagcaggtggtgagccatagtttgttttttgagacgaagtctcactcttgtcacccaggctggagtgcaatggtgtgatctcggctcaccacaacctccgcctcccaggttcaagtgattctcctgcctcagcctcctgagtagctaggattacaggcatgcgccaccacacccagccgggccatagtttgttgagccctggtcggcctgctggatttgcggttcccttggcagagtgagccacgtgctggagacctgagaggcctttggatctatcccctgccttgtggccagcaggtccctgactcagctgactcccaataggcccatatgcctctctgggcctcagtttctccagttttccattggaggccttgcattcccctcctgtgcgctcagcatgcccagagttctgtgggaataggactcactctttagcttccagtttccccagctgaggtgggcaggtaagggccagtctggacagctgagggcattttcatgtgtctacctcatctcaccaaagtccttcattcccagaagctgctctgtttgcctcggggccctctgacagccccgagcctcccgccagtcagctgggcacaacctctcatttgtgggtgagggtaattaggggtcctccccagctgctattccgggaaggctgctggctgtggacattctgctgggtggtgactcccaggcaatcctgatgtcctcaagggctctcagggagagaaattgcagggcgtgaccctgctcctctgttccctgccacgaactcaaaaataggctaaaataggaaagggccaattccaggattgtggctgcagcaaaatacagggtgaggtgcaggatgggcgattgggaggggcctctgtggcaccttttgaggcgcctcgaactggggccaaactgagcctgcagacactaaggtattcccaccttagggctgaccaggggtccggccctcttgctttaggcacatatggggaaactgaggcttgccatttaatccccacagccaccccagcatgttggtcctgttgttattcttgtagacaaggaaactgaggctcagagaggctaaagggcatgaagtcaggaaggggctgagcagggatttgaacccagatctgagattatcctataaagccggaccagcagcctcgagggaaaggtattgaggttggtagctcgcttggctgagctcgtggacttgagggattccacgctgttttccacaaatattttggccaatatgcaacattgcaattcttcctcccactcctggaatcttctaacttaatgtttatagtggagtcgaagccagcggccccctggtgcctggctccccagctctggggaaagtggcaatttgtgtgtctgttttctcaaaaaggtaacaggggtggcctgagaaaggggctcacaaacaggtagagttccaggtgaaatgtcctataaaactaaggagaaagaaagaaatgcccccggctgctttccactgagtcaccacatccagaaaaagcctctgtcttcagggacgagggggatgtcttgtggctaaggcagctggtttcccttgtttcaggcacccactggcgtccgacagctgcctttacctctccgagccttgatttccacctttgtccactgtttatactcagccctgcctcatctaacaggcctgcctggacagtgtggggagaggaggaggagaggaaggaggctcgatgagggcccttctgctgcctgctggctgctggctgtgtgacctaggggcctgagtcttagtctccccgtctatgaaaggggcacagcaaatccttatccaaggagcagatgaacttagcatgcctccccagtgtgcctggcactgggaggtgcccagttaagttgtaagttacagggatcagatcaccaattggttgatactggttatttttattcattttcctggcttgtcctagaaaggggtcagtgtgtgtgtgtgtgtgtatatatatatatacacacacacacacacattatatatattatatatgttatatacatactatatattatattatatatatgtgtgtgtatatatatatatatatatatatattttttttttttttttttttttttttgagatggagttttgctcttgttgcccatgctggagtgcaatggcgtgatctcagctcactgcaacctccacctcccgggttcaagcagttctcctgcctcagccttgcgagtagctgggattacaggcatgcgccaccatgcccagctaattttgtatttttagtggagacagggtttctccatgttgtgtcaggctggtctgggactccccaccttgggtaatctgcctgcctcgacctctcaaagtgctgggattacaggcggagccaccgcctctggccggcgtcagtatatttttttatgtaaagggccacttagtaacaatttaggctttgtgggccgtacagcttgtcacagtatccaactttgtccttgtggctcaaaagcagccacagataatacaagtacaaatacaaatggccgtagctgtgtgccaataaaactttattcataaggtcaggtagtggagcagatttggcctgcggggactgagtttgccaacttttggtctaaagtgtctcagcatcatttccttctgagaggtctgagcgccttttcacaaattactgctcattggagtttgcttatgttaattgactgttcatatcctttgcccatttatctgtgagcttctgagctttttctagttgatttgttagaggtttttatattctagatatttattcctgttggttttggacactatagttaccttcacatctgccatctacctatggagttgttatcgaatggaggtccttaattttagtctagtacaagagggtcttatacacagactccttttcttctctaggacaaagatgtcatcctatatttagttttgttagctttggttttactgttcatacgtaggtctttaatccattagcttattgttgcatatggtgtgaggtagggattcaatttttttcccccctgggcaagtcagttttccatgcaccatctgcagaatactctatgatcataaatcatcatcatagactaagttcctgcaaacacttagtcctcttatgtgacttctattcccttctgctggttattgatctgtttctactgcatttccacactgtgtgttactatggctttgtaaaatattaatgtctttttatagcaggtgaggcaagttcagacttttcaagagaagtcagaaagccagatcgctttgtgaaatatcctaatatgttagtgttggcatatgattccattttaatagaatagtgtttgccaaaccaaacgtgtccatggcctagttccagcctgtgcctgccagttggcaaacatggctgaaactttccctgtgaatctgaccactgagtgcacatctgtggatctgcagtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctggtaggagcacagctgagcagctgtcccttccttgccagagccccctgcaggcatgggagctgggcgaccttctggttatgcacagggaagggggctcagcttggagtaccagaataggtggattctaggtggtagggggcaactctgccaagaagccaggctgcatcactggctgagactaccctcctaacaaaagagattgggcttgcaggtctccctttctgttcccttgcctctcctgtcccctccccgtacactgtatagagaggttggcctcctgaagcaactcatcctgcataccccacagcagcccccatcttaacgcgtggcctgcagcaggcagtcaagacagaggctcagaggttaggtttctggtcactgccagggttggagctgaagcctgactcatatgaagacggctccattaacttctctcccatagtactgcagggactgctgttccctctgatttcatgcccctcactgtaaagtcccccaatgcttcccgtcacacttaggataaaattaaacctctcactcccctcccctccccttctctctttcctctttccctcccttcctccttccttcctctctcttctttcttttctcttttcttgttttcttttcttctttctctctctctctcgtgcccgtccttccttccttccttccttccttccttttctttctctcctcccctttctttcttccctcccctcccctccattcccctctctcccctcccttcccctttctcccctcccctctctcctctctcctctcctctgcctccccagtggctaggacaacagacctgcgccaccacacccagctaatttttgtattttttataaagacagggttttgctatgttgcccaggctggtcttgaactcctgggatcaagcgatcaacccgtctcggcctcccaaagtgctgggattacaagcgtgagccattgcgcctgacctcctgatctcttttcttatcctccagtgccttggggcctccctcaggacctttgtacgtgctgtgtctgctgcctggagcatgttcctccactctttatgaagttttgtttttcatttcgttcaggcctcagctccgatagcaccttctctgcccccttgccgtgccctatcccattaagtgctttaattccaactacgtacactccctgcatcacatcctgtatttcttttgtttattcgtttatagttggcctcccgcactaagcagggctgggcttgtttgtcttgttctagatggtgtctccagcacccatgagaactgcctggcccgtgtgatgggcagcatctcaatcaatgtctgttgactgaatgagtgcctttccctgtatcccccgcactggggaacccccagacctgtttctagcatgcctgccatcctgccctggggtgggaccgctcctccctaaactccctgactccacattcttggtggctggacacctttggatccgtgtgattcgttaagccagtggcaggcacagagtgagcactggctctgccaggtgctgtttgcgttttgctctgtctcgcccacctggatctggccacttccctactagacctgggacgaggtcatggtcctgtgggggccacggtggggctggccgtaggcccacctcgctccctgaccgggttccttctgccctgggcccccagatcctgccccaggaggaggactatggctttgacatcgaggagaagaacaaggctgtggtggtgaagtccgtccagaggggctcgctggctgaggtgaggccctcgggggagctggcagggaccgtgtgcaggtggcagagcggggtgtctctcttcaccctccttgaggcagcccagcccaggagattctggaatgatcgctgactcctcttctctcattgctcacgtggagaaactgagtccaggacccactgtctgcagtggctacagtagctgggagtgagtgcagagtcccggggctgtgctcctggtgtgttccaccactgccctctgctggacattgtggggaggtacaggaaaaaagcaggtgtctcagttttctgcaaccagtcacagtggcttgaataagataagctcattgctgtctgatgcaaagcctacaggaggataggttaggagagtgagggtgtggctggccgaggattcagccctggggccttccggctttgcctggggcgtgtgcaggtgggtgggggagatgcacctgccgtgctggctggagcccagcttgcccctgtggcaattaggaatgctttgggctgcaaggagcgacatacccatggccggagcggctaggttgaccttgccagtgatgtgagcggttggaaggaggcagttgtgaatcttggttcgggtcagcaggtcttcatctttcttcgccaggccctaacagacataagatggccaccccggtgtgaccctcgtgtccccacacaacagggtcaggccccagcagagtttcccctcaggaggaatacctttcccagctgccctcccatgagcttccctttgtggctcatgaggcagaaccaggtcccttgtgcccctcaactgcttaccacagacagcacgcagtcacccagtcctgctggatcccttgggccagcacccttctgctgaacacatttgagcttccttggtgaggagggaaggagcttagtaactggtgtgcacgtctgtcctctgccgtccctacccaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagtgagtgtcccagggcggggtgtccggcagccctccctctcaggctgagtggtggctgagggctggggtggcatgaactgtcctggtcccccgtggctgggacccattgttggagtcacacaacacaagctggaccttcattaattcggcagatgtttacagagtgccactctgtgcttggtggcagtttgggccctgggaatccagccacgtggggatgcatgcggttcctgccattcatagatctcagatctagttgggggaggaggcaggagacagacaatgtgcagatacagaagtaagacactgagcctgtgctggtgagcgtggcacagataagtttctataaacccgggaaaggggccagagtgtgcagagggatggctgtcagggagacgtcactgcgagtcggggtgaagacccgaagcagatgaggggggagtcaaggggatttctggaggaagagggctccaggcaggggaagcagctagggcagaggccctgaagtgggaccgtgtctggcgcattggaagagcagaaggaagctgatggggctggagcagtgagtgagagggagggctgggtagtgaggtctgtagggtaacggggtccaggccctggaggcccctggcaaggacccatggggagccactggaagcttctgatcgaagtcctgtggctgcaagtggagctcagattgtcaggggcaaaggtggctctcgggggagctgaggaggtggtggctcagcagagtgcgagagcaggggtgggaggagcagacccgtgctaggggtaggtaccggggagcaaagcattttgtctttgaaaaattatgcatctggtttttcacttttcccttttatttaacacagatcttctcttgacaggaggggtggaaagttttaaatatgattatttcagtaaaaaggcgagctgacttagggaaaatgtggttgatcgatgggttggtatgtggaagtggcagaaagcaccaaggtggaatgtgtctgctgaaagctgtggaaacacctggtttgagagcaggctcccagctcggctttatctgcaggggggaatgggagggacaattgtgcagcatagggttggagacctgccttagacggggatgtgggcagggtactgatgctccaggagcagtgacacccattgccctccctggcaggtgctgcctctctgctttggggatcgacccacagaatggcccagacctgccttcctaggggacttgtgtgggtgtttttctagggtcagcaccgagatgtaccagcagatcacttctcaccctcccacctgcgattgttaaactattgactggttggagtgctggtctcacctccaagggtcttaggacaggagaatgatggaggtgtgggaggatggtctggaatttctgttcgaggacagaagctccaagggcaggccagtgggttgtgcttaatcaaagatcctggtggcatgggctctgcctgattgacatttctctctgtatttgggagctggaaagcctggtggtgctactactattttgggctgaattttcccagtgtttccaaggcagaaagtctctgggttggcaccggggttattgagagtgatgctggttttcctcatggcctttttccctgcctcttctacctggtgcaggatcatcaaaatccccgaccagccggacacactgtgcttccagattcgtggagctgccccaccgtacgtctatgctgtggggagaggtgagtgggagccttgggagagaggggaaaggtgcagaagatggtggatctgtctgtgtggcaggagttcagagccttctgaactctaggcttctgccagacaatgtaccatcagcacttattttctttgcctgatgccaagacttgcaaacacaaatgcctgttggggtcaggcaggctacaagtgggtagccatcccagtggaagacagtgggtagtggtgaggactatggcaaggtgaaaaaatacatgttcactctggaaggagcagtggctcctcagctggagctccttattgccagacaggaatgtgggtccactctcaccagacttgattttctaagagaagccaccaatgcaaatttgggggctctgccgcaatacttctatggccggatccagccgaaaggccaccagttcaagacctctgctttctgcattgcctattccttgtgtgctattaaaggcgtcactatgtcttggagatggaaccaagtaggtctatgatactgggcccccaaactttttttgcatctaagtgcccctccctttaaagtttaaacataaatttttcacttgtgtggtcatagttgtgtgtttactaggtgttcattaagaaaacgcataccatgacagaaggttactgagaatttgataatattttaaagtaggttttcattttgtcctaaagcagtgattctcaccttgggacaacttagcctcctctccagaggacatcggccctgcccggagacatttttgtttgtcgtaactggggagggggtgtttctggcggttagtgggtagaccagggatcctgctaaacgtgctgcagtgcacaggacagccccagagaaccacacagaattatctggcccaaaatgtcagcagtgccttggtgagaaatcctgcctcagaacatctgcagagatactgataatgggtagtaataggtgttcataggcaaagacggtaaaaagaataaaccagctgctattccttgagcacttaccgagtgccaggcacgatgctaaatgctgcacacgtgttagctcgtcggatctccccgcgaccctcagcgtagggattatgagcgttcccatttcacagatgaggaagccagcctccagagagtgaagggacttgccgaaggttccagggtcggtctatggcagagccagggtttgaagccatgcaagtccccaggggctgtacttggcaccaccacaccattcaggcctggtattgccccatgtctgggcaaagcttgacatttgtttgcatttccagacctttcacatgaactacaaaaaaaaccctgggttcaagacctacggtttggggattgtggaatagctgaaaaaccttgcccttggagtctcataggcctggttggaatcctggcttctggccattcggcctagagagcatggctttgcctctctgagcccatcacgctttctgccaaatgcggcccagtagcacaaggcggctgcaggactttaaaggagacgaggttctagagtgaaacgggcctgaatcggatcccgtttgccttgctgcgtgaccttgggccagctactacttctctgaaccttagtttcttctgcaaaatgggaacatcaatccattctttgcactggagtgtcagagggcggctctggggtgggaggggtggaggtggagtccttgcgcgtgtctggggttgcagtggtgggtggtgggggacagtgttcagcgggctgcttgtacttgcctggcatccagcctcatgtgctcctgttccccttaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctggtaagtttactggaaaccggggccgtcaaagaagtcctgctgagtgggggtgggtggctgagggctgtcctctctttagagaaaagcctgcatgtaccactggttgtgagtagggtggagctgctgacccaacaagagggagctgggcctgagctttgtgctcccgctgcatccttaaaccagagttgctgagccatgatacccgggggtctcggttttcacagctgtgaaatgggtgtgaccagaccctctctcctcaccacataggcatgttgggcacatagtcaagtgggttgggaaagtggatactccatttggttgggggccagggttctggtggagggcgagattccctcattgattgattcactggttcactcagtgtgtgtgtgttgggcacctgctgtgcaccaggcatgtttgtagaccctggggacacaggagagacgtgtctgcacccatgtccctgcctcacattttcacatcccctggcttctgtatggagcatagactgtgcacggtgagggctgagtgtgactggtggtcagtgagtttccagagctctggaacccaggggcagttcacacctcggccctgtcccctcctccctacctgccggcaccatggctgtccccttactctggcttctggcagggcctgtaccagtggatctaccacacccatgaggatgcccaggaagcacgagccagtcaggaggcctccactgaggaccccagtggcgagcaggcccaggaggaagaccaggctgattcaggtaatagacggggcatggcatgacaggagcttccagagggactgagactccggaggggctgggtcctctcctgttgtcccctcccctcccctcctcccagccagtccacctccatgccagcaggtttgttttttttttcctttttggagacaggttctggctctgtcacccaggctggagtgtagtgttgtgaccacagctcactgcagccccaacctccctggttcaagtgatccacctcagcctccggagtagccaggatcacaagcgtgtaccaccacacctggctaattttttaaattttagagttttttttttagagatgaggtctccctatgttgcccaggctggtctcttaactcctgggctgaagcaatcttcttgcctcggcctcgcagagtgctgggattacaggtgtgcaccactgcgcacggccgcgatgcccacgatgttatgtcagtttctgatggctgctatagcaaagtgccccaaacccagcagcttaaacaacacacagttactacttaaattttggaggtcagaagtccgagtcccactgggctgaaatcatggtgtccacagggctgtggtcctccttgggctctcggggagaatctgtttccttgcccgtttcagctccctggtccaagccactatcatttcttaccaggacggtggcagtagcctgctcatggctctccctgttctgacttcctctcctccaaggggctattcccccagatgagaagagaaccttccgatggctccctctgtcctcagggccaggccttggatggcttgtgtgaccttgtccagactggctctccaacaccttccatcacttccccactcgcctctctactctggcggaatgtactcctgccctggggcctttgcacttgctgttcccactgcctggaaggcttcctccagaatcctcctcgcctcgccttcctccctccctctgatctctgctcagatgtcacctcttttggcttccagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaaggtctccttgggcactgcctggccctgccctaccctgggggattgaagccagtttctcttatcaaaggttgggagaaggagttgggtgggacacccgaatcccatttcctcaggcttagcctggagtcctgaattctggtccttgtcccaccactaggtagcgtgggactgtgcagagtggcttgtccctttagcctcagtttactcccgtgcaatatgggccagcaacacacctgacttcccggggggtattacgagtagtacaggagtcactgtgggtgaaccgcttaaaatcttcccggcacacagggaatgctcagtagctgttgacatttctgcagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggaggtgcctgcgtgctccctccggggtctctgccacaggtcccagacatagcatctcagcctgggatatttgggttgtaaattacaaagcccaacccaactcagctgaaacaaacaggagaatgtatggtgtgtattactgaaaaggacggaggtgaacttatcacatcatagcagtgcggcctctccgcatctcctggcttcgttttccttagcgctgggttcactctcaggcaaacccttctcatgtggtggggacacgttggcccttgatagctctagcctcagcaagcccaggagaaaattaactccaagggagttctggttggcttggcttaggtcacttgcctcacctggttccaatcgccatagggatggagaggcacgttgaccctgaacctcatgaactgagggtggggcagagacaatgcctcaaggatggttcaggggcagccaaaatggagccatgcatggggtgggcaccccgaggccttgggttcctccaggccttccctgcagtcctgagccgtgaaacacagtccaggggttccccttctcatttggagctactggcattttgtccaactgtggggcatctggcctaggccaggataaagtgggtactgggtatgggccaatatttccagaccctgccctgtgattcacgaccttacggcctccactttctcagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggtacctgtgtgtgtctattagaaactgtgttcagatgttgcactccagatacttaaaccaaaacttgtctgaaggtcagccgtccagggctggaatggcggctccatggtcatcagggatgaccttctctctttatgggacagcatctctagatgtggctttatgccttgtggatgatatctgctggggtaccagccatcatgtctgcattgcaggcaggaaaagatcacagtagttaaaagcatgttagcaccagactggaacagtcttcttgaagtaactgaatgaattaagagtatttagaagggacatttttctccttcattgggatccttgaaatgggtttgtattgttccgcccaaaggcccagtggatgctgggggctgttttccagtgagctctctcttcctccactgcaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggtgagcgctggccgggggtgtccggcgtgagcaggggcaggtgttctcaatcctggccttactgacattgtgggtagcatcattctttgtagtggggggtgggctgtcctggacattataggctatttagcagtatctttttcgtctatccactagctgccagtagcaccccctcacctgattgtgacaaccaaaaatgtcttcagacattgctaaatatcccctgcagggaaaatcatccctgactgagaaccactggtgtaatgaaatattatggatatagcagcgctcatcagtgaggctaaaactatctgctgaaagattctggagagaactttataattttaacatcatagaaaggaggcagctgtacaagccgtccttttgctgtaatacaacaggacacagacgcagccccgcccacgaggctcttgccagcagatacagagctgtcatctcctgaaggttcaaggtctccttactcagctctaggatgtggggcagagggtggttcaatggcaccttggggaggcatccggccaaatcatcaacgaatgatggggaagcaggtgtggggaagaggaactgctggagattaaagagactcaagagacggacctgccagatgcagcctctgaacctgcttagcaggtttctagcacgtccatgtggggaggcattttgagacaatcaggggtgtttgtccacagactgggtgcttgatggtattgaggactccttccttctgttgggcacagttgagcagtgtggtctgtgtaaagcagtgtctctcacccttgacactggtgacatttggggctggattattccttgttggggagctgtcctgggcatcggaggatgttcagcagcatctggggtctctacctacgagatgctggtggcaaaatccctcttcagttaagacaagtagaagtgtctttggacatagctaaagatttcctagggggcaaaattgcccccacttgagaaccacatgtttaaaagaaagtctgtatgtattagagacacctgcggaagtaggtgtggtggaattacgtgttatcttggacttgttttaaatactccagtgggctgggtacagtggctcatgcctgtaatttcagcactttgggaggctgagttggagggattccttgagcccaggactttgagaccagcctgggcaacgtagtgaaaccctatctctataaaaaaaaaatcctaaaattagccaggcgtgatggcatacacctgttgtcccagctcctcagtgtgctgaggcaggatgacttgagcccagaagatcgaggctgcagtaagccatgattgcaccactgcactccagcctgggtgaaagaacgagaccctgtctcaaaacaaaacaaaatgctccagggaaataaaaagtgatggggatcatgggggaaacaaggtggaccctgagtggctgttgttgaagctgcctgttggatacctgggttcatgatattctctctacttttgtgtatgatggaaatattccatgataagggaaaaaaagaatgtagactctagagccaggaggcctgggttcaaatcctggccctgctacttatccactgtgcaaacttaggcaagtcacttaaccactctgagccttggtttcctcgtttgtcaaatggggctaatcatgctactgactgtggagatgtggtgggattgcatctagctgggcgtattcatcactgctcacttagaaggcacgagacactgttcttttttttttttttttttttttgagatgttgtctcactgtgtcaccaggctgcaatgcagtggtgtgatctctgctcactgcaacctccgcctcctgggttcaaccaattctcctgcctcagcctcccaagtagctgggactataggcacacgccaccactcccagctaatttttgtatttttagtagagatggggtttcaccatgttggccaggatggtcttgatctcttgatctcgtgacccacccgccttggcctcccaaagtgctgggattacagatatgagccaccacgcctagcagagacactgttctgagcactttatccaactgtcaccaggctagagtgtgatggtgtgatcataggttgccacagcctcgaactcctgggctcaagtgatcctcctgcctcagcctcccaagtgactaggactacaggcacatgccgccatgcctggctaatttttgtatttgttacagagatgcggtctcacagctggtcttgaagtcttgagctaaagagatcctcctgcctcagcctcccaaagtgttgggattacaggcgtgagccactgggcctagcctgtttacacattttaactcccttaattgtcacagaagcctaagatatagatactgatatgatcccattttacatatgaggaaacagagtctccgagagtttaaataattagcttgaggaatggcaatactgggatttgaatctggggtttagctagcttcaaaacctgtgctcttaaccgtcacaccctacagtggggattgatgagctatggcctaggggcccagtccagacttcagcctattgttttctttttcttttcttttctttttttttttttttttgagatgggttctctcgctctgtgcagtggtgcgatcttggctcacttcaacctccgcctcccaggttcaagcgattctcatacgagcctcccgagtagctgggattacaggcacccgccaccacacccagttaatttttgtttgttagtagagacagggtttcgccatgttggccatgttggccaggctggtctcaaactcctgacctcaggtgatcagcccacctcagcctcccaaagtactgggattacaggtgtgaaccactgcgcccagctgattgttttcatttttaaacaaggtgtcattggaacacagccacgcccatttgcttccacactgtccaggtctttcccactgcaacagcaggttgaatggttgtcactgagaccctacagcctattgaggtggaaggatttgctctcagggtcttcacaggaaaggcttcctgcctcaccttctggtagagccttgtgtagcttggccgtgaaagaacttgcgagtctcccacccccaacaggagggccagtgctcacacctgcagctgctggtgggattttcagggaagggacacaaagggccaggcctgtatctttgacttcaaggtctttgcttccgtaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacaggtgggtgtcaccgtcagggggctgaggttagatgaggatggccctggacaggtgaggccacggacccgtggcaacatcagaatcagtggacacttctcagggtgcagtgggctcagggtgctgttgctgatagcgtggttctgggggattatctgagacccctgagcctggaagacccacttaggctccccagttgcaaagctgacattttagggttgtccccacgtggacccatctgttctgcctcagtgtcaccccacacatgctgacacgatgttgtcaggcacaagggcaagattctgtggtgtgtttgcaaactcagtgtaagacatacggtttctgaaacaagcactatttatgtttatttggtccaaggaggaagagtgcagttttttcccctcctaacctgagaagatctaaattttctactggttaattataacaagatcagtgaggtcctaactagttggttaaatagactaaaactcagtttcctgtaataagccatataatgggtaagtttaattccttactgcagataaaccagcactgtggtcccagtgaaaggtgacatcacatttgcccatggtggttacagtggaatcttagagggtgcttcaactgtttgtgggcaaaaatcagaactgatacagtttgagaaggcagaccttccccccagtcctcgcagcgtgaatgttcttccagtcgtcaagggatctgcctgatcccccgttggctgctcgcctggcgtctgtatctggctgctgcggcactttgtgcccccagagcctcatgtccatagtctcagattttgccctctctctgggatttcattcttacatttttgggtcctccagtttttcctttaattttcaaaaaggtgaaggaaaaaatgtcaggatcctgggttttgatctcccacaccttccgagttcctgggccgtagggaatccaatccagtccctgtcctcatgaggtttccagccaggctgggggctgaggagacggaagacagagccctgtggaatgggcaggtgtctcagggcaaggctgtcccctggggacactggacagagtgacacctgcgtgaaaatgattcaccgtcttcctcctatttctgtgtttctgtgctagagcctagaaacgtttcccagccctcaggcgtggaaaacccaccaggccggccttccctgcctttgggacccaggaccggtgctcggtgccctctctgggctgcacgcccacctgagggcccaggggttttgtctacactgtagaaagtgggttttgggtgccaggaccagatggcctgagctcagggtgactcagccccttctctgggcccctttgcagcgagtgtaacagcaatcgagactcggtcctgtcctacaccagcgtgagaagtaacagctcctacttgggcagcgacgagatggggtctggtgagtggagtggcagcggcctgtgctcagggagagaggctcctccccatgagatttagttttagtttattttattatactttcctctgcattatattgttttgtgttttattgcatggtcctgtacttgatttccttccattcagtcattcaacaagtatttcttgagcccatattatgtgctgggcactgggaatgcggcagcgaaagaaacaaacatctccgccctcttagagctgatgttctccgtgaatgtcatggagatggagcaaatggaagcatgcacggttcaattctgtgtacttcatgttcgatgaatgttgtgatgcgtgtgctgacaactaaacagggtgacctcatggtttatgtaaaaatgatacatgtgtaaaccgaaaatccaaatgacacagagcagttcaaagaagtacccatggctgagcgtggtggctcacgcctgtaatcccagcactttgggaggccaaggcaggcggatcactttaggtcaggagtttgagaccagcctggccaacatggtgaaaccccgtctctactaaaaatacaaaaaattagctgggtgtggtggtgcacgcacctgtaatcccagctatttgggaggctgaggcaggagaatcacttgaacttgggagggggaggttgcagtggactcagatcatgccactgcactccagcctgggtgacagagtgagactccatctcaagaaacaagcaaacaaacaaacaacaaaaagaagtccataaaaatgaatgagagtcttatcatctcccccagaaatgaccctcgccagcatttggagctcattggtggggcctgtgaatgcatggatgggcaggtgggtggatggatggatagacagacatagacaatattttataaattagatcatactctacttacagcttttttttttaaatttttttttgagacagagtctcactctgttgtcaggctggagtgcagtggcacgatctcagctcactgcaacctccacctcccgggttcaagcgattttcctgcctcaggctcctgagtagctgggattacaggcgcccgccaccacattcagataatttttgtatttttagtagacatagggtttcaccatgttggccaggatggtcttgatctcttgaccttgtgatccgcctgccccggcctcccaaattgctgggattaaaggcgttactgaaagcctgaaattgttttttattttagtcttgtttacttcagactttaaagcagttcattttgcaaatgggttgtgtatccacatggtacataattcagaaggccccggagggtgcatggtgacaagtctcccccccacccttggttctcaggctgtcactgctgttcccactgtcactgcagtcttgtgtgtcttttcagagatagtctgtgcataaaaatttaattttaattatacttcaattaacagaagaaaaagaagctcaagtaaaatggaagaaattgttgaactttagatacagatttcatcacataagatagtcaactgcacaaactgtccccaggtggctctaggaaggagttgggtgtgacagctgatgtaactgaaccagctgggtgaggaatcaggagacgtggcctccaggtccttttctctgttcctcagtccctcatttgcagaatggaaacagtagcagtgctttacaatcttgtcatgcgttagtgcctgttgtccattttgcagatgaagaaactgaggctcagagaggtcaggtgatttgccctgtggctcacagccaggacctggtcttcagactccacatcccttgtgggtttggagttctgtagctgtatccccctcttaggaaagtgctggggatggtgtgaggtggggcaggaatgactgatggctgctgcttctacctcctgccaggagatgagctgccctgtgacatgcggatcccatctgacaagcaggacaagcttcatggctgcctggagcacctctttaaccaggtaggacctttgccccactcctggcgcaactttgggttcctcctgtcacacctggggagggcccatgacccgggggctgtgggtcccagatgtctgcagtgtgtagggccacggggcccaaaccaaccccaggcttcttgccacccaggtggactccatcaatgctctcctcaaggggccagtcatgagccgggctttcgaagagaccaagcatttccctatgaaccacagcttacaaggtgaggggatagccagtccaaggtgacagcctgcgatggggaagggtgttagacagggcggcgtacccgggctaatgctcagctctgccctcctactgctgaacgactgtaggatcatcaggacagcgattttagcccatgggccacatccagtccatgacctgtttttgtaggctctgagccaagaatggttctttttctttttcttttgacctttccccttcccctcccctccccttccctcccctcctgtttcttttccttccttccttccttccttccttccttccttccttccttccttccttccttccttccttccttcctctctctctctctttctttctttctttctttctttcttgttttttggagaaagggtctcactctatcactcaggctggagtacagtggtatgatcacagctcactgcagccttgacctcccaggctcaagttatcctcacaactcagcctcctaagtagctgggactacaggtgcacgccacttctcctggctaattttggattttttttttttggtagagacatggtttgccttgtagccatggctggttttgaactcctgggctcaagtggtcctcctgccttggcctcccaaagtgctgggattccaggtatgagccactgtgcccagccttccttcatgtcttttaaaccatactcatttttttcttattattgacatcactttttaaaaagtatcactcttaaaaaatttaattttgaaaggaccttattgaactccctatatatgaaaagccagcataatatgccaaaatttgatgataaaccataatgataatgataaattaaatgcaaacaacggcaacgaaatatcattataccgcagttaggcactgttgcctgccaagggctctttgttcttcatttaagagagggatttgtgaattaaagaagtgttaagggcttaccaacaccaaattgaggctttcttcttgaaatgattgagagaaaaggaattgaaatttcttatgttctcccacctacctctcctcccatttacccacctacccaccctactcatccacccaacctactatccgtgcatccacccatctaccctcccactgtctatccatctatccacccatctatccatccactcatccatttatcatctagctatccatccattcacccactcagccacccatgcacccatcaatccatccgtccatccacccctccacccaactacccacttaccatctatccatccacccacccacccacccacccatccatccatctacccacctacccatccatccatccatcttcttgtctgtccatccatccatccttccctccttccatctgtgtgcccactctttcacccttctacccattcattcatcatctacctgtccattcatgcttctgtacatccagtaaataatttcccagaaccagcttgtgccaggccttgtactgggcactggagaccctgagatgaatttgatactgccctgacctcaaggagctcattgtagattgtaggagatagaaatgcagatgggcagttgccaccaagagagggtgggaagtggtgaggacttggggctccccagctcagctgcacatcctgctgtctcaggatcagctttcagggatggacctcagaaagcagaaacagcaaacccacaaatatctcagaaactgggaccttgcaggaggaaagagcctttgtcttttgcaggggcctttttcttcctggcctctgaatggtggggccagaggtaagtcccagcgctgtcactgcccagttgcatgacttaaggcatgtcactttcccactctgtgtgtgggcttcctcctctgtgtagggaaagggatagaactcatgtgccatctcaattggttgtggctatgaggaggtagttcctgagaatccttctgtggctacaacatccaggcttagacgaaaggaaagccgtgattgatttgtgaggtctgcactggattggctatagctgtggggagtcttggtctcagagcagcaggaaggagtgctgagattgatgaataatgcctgccatgggtgtggtaccatgaaatagcacacttaccctctgtggacccgataatgcccaggagtcctgccagctcccttgatctaggattatgagctctgggatctgtgatgggacataggcctttgtgccaccgttctccaacactacctccgtcccttccctggccctcatgccactttcctgccccagagtttaaacagaaagaagagtgtacaatccgtggccggagcctgatccagattagcatccaggaggacccctggaacctccccaactccatcaagaccctggtggacaacattcagagatatgtggaaggtcggtgggcagggagggtgcatcatggtggggagggggccatggcttttggtgtggaacctgagagaatcaggaatggatccagttctgtgacccctgtttctccatgaccagggagaggacaagagaagtgatgccctctctcagctgagtgtcctgccctgggcaggatgtgacttgagcccaggagtttgagacctgggcaacatagtgagaccctgtctctatcaaaacaaaaatcagaaacaaaacaaaacaaaacaaagccctgactttggaggttgaaaaggctgaacctgttctttctcagcttccaaagcattggatgtgtgagttcctgttattatcagggtatgagggacaccggctggcagcccactgaccagattcaggcccacagataggtttcgatgctgcagcagcaaaaactgtgactctgcttccagcttgacaaaggttctcacatagaaacttggatttctggctgctcttgaacaacacgaagatctggtgactctaggcccagtctcccatcctcccttggtggagaggagtggcggccgctctgtgtacgtggggccgaggtgctttccagttcaccccagtctccaccactccctgtggcttggcgtctgctccacgcatcttacatcacctgcctggcccttgccggcatttgcgtctgagactcctgcgttagaaggatccggacgagggagatgtttgaccaggacagtgggagattagaggactctgggctgttccctcggggaatggcagcctctgagtcggagtctctgctgcttctgatctgtcctgttctccaaaagtgtaaccagtgaggagcatcgactctgggtccagaccaccagggcttgaatcccagctcacccacttactggctgtgtgatcatggcgagttccttgacgcctctggccttagcttcttcctgtgtcaaatgggcccacagtgctgcctccttcccgtgtggtcaggaggattaaatgagtcagcataggtcatgcgctcagtgccctggctgcctggcgtggtgactcctggcctggcttcctggtgtggtgagttctggcctggctgcctggcgtggtgagtcctgccgtggtgcctggcgtggtgagtcctgacaagagcgcaccactgcagctgctctcgttcttaccctgcccagccctgagtcctgcagtcctccctggggaagaaggcacctaataaaccaaatccaaagcccttccacatctttctaagcccttttgtgggccgaggagcatcttttttaaggaaagagaacaggatgttgggcctggaagaattgagctttttttgcaggacagggcgtgtgtagggccatgcccatgtaggatgagaatatgtatgtgaggctgttaggagtgtgtgtcttatgtgtgcactcgtgtgtctgttgtgtgtctgtgtggatgtgtgtgtacctgtgtgtgtacatatgtatgtgagtctgcagatgagtgcacgtgtgtggtgtgcacttgtgtgtctgctgtgtgcttgtgtgggcgcatgtgtacctgcgtgtgtacatatgtgagtctacgtatgagtatatgtgtgtgtctctgtgtgtggcatgcacttgggtgtctgttgatgtgtgagtgtgtgtgtgtatggatacgtgtgtatctaggttgtacgtgtgtgtgaccatacttatgtgaacaaggtgtggggcaggggctgtggcccagggattaaaggggctggttccatctgtgtcccaggcttgcacgtacagatggggctcacagttggggttccactgcctgaggtcaggggttcctggagtttacctgacaatcaataaaacctccttgagcacagccttgggtgccagggctttgctgtgaagggtcagagcaccttgggaggtgccatggggaggggcccggttctgccctcacctcttgctgccccctcccagcccgtccccctttctgtctcccttctccttccagatgggaagaaccagctgctcctggccttgctgaagtgcacaggtgaggcctttaaaggtgtgtggggggcacatacccggcctcttccaccacccaaggccgaccatccatgccctcggggcctggacggggggaggcaacgctttggcctggagcccctccaagagctacttgaaacttgcttcttcctcttgtgtccaagggacaagtctcagggcactggagccaggagccctgtcctgtgccactgcccaggcctgggtggatgttgacggggccccgggatagaggacgatgttagggggccttgtgccggtagagccttcagccccagcctgggggcttccacccagcagagagtggggaagaggaagggggaggaggtagcgggagaatcttggagaccttctctatccctgccttctttctagaaattagccaagggggtgctactgcaggatctgggtcaaatttggtcactaaaaaactcactggccagaagccggccattggaaataattccttccagaagattgggaccctgagagaccaattgcttgaaactggccagttcttcagaccatgccaaggtcaaggacaggggcaagggcagaggtgggggaaggaagaaagcatagttctccaaaatagagaaaatgctaaactgcatttctgaacatgtgcagcttggcagaagagcttagcaccattggcattctactggccaaggccaaggaatcccataatgagaggagaaatggctgagggtgagggtcttgggaaacccttaggaaaatcacaagatgtttgtttgtttgtttggttttcaaagcaggcagatgagtcactgagagaacagttttggcaaatgggcttgcttttcgtagaattgatttttgtggaattggcttttggtggctgggatgtccaccaaaaagtaatttctggcctgatgttagccctttgctgggggttccatgaggggtcctggacccagggttttggggggtgggcctcctggtggcacgggagcgcccctccagcaaggcctcctgccctctgcccccagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtggtgagtgagtggggcgggagggcggccccgctggcccacccactggtgcccgcccaggccgggtcgagggagcccttgcccacttactcaggctccccctggcctcgtcattcccgcagcagctatttgttgagcacctgtgtgctgttttataggcactgaaggtccagcagtgaacaaaacagagtccctgtacccagggatcttctgtcccagtgggagggagggaggcacacacacacagataacagaatccatgctacagaccagcggctctcagcccagggcagtttccccactaggggacacttggtaatgtctggagatgtttttggttgtgacaactgagggcctgaggtgggagtggggtggtggaagccagggatgctgctggacatccggccaggacctgagagtcaccagtgcctctgaggttggctcctggagcccctgctgctggctggtggggaggcctggccttggagcgccctctgctggctgctgctgcacaagacgcctgcctggcacagattggccatcacttgattctcagaatgcacaacctggggcccagggaggaagcagggaacactcagccctccccttcctcttctcacatggggatgctgggccaagttccttcattctccaaacaccacgatgtgccaggccctgagctgggagctgggggcctgaagctgacttcctagttgggggaagcagcttgagaagaagaaaggacagaggagggaaggaaggtggggagaaggcaatctctacaggaagcttggcgggcactgcagcttctctgtcagagacagcctgtgtgaggtggtgacgcttgagctgagacctcagccagccaggcagacagtgtgaggaagagtgtgcggggtagagggaccagcatgtacaaaggccccgaagagtggctggtgtgaccagaggggagcggcaggggctagggagatgtggggaccagttctgtagggcctgagactttaatctggaagcagtggagggttcagaggcttggagctgggtgagtgatataatttgggttaagttttcaaaacatgacttgtaggatgtattgtttgggggcagagagtggcagaagggaaacctggtgtcatcttgacaagagatggtggacccttgaacctgggtggtggccaggaagctggagggagatgggtgggtctggaggatgttttagtgtcaccccatcagacttggtgatggaccaggcccagggtgagcgggagagaaactgagaagtcaaaggtttggatcttggatgaccgaatgaacgctggtgctatttgctgacatgggaccgactgggggaggttgaggaaggaattggggacttttatttgagtgtgttaggctcaaaaaggttaagttagaagcctggttggtgatccaggcaagagaggcagtgactttactaggatcactcagtgaattaaggcagagatgggttctatgacccttgaaagtgcaggacaagccacagagcacaccatgatttcacatccactctggagagtcacgctcaggacctggcacccagggggcccacagtgtggagtgccgactagagttgaattcagcatcttgataggaaaccctggggcagggttggcatctgagactcctccgcgctgtcttcttcctgcagaaggaggaacggaccatgctggaggacatctgggtgacgctgtcagagctggacaatgtcaccttctcctttaagcagctggacgagaactatgtggccagtgagtgatttctcccatcccccactgtgagaggtggggtcctggggtggaagggacagctctctggggtcaccctgtccttcccctgcctctgggccagctgcccaaggtgggctcagtactcagtgctgtcaaacctcatgcctccaacatgagtgtgagagccgaactttggggcacacatggaaaaagaggggtttctttttgtatgaacccggctatttccaacagctcttaaaagagaatgacactggtacccaattcttaataaaattattccctagagatgtgaaaacttaagatttttaaagggcttaaataagtaccataattaagttccatcctcccttcctcccttgctcgtgtcctcacctctccttcctccacgctttctcccctttctccctttttctttctgtctttctctctgtgtctattttccacccatccttccacctgcccacccatttatttatccatccatgcatccatccatccatgcatccaatcatccgtctgtccatccatccatccatccatccatccacccacccatgtgtccatgcatccatccatccaggcatccatccatccatccgtccatccatccatccgtccatccatccatccaccccactcatccatccatccatgcatccatccatgcatccattcatccatcgatccatccaaacatctgtccatccatccatccatccatccagccatcatccatccgtccatccatccatctatttacatgtccataattttgagcacatagtatatgtcaggctgcgttttgggccatgtaacatggtcctcattcctaccctcctggagctcatagtctagaccagtgcgtctcagccctgcttgcactctggaatcattgagggaactttgcaacgatcccagggccctgggccctagcgattctgatcggtttgtggggtggggtctgggtgctgggtagtctggatgtgcagccagggctgggaacttctgggcttgcttctgaaagcaggggttctcagagcgtggcccctggaccagcagcacctgggggcttgatagaaaggcatattctccggcccagccagaactacggcctcagaaactctggaggtggagtccagaggcctgtatgctgaaagccctccaggggcttctgaggcatgtgggtttaattaggaaccaggcactggattagtgtttctcagttttttcatttcattagattttatttaatttcataaaaaacctttttagtcaatttttcctaattgctgcacccccatgaaattatactactacgggtataccctatgtctgtttatctgtgcatctgtgcttattatacattaaaagaggaaagtgttttcattctccttcccacgagccagttttcacctccttggggacagtgtctctcctgctgaaaatgcatggactagagtctagatgaagggcaggttctctttgagtagcaattggaattgataggcagcagcagctgcctgtctccaggctgagattggctcgggcagagctttgatcgatgagtgatgtctgccatgggtgcaggatggggtctgggtgccatattttgcaccccctgccctaagcgcttccttctggctatgaatcagatgtataccctgtttgagggcagcttttcccaggcaggggccatgggctaccgggtgagggtacaaggagcgctggggaagctctgaccccaaatgctgtggaccccctaagtaggcagagtccgcatcaggttcaagaattaagcagcggaactaggagctgatgaagcaggcgaaagggaggtgtcagctgcagttcttcggagagtgagagggaagggctgctggaggctgtccctagagggcaggagggcagggaggtctgaggctacccctgtagagtcgggagaacagggaggtcccagggtgcccccctggacctgggggcagggaggtgccagctgttctggagaggtgtgccagggcttcccctggccttggcctcggtggtgagtcatcctgccccatatccttccgcagacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaaggtgagcttcaggcctggggcagggaggaccacgggggccgggccaaggccaccaagcacaccggctcccaaccgcctgcccgcccccgacatctcccctcccagtgctggagaacgtggaggggctgccttctccaggcagccaggccgcggaggatttgcagcaggacatcaacgcgcagtccctggagaaagttcagcagtattaccgcaaactcaggtatccgcctggggtccccgttgggggcaggagtcaggaaacctccacgtggagtgggcattagcatggaaggtgccaggcggacccccagcatgggcagtgggccgcacaccctttcttgagcaccttctgtgtgacagcactcttgcctgcgtgagattctcaatggcagcaggccatggatcccactttacagaggaggcgactgaggcccagaaagtgtacacacttgcccaaggtcacacagccaggcagtggctgagctttgaactggggtctgtttggtttcaaagtgggtctttcctactgagaggagccggcttcattctacagagggtgggagctaggacaggggaccttgggactcttgggcctgtgagtgaggggtgcggctcccagggtcttggctgctcagaagagaaccccaggggaggaggggtgagagcaggagccaggtatcaccaggaggaaccacaggttctgggaggcagcttctaagttctgcagctcccactcctaccaccctcccccacagcccttcctgcgtgtgtctcaccacctccctctgtgacagaggcaggccgagaattaagaccccagggagatgagtacgggtctgggcttcatcatttggaaatgagagaatgaggcttcattcgtttgctcagagaaagcatccagcccagttactgaaaactggcatctgtttggattgatcagggctgtcatcagtctgttctgcgccatctgtggaatactctgagtcctgcctgtgtgatgattcattcatcccttcattcacacatgttgaggccttctgcgggccgggcactgttccgggtgcttgtttgggaatgtgcagtgagcaaaacaaagtcctgttcttcatggagcatatattctagagcaggggttgtcaaaatctggccctccttgtctccctgttttgtaaataaagttttattagcacacctgcattcactcattttcacatcctctgtggctgcttttgtgctgcaatggcagagctgagtggccgcgatcgagactttccagtgcacaaagcataaaatgtttaccgttgggctcttcacagaagaagttcgctgacccctgttctggagggggagacgaacagtaaaccagtaagcccagagccatgagatgccaagtggtgagaagtgctcagaagagagaaaaagcaggaccagggcctggggagcagagggctgggggctgctgtggacgggcaggcagggaggggtggcattggaggagtgctcaggaggcccctctttcccccccggctgttgtaggaacaggtgcctgcgggtgagcacagcctgcaggcgctctcagggatttcattctgagagtcggcagagggcggagtcacggtggctgcaggagttgagacctgggtaggggcaggaggatggtgggtgtggtggcccccgcctcattcccatctttctctcgcagggcattttacctggagcggtctaacctgcccacggatgccagcaccacggcggtaaagatagaccaggtatgtccacgtgccctcctgctgcagggagcttgggcagggtggggcgctcaggagtcaggactcagcagacaggcccagggttgtgccccagcagattctagccccaaagcccttgagaccctgcagtctctcctcctccaggaagtctcccatgatagcttcctccccattcccaacttcctgggatgatttattttcgctggcagccgcccatctctgccactccaatccgccttattaaccacagcatttctctgaggctggagcctggacctcatgacagatgtaacctgtatggtattctttttgtttatgtgtttcaaatttgctgtcaacctttagaaatcaaaagatttcccataaaaacagaggcttccagcttttctggaggaatgggaagatctggctgttggggaccatgttgccacatgtccccgttgctccgagctgggagcagctccctctgaggggcctcgatagttcggctccttgggctccttgcctctgaccctcaacacatgtcttttggcctcctggttttctagggtcaggcaggccttgaatgtgctgatgattttggggtgctgtcttggggctgtgagctgggggctccgggaggagggtgggcacagccgtttgggactttccactctggctggcagaatgtccccgcagcacagctcgttagtgaaccaccccttgcacctccacgtgggggtcagggaatgctgggggcagaagggaaggctttttctggagagggggcgcttgtgttggtcttgacaggctgggagagggcactttcttcaggcttcactggggacacacctgggcaggtgaagagaattaggttggaaggttagacctgaaatatatggtcaacactgactgccagcttgtagggcagtggggagccacagagggttcttgagcagaggttatagaagattgaattgcattgttatccccagaggggtgagctgggaggcagctgcaggaacagctggattagaaggatatggtgggggaggagggccagatgggggctgaggggctgtgaggacctcctccaactccccggttatgtgtggtaccccctacagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggtgagctgctgcccgctgagtcggggtgtggggaggggctggcctagcttctggtcagtttggggtcctgtggcaaggaggcaggaaggctgggttccaatcctggttctgccattgcctgtagagccttggctctgtctgcacctcagtttgtctgtctgtgaaacggaatggcagcagcaggtggtcctagcagggctgtggagccacctgcttctctaacgccgtagtgagtgtgtgtgagagctgtgccctgtagttccgccggaagcctccttcaacattaacaatagcaatggctggtttatggggcctgctgacctcactggaggctcccctgcctcctacctccatcctttgtccccagtgctcatcccagggaggaagaggtcaccttctccagagtgcttcctgaccttccgttacaaactgtgcccactctccccactcagtgccctcccaaccctctcttcctctgcagccctcacccccactccccagacagccttcattggggtatttatttcctccttggctccctcagggcagggctggatctgggagggcaggggccccttttgttctctgctgttccccagaggctagagcagtgcctggcctgagacaggtgctcaagaaacatttgctgaataaatgtttcacggggccagtgctctctgcctcctaggtcattgacgttccatgcagattaactcctttccgtctttctctaccagtgcagtagtggggcctattttaggggatctcacctaggggcagttttatccccggggaacatttggcaatgtctggacacatttttggttgtcacaacttaggggagggaggagctcctggcctttagtgggtagaggccgggatgctgctcagcttcctgtggttcccaggacagcccctccagctgggccaggtcctctgtgcaccaccatgctccctgtttcatagttaatagtatagggaggctgaggttaactcagctacccagggtcacagaggagttacatggagggacaggattggaatcctagaggtcttgctgcagaatccacgttctagaactgttgagaaacccagagaggtgtgaatcgatgtgtccatctcaaaccccacggagccgacaagtcgtgaggctcccagggagtcccccactcactcagcagatatttaccgagtcctcctctgagcgaggcactgggaatgtcacagggaactcaacagggcttctgcagacggggaagcaccagagtgcctgccagtgagggtggtggctgcctggaggaagaggagcaagcggggagggacggcaggaggaggcgttgccgtgatggtcaggattgggtctgggaggcctcggagggacaggaagttgccccagctctcacccactgtcctctgactcccgctgtcctcccccgacccctgtccccccaccgccaacccgctgtcctccctcccctgctgcaggagcaccctgagcgtgtccctggagcaggcggccatcttggcacggagccacgggttgctgcccaagtgcatcatgcaggccacggacatcatgcggaagcaggtgaggccgcttggccacagggtcctccagcaccctgggctgagggcgtggcatgcttgcagccagggtgggatgaggggctggtagccaccagccccagacctgagccttctctgaatctggaggggagcaaggatcttagcttctgggtccttgggcttctgggccccacccccaccccccagtgtgcttcctcacgtgccctgaacctgcagaggcccctgcctgatggttccttcttccagggcccaagggtggagattctggccaaaaacctgcgagtcaaggaccagatgccccagggtgctccgcggtgagtggctgcctcgtccgccccttcctgtccactcccagctggcgacccaggcctggctttggcatcatgctcctggcctaacccctaatgctcagatggggcttcccctctcatttatggggaacctctttgaggagcaacagacacaactttgtcacctcccaaaggagctcctgctcccaccgggaagatgagcccccaggtgtgccgtgaggcggtgactctatgagatcctcccacctcactacactgtgccctcagccccatgccctctcagccctgagcccccgccccgtgccctccaccctgtgtcccatgccatgtgccccccaccccgtgccccctaccctgagtccctgacccctgagcggctcgctttaacctggggtggaattaagaattctgtgattttagctgatccaacctaagctaaccttttagccatttacagaaatgcgaactgaacagcagcctgggcccaggcctgcgatgcctgatttgcaggaatgctctctgttcctgccgtctttggcatggggagtgctgtttcctcctgtcctcccaccctgccctctcttcatgtggttttcagtcttcctcttggtgccacatgtaggccctttaggatcatgacgttgtttccgtctgatcctctctccatctccacagccctagtttgctgtcgtcatctgcccacaagttttaaataactcttgttttgaaataatgtgactcccaagaagttgtaaaaatagtccacagttccatggacccttcaggcagctccccgccagcggcaacgtcttacgtaaccacagagcgccggcaacacctgctgccagtggtgacgagagtcactgtgcgtgctgtggcgctgggggctccacacacaccttgtttgtgtctcacgagtggcacgtggttcctttcaataccttcacggcctttgccctgtgccacgcactgtccaattgcttcccctctgtggactcattaatccaaacagctgccctgtgagccaagtccggctgtcatccccacttggcaggtggggacgctaaggcacagagaggttaagtatcttgtccaatgtcacacagctagtaaatggcaaagctgggattctgaacccaggcagtctgggcgtggagtccgagcgctgaccacatcagaccacatgtgcagcattgcagtctgcttgccctggacaccacgcagcctcctgtctggtcccccggctccaaaaccatctctgcatatagagtttcccaggatagagcaagtgaaactgcgtaaggggcagagtgctgtggccatctggcccccactagtgtggaatgtgcaccccacccccacatggctgaacgcacacgtgcacctgtagacacgtcttcatttgtaaatgccagtctctgagtgggcagagactgcctgtgggtaggggcctggcagtcagcagaaggcatggacagcatagatatttttctctgcatcttttatatacctgtgagtttgggtttctgggcatgaattacatgttcaggtaaaaatggaaataatacaaataggtcctggcccgccccggcctctcctcattctctttgcctccatccccagcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaagaacgaggctgtgatctgcttcatctgcggtgggtggcttggggggtgggtgcggccgggggcactaggggatgagctcgcgctttaaaagcctcatggaggacagtgctgatctctgcatcggggccttgaaccagcgaccccgaagtcagtgatgttttcactctgtgcctcagtttcctccttgataatggggcgatgcagcttctctcgcggggtgattgctgaggacgacccgaggttgcacggattgcctgcaacccaggtatacaggaaaataacaggccttatttgatatttcagcttttttcccccctggattctgagctcccatttcactgtgaaggtaggaaaaagtgactgttttcccaggaattccacacctcctcctgggtggcttacttgtgctgaggggacagtgtggatccaaggggtgccatagaatcctcctcgctccaacctgcaaggcctgttggatccaggcgggagtggagttcaaaatacccacaacatggtcgtgccggacccccagtcagccagaacttacgctggccacaaacaggcctattgggcagacgtgaaatgcaccaatgagaatagagagtctgcgtgcacacctgggcctggtggctgcatcctaggctgtcagcaggttctccacctgcctgggcccaggtgatctttatgaagctgcctgggtttgtttgcctagtcagagaaacctcattccctgggctgcagacctgttctgctgtgccagccctgtgccccctcgtcctttttttttttttttgagacagggtcttttgctcttatcacccagggtagagtgcagtggcgcgatcatgactcacttaagcttcgacctcctgggctcaatttatcctcccacctcagcatcccaagtaactgcaactacaggcacgtgccaccacgcctggctaatttgttaaattttttgtggagaccaggtttcagtatgctgcctaccaagtagcctggactacaggcacacaccaccatgcctggctaatttttaaaaatttttatagagaccgggtttcggtatgttgcgtatggcctcttctttattccatcttttcccgatttccaatcctttggaaaatgctgaaatcgatgacagtttcctctgggtcatggccacccttgggactcccctgtaccatggtgctgcacccagccctgccatttcacactcgagccccttctctttcagtctcttttccttccaaactaacctgttgcagattacattctctgaaggcccagattggatccctcccagagagagatcctcgcgtctctcagttacaggtttcaaaggactcaatactctaacaggcaagagggaatcctggtggggtttcaggcacagtcatggattgattatttagaattatctgaggccagtgtttggatccagggaaaatcacttcgagggaagacctgttacctcaatctatatttgaggtcaacagggaggattggacgtcttccttcaggcagacacgtttctagaaagcatcgatttcagcctctcctccaccctgggggcccgcagaaggaacatacattctcctggggccgtaggcaggagcagcttgggtttccagccggctctctgtggccttgagcaagttgcatactttacaggctcagagctgtgcttgcagagttgggagggagagccgggcccacctccctctccgagatgtgtttctccaagtataaaactaagcacgaagggcctctcagagcaagcggacatttttgcaggagacaagaggtctcaaactgatggctccaggctgaaacttggaactaaatgtgggtttttttttttacttccttcctgatatggtgttttaaaaaaatgaattatatttatgaaccagcaaatttcatctctgaattctgatttttagtttgtctcgaaaatcagaagctctgagctgggtgtggtggtgcgcacctgtggtcccagctacttggaggcaaaggtgggaggattgcttgagaccaggagttcaaggctgtcgtgcgctttgatcacacctgtgaatagccaactgcactccagcctgggcaacgtagtgtggtcctgcctcttaaaaaaaagattaaagaaaaaatcagaagctctggtcacactggtccacattcccacctggctacatgtcagctggagctgaggagcggctgtcttcttgaggagggtgccagctctccagctccccggagccacgtggtccgagcactcatccggcctgctcacgctgacggccagatccttagctctggacttgccatggcgatgtcagctcggggaggacctggtgacccggagtcactgtgccgtccaatggagaatcaaggggcaggcgcagccccgcattgacgtctctcggagcctctccttctctgctcctccaggatgagggcagggcccaggtggttgaattcctctgagcctcagttttttcatctgtcaaaaggtgctgacccagagatggccccttggcgtggactgcaacagaggccacccaggaagtggaaggtacgatggggtgtgttgaccgctttatgattttatctaaataactgttggtgtacttcctgtccaccttccccccagcagtaagagcaggaaccacaccccttccatactgtagcccagggccagacagtggtgaatcacggctaaatattaatagaagaaagcagggttagcacagtgatcagagcggggggcgcaagccacacccatctgtggccaagcgggcccctctaacctctgtgtctgccacgtgggttcattcatggggggctggactaggacctttgaagtcagacaccctcgcctgctcctgaatctgtcaacacctgatacttgctgagtggccatatctgagattctctgtctttctgggaccctcagcttccttctttgagaaatggagactttacgcccacctggctgccttgcgggggtaccaggagtctcctccagggccccaaagtggaacttcccgggataagtgtagtgccctgtctgtccagcaggtggtgctggggaccgcgtagtgcccagaggctgctgttccccgggctccagcactcagaccgaaggctggctcctgggtgcaggtatttgggacagagccagcctggaggcggggcctggaatcgtctggacaatgggcactggcgctatccctctcctgggctgggcttgccgtgaatattttctctttttttctctctttttaaaaactttttaaaatttgtctctttcttactttcgtccccctcattttctttctctctctctaagcttttctatatttgtctttgtcccataacatatgtctgtgagcttgactcgatttttcaattctttcctttcggggatctttcccttctctcttttctcttttttcccttcctctcttctgattggaggagaaggatatgaaaggcccttatgcactgtaaagcggggtgcttacgaagcttgtgaccagaaacccacagtcactggtgcacctttgtggaagtgacggccactagatggcgctgtgggccagggcgccccgcctagccttgcgggcctcctgcccagagctcctgggaggctcccactgcaagcctggagctcggggtttgcaggcaggggaggccgaaagccaagcctgaagctgcctccctccgggcactggtagcgttccctggagggctggagtggggcaggggtggttaggagagggatgctaaggaaatgcctccgctgccagcgccttcaccagctgcacctcccattattgcagccaaagtttgctcacaaggacagtggctggatttgagcccaggccgtgtggctccagaccctgagcccggggctctgtctggggtgtggcccaggggcaggtccttgggtgcgtgagggtggcttggctcagctcctctccctgggtcactgcagcggccctgtgctgttctgttttcccatcccgaagtcctgagggtctcagcagaggggcccaggattcaagtccatccactcccagggcgggtccctagccagcctctgcccagcatgtggggtgggtgcttccctgtcctcctgcttcctgcaatgtttcccttccagcactttccaggctccagttccccatgctgggctgcccgagcacccccaccctgcagctggccctgctgccctggcttccacctccagatccttcttgccatgtccgctccaatcagagccaacccaccctgtgcccctcccagtggctctgctgcctgctggacacatgtcaccgccacggggctgatgggtaacgggagatgctctcaggtcctgatttgtgcttcgccagagccctcctagagctgtaggtgatgatgggcactttccagacactggcagggctgagatgagctgctccagggacaggaggttcagagatgaagagctggaggagggccagccctgcagggcacacagacttgcattgctggcttttggcccaaacagctctttgaaaaacagcacaggaatggccccggtgggtggtatctgttttcatggtgcgtggctgacactggaagacgatggacccgtggctgctgggtatcaggggaggggagggggcctgggtgtgggatgcagggctgccctccttccctcacatcccctgctgtcaggaagagggcagggggtcctggggcactgaggctggggagacatgagggctgtcacatctgtgtcctatccaagccagatccatgtcctgtttgcagagtcttggccataaagagggactgggaacactctgcctcaccctcaccctcgcaccctcctctgatccatctgggtctgtctggatggcagaggctcagaaggtctgaccctacccgatggtggaggctcagaatgtctgagccagaaaggacgtcgacgaaagtctagagccaggtgccctgactcacgcctgtcatcccagcactttgggaggctgaggctggaggattgcttgagcgcaggagtttgagaccagcctgggtaacatagtgagaccctgtctctattaaaaataaagaaaaaaaattagcttggggtggtggtgcaagcctgtggtcccaggctgaggtgggaggatcacccgagcctagggaggtcgaggctgcagtgagccatgatcaaaccactgctccgctccagcctgggtgatggagtgagagactgactccaaaaagaaaaggaaagactcgccttcctcctcctgattaacaggtgaggcagatccccgtgccccatagggactgcagggacactgatgcttggtgctgattgaacccctactgtgtgtcgcaggctgtgcacatcacctcactgaatcctcacgagagccctaggggggcaccatggttgtcgctgtcctcccactgtggagctgaaggagctgaagggggaaggcgctccccgaggggcacgcagtcaaggagcctctgagccgggatttgtcctgtcccaggtcctgggtccccacccgcagccccactcgctgctggcagaagcaggtcaccaaggaaagacccagggggcttccctcttggggcttccagtgtattaaaagtgaaggaatgccaagaaagggctatagaaaccacgggctggctgaaatgttgaaggaacaaacgaactctttatcgtggtgctgttcaggaaataagaactacattgactttgtaaaagtacgttcatcccaggtgcatctgggcgtgaggacgggaaggagggggctgtaaagatggggattagggctcgtgggtcagtgcctgagctttgtggccggactccctgggtccggattcctgggtttggattcctgggcaagtcacttgactcgtctgtgtctcggtttccccatctgcagcatgggctcccaaccgcatgttcccggtgtcggggttggaggggcaggcaaagcctttgatcagcgccaggctgtgggtgactgccccaagggggctactgggtcctcacagtcctcgtttctctgagactctagacgcagcctcatttgaaggtgactcccacatttaggaatccaggccttctgggaaagtgaggcccagggcccatgttagactcaggccctggggaccaattgcatccattcagtttgcagagaggtgtgttcgcctgcgtctccacctccgtgctccagggagatccgccatggaggctgctcccagagtaactggggatttcatatgaagagctaattaggcagaatcagtagggtttactcgaaagaggagaccattccagacaaagctgggagatgagaggatgaagcctgtggctgagtgtggggtggggaagggttctgccaattccacagaacctctgcccacgggcatcccctcccctccagctgccagaactgcgggattaaagtctatgctgggttctgaccctgaatgggtgctctgagggctggatgtggcagagggcgcagagcctacagctgctgggccactgctccctgcacacctgccctagccctcagtgtcaccaccgatgccccacagtggcttcagcctgatcccagaatgaggagccgccagatgggcctcggctcagattccagctctgccacttgctggctgtgtgttcttggacgtgaccactctgagcctcagttttctcacctgtcaaaggggagtaaatgaaagtacctccctcccagggttatcgtgggacttggagcaatcagctggttcaagtgcttagcaaatgcctccagcattgtaaatgcacagtgagtgccaactgttattattatttcctcccctcttacctggagagtaaacacacacacagtcatcatatagattatgcatcgtatggccgggtgtgatggctcacacctgtaatcccagcaccttgggaggctgaggcaggtggatcacttgaggtgaggcattcgagactagcctggccaatgtggtgaaaccccatctctactaaaaatataaaaattagccagcagtggtgtcacacacctgtaatcccagctacttgggtggctgaggcatgagaattgcttaaacccgggaggcggaggttgcaatgagctgagattgcactgctgcactccagcctggcaagactccgtctaaaaaaaaaacaaaacccacaaactgggcacagaatccaggacccaggatctgccctgagagcagaggtgttcacagagcctgggtggaggaatgctccttagtcctgttgcttttgagtgaactcttgagtgtctatcctgcacatccaggaagtggcatcggggcacagaacattccagggcacacagtccggtctggccctgggtcaccgggtcctctgcctgatctgacagtgccctcctgagtttccagtcctccatagagtaaggattcagggtttctctctggcctctttcgatcctgctgcccgctctgcatgctgtcactcttccctcatgccaggctccccgggcacaatgggccatactcacaggcccgtgctgcagtgggagcagggcctgtcccattgtgggccttcccagtcctgatgcctacacccacaagacagtcctgtgcagtgcagcttgtaccttgtatcctggaccccagcccatggacagcatgccctccaagttccatccatggctcacaccttgtccatgacctcctaatccaagctggtggactgagacagcctcctatggggcctcctcgatctgtgcttgcttccatgatccattcttccagccaccagagcgagcattataaagtgcaagagagatgatgccactctgtcatctacaatcttcaatgacttcccattgctcttgaaataaaatccaagatcctatgtgatctggtccctaccttcactgcacacctccctcccctgctcacttggcatcaagcacatgcccacctcagggcctttgcacttgctgggcctaaaatgctctccctccagatcttgtcatggctggcttcctcatcctctgggtcttagctcacatttctcctccaccaggggaccctcactgaccgccctgactaagggagtccctgtggagtcacatttgattccatcaggctgtacaagttcctccttggggtttatcgaatctgcgattatcttgcttatggttttgactgtgccatcccactagaaggccagctccatgagggcaggagccatggagagtaggaggctgtggctccaggacatagcccagtgtccagcacataggatgtgcctcctaaatattcattgagtgaatgagtaaatgaaagctcaccctggcacgatgaatgaactcagctcaaaactcacccgtctcatgtcttatttctttcaaagcctgccatatctgagaactaatgaagaatttatttgtgctaatgaatatgtattagttcttttaagatgagatatgcatattttagtaggaaatgccgagagtcacagttcttcaatccagggacgccaccccaagaatgagaatgtgaaatggtgatgagggtggggtagatatttagagcatggagtcccaaagaggcatcagatcacagaatagcaaaggcttcctgggtgcagtgggggagaggaggagcactgccctggggcaacacagggcctggcgctgggcaaatcacttcccctcctccctggtctcagtgctcctgtctgtacatggggatcataatccataactcacagggagtgaggttccaatgataagatggttagtctggcgctttgcacatttcaaaggttttgcttatcaagtagaagggattatggtaataagcaaaaagactctacctgtcacaggtgggatgcttttggcttcaagcagcagagaaatccacaataagtatcctattgttcttacatcatagggacaatatcttatgtctccatgaatcaagaaatccagtggacttcctagcacttctggtttggctggtacagaggtggggatcaccagggaccctgattcttttcaacttcccactgtgctctccacattggcctgaccctcaggcttgcactctgaagctcgtaggattgcgccacagctccaggcgtcccacccttgtgcaagaggtgaaagcaaaagaaagaacgcgtctcttcctagtgcctctttataagagactggaaccctttcccagaagcccccagcagattggattgcctgtaactttggccaaaattgcatcccaagcgcattgttaggcctggtgctggcagaggaagtggaattatcatggtttggccagtgctttttcaccagagaggtacagcctctgaggttgtatggaaatgtgggggtggcttggctcaatgactggtaatattgctggcattcagctgggtggggctgggaatgctggatgcctccaaggcgcaggacagtccacataagacagaccgtcctgtttcccacacgaatttcacttctcctctggtcgctcttgtgtgaagagccatttaatcatcttagcctagaaccgacatcaatttaatatcaaaacaagatatttttgtaagattttaccgtacaccgaatataatatttatattcaagtgtctttatttttctgcccttctgttgtagcgcaactcctgatcttctcttccatccaaacttcttctgtagaagttggctaggatctaactattggttatatctctgtgtgtgcctgtgtctgtgtctgttcatttgcctattgaaatatgatttaatttattacaagttattatttcattaaaaattattgtccttttatttctttttatagtccacttagggcattgtaatgagtttttaagtaggtgtatgatgttataggttaattatttatgactttcatttcagggcagtaaagagacattaagcacaattc

SEQ ID NO: 395 - DNA, 6496 bp, Homo sapiens
gcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacaggtgaggcctttaaagacacggagctgcagctgcgcagagacgcgatcttctgccaggccctggtggccgccgtgtgcaccttctccgagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagtgtgcttcctcacgtgccctgaacctgcagaggcccctgcctgatggttccttcttccagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaaga

SEQ ID NO: 396 - protein, 1647 aa, Homo sapiens
AAARESERQLRLRLCVLNEILGTERDYVGTLRFLQSAFLHRIRQNVADSVEKGLTEENVKVLFSNIEDILEVHKDFLAALEYCLHPEPQSQHELGNVFLKFKDKFCVYEEYCSNHEKALRLLVELNKIPTVRAFLLSCMLLGGRKTTDIPLEGYLLSPIQRICKYPLLLKELAKRTPGKHPDHPAVQSALQAMKTVCSNINETKRQMEKLEALEQLQSHIEGWEGSNLTDICTQLLLQGTLLKISAGNIQERAFFLFDNLLVYCKRKSRVTGSKKSTKRTKSINGSLYIFRGRINTEVMEVENVEDGTADYHSNGYTVTNGWKIHNTAKNKWFVCMAKTAEEKQKWLDAIIREREQRESLKLGMERDAYVMIAEKGEKLYHMMMNKKVNLIKDRRRKLSTVPKCFLGNEFVAWLLEIGEISKTEEGVNLGQALLENGIIHHVSDKHQFKNEQVMYRFRYDDGTYKARSELEDIMSKGVRLYCRLHSLYTPVIKDRDYHLKTYKSVLPGSKLVDWLLAQGDCQTREEAVALGVGLCNNGFMHHVLEKSEFRDESQYFRFHADEEMEGTSSKNKQLRNDFKLVENILAKRLLILPQEEDYGFDIEEKNKAVVVKSVQRGSLAEVAGLQVGRKIYSINEDLVFLRPFSEVESILNQSFCSRRPLRLLVATKAKEIIKIPDQPDTLCFQIRGAAPPYVYAVGRGSEAMAAGLCAGQCILKVNGSNVMNDGAPEVLEHFQAFRSRREEALGLYQWIYHTHEDAQEARASQEASTEDPSGEQAQEEDQADSAFPLLSLGPRLSLCEDSPMVTLTVDNVHLEHGVVYEYVSTAGVRCHVLEKIVEPRGCFGLTAKILEAFAANDSVFVENCRRLMALSSAIVTMPHFEFRNICDTKLESIGQRIACYQEFAAQLKSRVSPPFKQAPLEPHPLCGLDFCPTNCHINLMEVSYPKTTPSVGRSFSIRFGRKPSLIGLDPEQGHLNPMSYTQHCITTMAAPSWKCLPAAEGDPQGQGLHDGSFGPASGTLGQEDRGLSFLLKQEDREIQDAYLQLFTKLDVALKEMKQYVTQINRLLSTITEPTSGGSCDASLAEEASSLPLVSEESEMDRSDHGGIKKVCFKVAEEDQEDSGHDTMSYRDSYSECNSNRDSVLSYTSVRSNSSYLGSDEMGSGDELPCDMRIPSDKQDKLHGCLEHLFNQVDSINALLKGPVMSRAFEETKHFPMNHSLQEFKQKEECTIRGRSLIQISIQEDPWNLPNSIKTLVDNIQRYVEDGKNQLLLALLKCTGEAFKDTELQLRRDAIFCQALVAAVCTFSEQLLAALGYRYNNNGEYEESSRDASRKWLEQVAATGVLLHCQSLLSPATVKEERTMLEDIWVTLSELDNVTFSFKQLDENYVANTNVFYHIEGSRQALKVIFYLDSYHFSKLPSRLEGGASLRLHTALFTKVLENVEGLPSPGSQAAEDLQQDINAQSLEKVQQYYRKLRAFYLERSNLPTDASTTAVKIDQLIRPINALDELCRLMKSFVHPKPGAAGSVGAGLIPISSELCYRLGACQMVMCGTGMQRSTLSVSLEQAAILARSHGLLPKCIMQATDIMRKQCASSRALNLQRPLPDGSFFQGPRVEILAKNLRVKDQMPQGAPRLYRLCQPPVDGDL

SEQ ID NO: 397 - DNA, 118502 bp, Mus musculus
  misc_feature (1)...(118502): n = A,T,C or G
tgtgtcgggaggaatttcttttctggtccagtctatttggagttctgtaggcttcttgtatgttcatatgcatctcattctttagatttgggaagttttcttcaataattttgttgaagatgtttgctggacctttgagttgaaaatcttcattctcatccactcctattatccgtacgtttggtcttcttattgtgtcctggatttcctggatattttgagttaggatctttttgcattttccattttctttgattgttgtgccgatgttctctatggaatcttctgcacctgagattctctcttccatctcttgtattctgttgctgatgctcaaatctatggttccagatttctttcctagggtttctatctctagtgttgcctcgctttgagttttctttattgtgtctacttccctttttaggtctagtatggttttgttcatttccatcacctgtttgtatgttttttcctctttttctgtaaggacttctacctgtttgattgtgttttcctgtttttctttaaggacttgtaactctttagcagtgttctcctgtatttctttaagtgatttattaaagtccttcttgatgtcctctaccatcatcatgagatatgcttttaaatctaggtctaggttctcaggtgtgtttggggttccctggactgggcgaagtgggtgtgctgggttctggtgatggtgagtggtcttggttcctgttagtaagattcctccgtttacctttcgccatctggtaatctctggagttagtagttatagttgactctgtttagagattgttcttctggtgattctgttaccgtctatcagcagacctgggagacagattctctcctctgagtttcagtgctcagagcactctctgctggcaagctctcttacagggaaggtgcgcagatatcttgtatttggacctcctcctggccgaagaagaaggcccaaaacaggacctttctcagacactgtgttgctttggcagttcccaggtggtacagactctcacctaagcagactaaattcctaagttccttggagtcccgggaccaagatggcgaccgctgctgctgtggcttaggccgcctccccagctgggcgggcacctgtcctccggtccggaaggtggccggctgtccccggcccacacagggtgctgcctcagcgcctctgtgcttctgcctgttccagaagctgtcaggttctctggcgcaccctctcacctgttcagactaatttcctaagttcggcgggtcccggaccaagatggcgaccgctgctgctgtggcttaggccgcctcccctgccgggtgggcacctgtcctccggtccggaaggtggccggctgtccccggcccacacagggtgctgcctcagcccctctgtgcttctgcctgttccagaggctgtcaggttctctggcgcaccctctcacctgttcagactaatttcctaagttcggcgggtcccggaccaagatggcgacccataactgtgtctttaaaagaccattccatctttctgtttcaccagctgtttcaggatggtgagcaccatagaaatgccagtggattctacgatagtaggctcactgttgcacttctctggctgtgcagtgagttccttggtgacaagcaatactgtgtgcgataccatgacggtagttaagtcatcctgtaagtctacaatcatttgggcagaagcactgagtgcaggaaaggcaaatccataaccagaataagtgtcttctccagtgagaactaagtgttggactttctgtggaaaaaactggtccagtgtagtccacctgtcaccaggtcaccagaatctgcacaccaagaaccagcaatacacatgttctattcagatttacgagtatctatgtgttctctagtgtacttacctcacaacgtcagctactgtcaacaactaacaatttctgtctcctttaaaatgagatttaacagtgttcaatgttaaacccacaccagggtccagttgtccccagcaagttgattgctgcctttaccgagttagttacccttgtaaaaggtcactttgggggaaagatgggaaaggttaacagtaggaatggagaaaggtgaacaaaaaactcttaggtattttgtcaaggtccagttgacaaccaagaagagccgccacagttcatcaatccctaggtgtgaatttagcactcagcattgggttcagggagtctggggctcagagatgattcctgtttgccatcactccttccactgtgggtgctgagccacaggattgagttttgcttttccttaaaatggccaaattgttccgttatgttgtgggtgaagcacgcagagcagcaagtcctttctgagtgaatcacccgcacctttgacgtgcctttgtgttttggtgtgactgtgtttgtgtggccctgcccctgcctgttttagtgccatggctgcttctgttgaattccttgtcttcacttaattctatagggtactttgccagtagaggaatctttctttgccttttcatttgggtttgggcgttgatcaattcttgatggtacacagaattcctttagctccactttgaaacctcacaggcagtcaccgtcgtgactgtcattccaagattctcctgacagggaaacagcacttgtcacagaggaagccttattgcagcagaggaaaggaggaagaacagatgtgtctatattcacagggcctggggacacttggaggttacagctctgagaacactgttaaatctcatttcaaaggagacagaaattgttagttgttgacagtcgctgacgttgtgaggtaagtacactagagaacacatagatacttgtaaatccgaatagagcatgagtattgctggctcttggctgtatggggaacttccctaaatcttgaagcccagagcctcaccgctctgtcttttacttataagaagtgcatcctggttgttccattgtagttttccagaagccaaagggcagggttagaacgtttagggccttttacactgagggactttcctggatccattgacttagcctttctttctgtattggcaggtattatagtcagcatgctgactccatgatgcttcttcaacagcctgaggtctgctaaggtctaggggcctgtggctcttgagatatggcagaaacaagccagagggacatacggcacattacatcaagggtgaacatggaggacattgtagtgtatggcacacacaaatcgcaacaggatgctcttgtgtgttcacacaagtgagacagtagagaacagggcctacagggaactgttgtcggacaggtgtagtgtttcccctttgccaggggaagaaaagttgatgtgttgtgtaagagtgagagtgtgcttcacagggctgacctgcacactcacaggtggaatgcttcagcagataaagcccacgtgtgttctttaaagaggagaagaaaaggctttgcctcctatgttaatcaagtgcactggaatcctgacccccctcattagcctacgttaggcaggctctctgagcatgggtagtctgctctggaaaatggggtaggagatgaaaatctctagaatggaaagagaacccacagccacatgcatgatgaaccattgtccccaaagtcataataatcaaattgccattgcgcaaatgggtttctccctacttcatggtttcaccttgcctttgctatgtggcacggtgtgtactgagctcaaatggagctatgttaggagccatcagactctttccagagtcctttcttacatgtctgctgcattccaccttttctgtcactctgtgcctcaaaggtggttatgtcctctggggtattttcatgctcataaccatatgctttctgctactagtgtaagatggggagtagggaggaggacatctgagtgtgtgatttccctgttgttctccctgtctctgtggaagctcttctctagtgcttctcccatagtacctcttcccatctcccctaccctgccacccttcctgtctccctaagttccaagtcttaatcctgacctttctctttccttgcatccccattcctcttccttttaaactcccgattcctttattaaattaatttttagggctatgatcatccatacctttgtgggatttttttttaaagatttagtttgagtttatgtgttcttttttgtgtgtgtatgtgtctaagtgctctgagtgcatcccggatgccccacagatgcctggagagggtgagggttccctctgaacttgagataatgaatggatgtgagccaccatgcgggagctggaaacccaacccaggtcccctgcaagaacagcaagtgcccttaaacactgagtcatctctcctgcttttgtggctaagcctttattaaactgttcagatgactctaatttatctgtttctttctggagtcccattttgaaggtcagttacttaacaagaaagaagctccaggaaggccaagttgcagtatgagagcttcaagataatggctttcatgtgaaagtataagttctgaatgcactcagcccaggaactcatggcctccttaatacttgatttcccatcctatcttgtaacaacaatctctaacccaacatccccccccctttctaaaacacacacacacacacacacacacacacacacacacacacacacacacaggacaagattcattgggttgattcctccctcattagaagcatctgaatgacctttgttgatacatattaggggggacctgcatttctgagttctgaaatcatggcagattgtgactaatacccctctgagatttggggacggagtgagagcaagatgcccaggcagtcacaggcacaggtgatgcttggatgttgagtcagtgttgtccccattctctgcgagtcacctgcaaggcactcgaaagagtaggcacgaggcagtcctgggaaatagtctgtgggctaagacagacttcaaatacaatgtgacgtctgaggagtcattagagaacagtgtgcagggacttgaaggttgtcttacagagagtggaatttctgcttgacacagtgcatggagtttgattacaggaaacaaggctagacacagtcctccaatgtgtgaggtataggaaggaggctgactgggtgagtggtcttggtggtaccccacagagcagaatggaggggaggcagagggtgaaggtatccctctgtggtgatttcaacagaacatccagcattagattccatgcttctctgaacgtgtgtgcacctcattggcagctctctcctcagtcctctgtccactcttacatgaaccagaatcagctcccatttgccactcgttccaagaattagctatcctcttcctatgtctttattttttactgcattgctcaacctgtatgctttccactttcttttttttttttttaaagatttatttatttattatatgtaagtacattgtagctgtcttcagacactccaggcgagggagtcagatctcgttacggatggttgtgagccaccatgtggttgctgggatttgaactctggacctttggaagagcagtcgggtgttcttacccactgagccatctcaccagccccctgctttccactttctatgcactgcccaatcctctcttctttgggatgcttctgctgcctcagctgattctttgtgcaactccctgtctgttactgaactgtcaccattccacctggacacgaagacctggcctgccttggcgcgcttttgccctccttccccctttgcacagaacaaagggacccacctcctcacttttatctgtccatccttaggattctcactgtgtggacaagccatcctgcagtagtgtttttagggcctcctccccttgcttagaaatccacattcatttgactctagtccctctcccaaatgttttaagtattgggcttggatttcccagctttataagtaatcttgcatattccaaagctgttaactaaccctgttatgtggcatttagtgcatcatattacatttgtctctttgtctcgctctctaggttctctcctggtgcatagtatatctctgaactaagtagacttcaggtgactgtagttcaaaggattatgcatgtagttttcagcctgtatttaactgagatacactgcaggtgaatggcccatcacagtttccgtgaaaaaggtcaggaaaggaccaagtgagctgtgacttaagagagctcagcttttacgcttcgagccaatgtgtaaaacttctgtgtggccagaatttatttataaaaaattgttctaacttaaaaccgttttccaaaacttaaattttatactttaattaataacaatagttgtataattaaaaaataaaatcaaaagctactcactgcccctccgcgccagcaagttactttggctaccattttcttatttactgtagggagatcatgtgtgcatgaccacagtgagtgtaaaacataaataataagatagttgagtttagaggttgtctgttatagttgcaacacacacactcacacacacacacacacacactcatcgtattttacaggagcccttgaaaacatcagacgactcacaatcacccagtatacatataataaaatctgtagatgttggcctgcagagatgagatcgttcagtaaagtgattgccttgaaaatgtgagggccagagttcagatctccagatacgtgtgtaaatgctaggtaggtgtaggagcccatgttagttccagccacagcggcagagatgggatcccagagcagcctgggtaaacaagactagcaatatcagtgagttctgggtttgattgaaacaccttgcttcaacaaataagtcagggagggcaagagactattaatgatgatttcctgtacgaacttaccttaaacacatgagtgagtatgtatgcctgcccacacctgtaatcatactcacgcagaagcatacatgcatgcatgcatacatgcatactacttacaaacatttgaaggaaacagggggaaatctaatcgttttaaaggaaattttagtttacctcatttgttaacttctgtgtcaaagattacttctaaaatagtaatattcagtgaagcagctgacttgtgacttattgctgttttatttcttttaatgttttctttgagatctttaatcagacatactattatgatcataccttcctctagtttccccaggttctcaacatgtccctcccaactctatgacctttctttctctttaaattaattcatgaagtcaaattaatgttgcccataagtgcatgggtatgggacatcccctggagtgctcagcctaccagaggccacaaccccaggaatgaggctcccttccccagcttctataaactgctgctggcttctccattaggaaggaggccatgtgagctcctccctcgttcatcttgaactctggcttcctttgtatagtaactgcagctgctgccagctcatgagtgcagtagccgtgtcatgtccaggggactgtatttcacagcaccttctcctgggccagcttcttcatttcatagtaccttctcctgagccagcttctcccaggctttctgcctcctcttcccagagtcatggagacttgggggtggtgtttcataaacaaggcctatttttgggctgaatactcagtctcctatgtcaatactgtgctgcccaattcaaaaagaaggctttctgattgaggctgagagctgcctgggcctatttagagggaagtctgaagcatggccatttagaaaaatcacagcaggttctaccctaagatgtgtgatggtcctctcacgaatcctccctttagacaaggatcatgatgccctacctggcataaagacaaggattatgatgccctacctggcataaagtttccccctgttcacagaagaagccagagagcagatgactattctgtgacagtcacaccccttctgcacaagtgacatatcttcctggcctgttggtactgcatcctgcaaggttcattgctgggtaagaccactgatgtcttttatctcccagcagcctaatgagagctagccagtagggaggaagtgtcttcatagggtttcaattgatttctttatgtcctttgaccaacatgggtggtgtcttcagcagctgggttttatactttgtggttacagtgggtgcaaagagcaatagtgcagcctgtgttgttttggatagctctggggagatgtcctatgtctggcactgcagtttttgtttaattatgttttctggattgaattactacttaaaaagcaagcaagcaagcaagcaagcaagcaagcaagcaagcatattttgaaaatgtcctaccttctagtagatttccataaagctttttcatacacccttagtctcggttaacccatcttctcttcaccccacctcttttatactacaccattgatccccactatgtcaccctcctcagtcacaggttacctgttctattcgttcctccaattacattttaattgggttgtacaataggtttccatatacccttcctctgggtcacccaagggctcagtgatttttattgaagagtcaaaataattaatttatcacactttcattatgccattgatcctgaaattttccaactttggatttaattgtggaaaatgcctgaatgagtcttccctttctctcttttcctcccccaccagtctagtttctgttgaagtatttcttgacactatcagacctccactgtcagccaggtgcctagtgatctgtcgagatggagttaaagcaagacctgcacacccatgtactgcacttgcctctcgcacatgctcgcacattaaacaagagcggtgatgtatgcaggtccccatctgatgtgaccgacagttcttgtctctggaccttgtgccttgtacttgctggggagaaagtccatagtgtctgcttgtgaacgcacctgactgtgcctctagtacactaccaagtactgttgacagtacaaaaactgagtaaaactgcattcgatgtccaggttctgaaacttgcaggtggcaggcagtagatgttcatggaagtaggctttacagtagagaaactggggctctggtgagagatgctacctctgttttttttctacttacagtaatagagttgtctttttacgtgctctgtgagggccaagccaggagggattaattttcttgttcctgctacgtccccaaggaaggagaatcagcgagtttcagatggatgaaccttgaaaataaaatgagatcattctggcatctcggaaaagtggggtgcgttgccatagacagtgtgttagctttcactggacggtgctatgtgaggaggtggactgctgacagcaggtcatctatgtttgtcaagtcaacttagagacaattgttaaaattacaaaaattaaaataaaatataattacattatttccccttccctttcctcctctaacctctctcctgtccccctgctcttcagctgctgtgtcttggagccagttctcgatagtaccagctgtagatcgccaggcaagggcagtacttaggtagcattctggtgctgtgtaacactgtacgagaacagggcaggggaggtgatgatgaggatggtgatgatgaagatgatgaggatgaggatgacgaggatttgtggttgtccattttaccttcattagctgagggctgccttgaaagccatactttgtgcatttttcatttatgaagatttccttggtaaaatagatctgtcattacttgaaaaaaaaaaaaccaccatgctaatttaacagtcttcattcgagttcctcccacagcagagctagcctggctccacacctgcagttctgagtcacatgcttcatggatgatatcttcttgtctccacagaaatagaaaagtttcaaaagggagaaggcaaggaggaagagaagtacattgacgtggtgataaacaagaacatgaagctgggacagaaggtgctgattcccgtgaagcagtttcccaaggtgaggcgggagctgtgcgctgctgctaccgagcccacgagcagagcgcaccctggcattactggccctggccttcacacacttgaagctaattaaaacgtttggtgaatgaagtgatttgaatcgtttgcttgtctccagaataaattgcggagtcataagaaatatatttatatcacactagccatgcatagcctgcctttctctaagatttcctcatttaaaaggagtggttcagaactgaaatcatttatgtgagatgcgtagaaccacattgcgcgtatgcttgtggatgcttgagaaacccccgttgccatgaactttatttccggtgtctgtctgtggtttagacagacaatgctgtctttataccattgttcatttgtttgtgttgcagtcttcattacccagtgtcccagagttagtttagatggttttcggttggatggtatacatgacattgtatgagtgttttattacaaggcgttttgtgacaggtcgtctcatttgtctggccaactgccaattactgaaattaagctatgttcactttttcaaagaattcctgttgtttttcttccttccccaccacccccaaagtggttgcacatggtaatgtgttcataggtaaagtgtttggattgggcctgcctgtgccacatatcttctatagtgtgtcctgctgtcaaggttttgttattattacacattgtgttgtattgatcttttcttgtgttgttagcttacattttcctgatgagtaacagcattgtatgtttgtgtctgctgttataaaggtcacaacttttttgacccatctatctcttggctgcatgcatattgatggctgactgggaggaactatttacatggtctaggtacaagtcctttctccagcttgcatttggaaatgtttagctcagtctgtggcttagtgtattttggtagaatcttactttgaggagtctctaattttttaagtattttgttttatgttatatcatccttcaataaacttaaatcttgatcattctcagaaaaaatattaaaatcattactaaattgtaaatacattctccttttcttatgagaacttcttcaattatcattttagcttttacattaacggtggtggtgaatctcaaatgggttttgtaaattgtaagttagaggttaaatgtgtcctccagcaatccctctgtaggaaactcaaccctcaactttcctgtcaatcacatttggaggtgggacctttggaaggcgctagaattagacagttcatgaaggaggatgtcacattgatgacaggtgctgcttataaaaggaaaatgactcagggggtacagtgtttgttgtttaggtataaggcctcttgttcaggtctccagcccccatgtaaaggctgccatagcggcactttgtaactttatcaggttgggtggatgcaggaagccagctagtccagccaaaataatgagctatggatttcctaagagattctgtctcaaaaactaagtggaaagcaactgaggaagagaacagacattaatcactccccaaacacctgtggacatttgacttacacacatactgaaataaaataaaaagaaaacgaggcgggagagtgacctaaactagtgtgcttgctctctgtgtgggatgttggcagccatgttgaacagaagattgaattccctcaaaatggtaaggtggccattctccagtggaaagccacactaccaagaatatttccggagtacaaattggttttgaagagttttaaattagcaggggcgaaggcagacacaaagatggttgggtaggtttggaatgtggattaattaaaacaaaacaaaacaaaacaaaacaaaacaaaactcccaaaactgcaaattctggtactctgctcttggatggctcagcctacagaatgcttagccaataaacgtccactcattataggttacctctgttgaaggatgatgctgcagccacagaagatggagtgaggcaagagtcaactttagctggaatgaaatggctgaggaagtgaggtttattttctttgttctgttccattgatgcatttatggatcttatgccaggaccagtcttgtttgctgaagctttttatggagagccatgaatttaaaattgctccagttttgaccttcttttttcaggattactttcatatattctggatcttttgcagttccatataaatttacgaattctttcatggatctctacacagtgacctgctgtgctctggctgcacttgggttgtgtctgttggtggctctgggtactgtgccagcttcccagctcttactcgccgtttctgagtgtggggtggctgtccgttcctgtagagatgctcagattcttctcaatagcattcattaccttcctggtgcatgtcatctgtgcctgtctgaatattcatggttattcactaccagaaattggattattgtctgagtttgtaacacaccatttgttctctttattgtccattttttctttcttttgctatattactaattttacaaaattgtttgatagatctgttaggatctttagtttcataatcacactgactatgaggatctttgcttcttatttatatttctgatgaaatactcaacacaagcggtgaggtgggaaccctttacttctcaaagagaaacactgtgattcttttatctctcatcattgctttacatttgttggtgaagtttataagaacaactttatatgagcttttaatttcacattcttgcttctgttgcacacacctgtctctgatgtttgtgtatagtcaggatagaacgcagatattcctgtgaactctccctgccatacctgttacctacttttgtcacaggtaacgtactgcatttttataatgtgggaaggctacttaataagcagattaagccagtcttaaaataatattagccctttaaaatgtaaggtagtctatatgacttgctcttagacttgtgagtggtcaaaactttcagtctaattgctatgattccacaaatacaaactagttttaaaattaaaaaaaaaaaaaaaggatgctcactcttgggaagcacttgggcagagatgcctgctgtacctatgccaaccaagatgcctgctgcagccagtgccagacctttacattgtacctgacactttagtcttagtcctgagggtggctggcatttcttaaaacaccagcattttatctgattgaaggttgttagaaaaatcagttcattttgatggggattgtatgaactgtgcagattgctttcataagatgggcgttttcactatgctaatccgaccaagccatgagcaggtgtgattgttccatcctctgacatcttcgatttccttcttcaaagactttgaaggttttgtatgcaagtctttcacgtgcttggttagggttatctcaagatagttaatatcatttgtggctattttgaagggtgttgtttccctgatttctttctcagcctatttgttatttgtatataagagaactactgacttttttcttttgaggtaatcatatacccagccactttgctgaaggtttttatcagctgtaggaggtccctggtagaactattgatgtcacttatatatatgataatatcatctgcaaatagtgataatttggcttttcgtttccaatttttattcccttcagttatcttattgctctagctaaaacttcaagtactctattgaataggtagggagagagcggacagcccttttcttgctcttgattttagtggaattgctttgattttctctctatttaatttgatgttggctatcagtttgctgtgaattgcctttattatgtttgggtatgcccattatattcctgatctctccaagacttttactatgaaggatgttgtattttgtcaaaggcttttccagcatcgaatgagatgatcatgtgcttttgtttttgtttttgtttcctttcagttcatttatatggtgaattacatagctgtatttttatatgttggaccaccatgagtctctggggtgaagaagcccacttgatcatggtggatgatgtttttaaatgtgttcttggatttcatttgcttgtattttattgagtatttttgcatcaatgttcatgatggaaattggtctgtaattctttctttgatgaatatttgtgtggtatgtcagtcaggatgtctgtagcctcataaaataaatttggaaatgttctttctgtttctgttttggggaataatttgaggcatattaatattaggtcttatttaaaagtctggtagaattctgccctcaaattgtctgtaactgggctgtttgtttgggaaacttaattactgcttctatttccatacgtgttatagggttatagatctatttaaattttgtgtgtgtgtgtgtgtgtgtgtgtgtgtgtgtgtgtgtgtaagatggggcctcttaatcaatgtgtgtgtgtggaattcagaggacaacctcaggtatgggtgctggcctttgactttggtctgagagaggttggctcttttgagaggtcacagctcatactctagcacacaggctggaggggactttctgtctctgcttcccatgtctgtggattgctgatggaggctgctgttcccagcttttcttggtttctggggggtatgccaggtctctagccctcccggtgttactttccattatgccattgagtacaattaaaaccgaattgggaactcttgatctttcacttctgaagtcatgttcaaatcattatattaggctgggctatcttattgtggtgcagagttgtattgtctgtcatgttgagtaattttggattgtgtcctggacactataaatgtgtattctggcagccctcagttctgttagagttcctgaaggacaccgatagctaattaactggattatattcagactgtaaactggtagagttgagttcttttctaaagctttgctttacatctaatgccagggaatatggtttaggggcagtctaagactttggcaggtcttctgttctaaccctttctgggctcgctcctttgtattttagtaccatggttgcttcacgtcttgcttctcaggtgtaaaagctctaaactctgtacatttattcccggctggctgtttcaggttttgactgtatttcagaatctgcctgttgtctgtcactatccagggcccacaatagttgacttgatattttgttcagacttgggcattttatggttgatccctgtaggtgtcacattgtgatcatgtttgctcaaaaacagataggtagatacatttttatataaaaagaaagtgagttatggccactgcatgggcaaattactgaacagaaatggcacaggtaaacctcttgcatggatcctttgtgcccattacaaagtagatggaaagatgagcaaacatagctactcacttactattccagagttaaatatcctgcaatatgataactagtctgaaattgatactttgttgtatataagttcttatgtgacgtaatacatatatccagaatctcgggacctcaaatattccttttcagtatcagctgtgataagatggggagacatgtaatttctgtaacaggtccactcacacaacatttgtttacagtatctggggcaggctgtatatctccatcagcatcacctagccaccagcatcaaactttctatagtgtgtgtgtgtgtgtgtgtgtatgtgtgctgtagaagccctcatgccagtgccagctgtcaaccagaggacagtagaggactcacccatgggagtagctgtggggacagtacagtctctcgctgagttggtgctgcctgtgggctttgacctgcttcagtaagagcaggattcagtaaggtccaggattctagttaataaggagccatcagttcatcattttctccggctgactggtctgaggtttgatatgggaggctcttttctgagccacattgttacggtaaaacgacagtgattaggattttgttattggcctcaagctcacttgagtggagaatccaggtgactgtttaatgctcagaacacacctggcttttgaaggatgggagggtcattttgacacgtttaaggaatgctgctttgagcatgttatctcttgctgaggtcagctggtcaggattacaagtcagaaaggtggacatttggtggttccttccaacatgagggcatgctatgtaggtcagaagtatttgggaaatcacaagccatttcatttggttaggaagattaattcaacaagatacgcaggttttaatagcagatgtgaaggaattggttaatgggttcacttaggctaatgaaactgcacatttctagactagagtgacttttgagctgtcttagaggatgtgggttctgtgtcaggaagcatggcagatgcagtctcaggtcaaagggaatgctggagaccatgccaaaaaatggagttataatgttgagttactgagttatgtcttcatgtgtggttctctggctacacagttggctgtgcatggcagggtattctgctggggcctgagctggcagagtgctcagcttgtatagattatgttttccttatgcagatgcgtgcacctagggaaattttggcttggagatcaggcacagtcagtaataaacaacaataactaacaaaattgagggattataataatatgcagtacaaaagctacttagaactcctgaatggtttatttctagaatgtttttaatgactaattttgatttgggccagctgtggattaatgaaacctccaaaatgagacaaaaaagaagggaaattctttttcatccctccactttagaatattaaataaacttttattaggggcagttagcataaaaagataaatagcaattggaaacatttattttttactcttgtctcatatattacatcccgactgtagttttccctctgtccttcggtcccagcaacccgcccccacgcccagccactcctctgtttcctttcagaaaagtgcaggctcccagggacatcaactgaatcctgtttaaacatctattggtataactgttttaaacatctattggtattctaaccgtcattgctgtttgtgatgtcaaaaattcttattaaaagtctatagtcttgtgtgttggcagtgcaaggtggttgctatttccacagcgtgcatggggtaaggatgtttgcgatcaggaagccataaaccgcgtctgctcggtgtttgagctaagcttcctatgccggggcctagcaaacacagaagtggatgctcacagtcagctaatggatggatcacagggctcccaatggaggagctagagaaagaacccaaggagctaaagggatcctgcaaccctataggtggatcaacattatgaactaacnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattggaaatgtaaatgagctaaatacctaataaaaaatggaaaaaaaaaagaatacaaatatgaaaaaaaaaaaaaaacagtgactggctttcttccctcccttctcccttggagaacgttacaggccgttccaaccccagcttctctgtggttcacgccctggaagttgctggtttagcttttccagctggtgagtgtatgacatgtcagtactttaaaacttgccttttctgtagcccctggtggattttcagagacagctctctccccagaggatcatttgtttaagatttcaaactaatagctcacctgtagaaataagagggcagtgcttgcagataatcgtgtctgcttctttaagtgggagttcatttactttgggggaacagtgcagttgctatgactttaagtttctggacctgatgatgagccccaggcctgagcaggcactgcatggtcctccacccgcagccatacagtgtgattcttgaaaatgcatgggaatgcactgttaggatcacatccaaccaactcaccatcactttaaacatccatcatttcctacatcctcccttctaattattttggtccatccattggtaattatatcaccttgctctacagttgattgcatagcctaattcctcctggttagccagtgctaaccgggaactttaaccagtgctagcctctcccctttcttgccttttccccactcgtctcttttagcttccacacagataatgctgtgatttgtatctctgtaactggcttattttattaggtgtaaatctcctcacgctccccaatgctgtcacagtgatgtgaattttctttaatgcttcactgtatgtatttcagatttgtaaaatccttaatggatgggcacgtgagtcatttctataccgtggcagtcatggctgaggcagtgaatgtggaaccccaggcttctcattaagatgctgattccagccttgtctgtgttagaatttgtagggctgggatgaaatactcagcgcccagggctgtagggatgaggatctgagacactgctgcagagctttccatccatcctgatgggcacagcagagcagagcaaaacagagcagctcaccctgtggggccaagaaacagagacacacatggagatggagaggcagaggcaatacacctgtaccacaagctgctctttgtccaatgtagtttctactgtgaactaaacttggaaattcaccaaacaagtaattactccataactgcacaacacaaggcacacaaagtgtttgcgctgagaagtttctttgcagatggaaagaaatttgtgttaggaactagtgggacttggccgcgtgtgcacctccagtgtttattagctcttagcatgtctgcttttctctaaatgtcctgccagaccccttgttggctgctccctgtgggtgtaccaggataggcttgattgctgtaactgagctccataggcaattctggactgtttggatcttttcctgtggttttgcttttcttcatttcagtgaacagaaagtcctacagtctaaagtgtctgtgcccaatggcatcctttttgcctacttgatacgagttcattaacccctatcctactctcttctcaagtaccaggcatttgcttcctaccttgactccccttcctctctctgtattttcttgtcagaatttgtttgagaaggctgctgtccctcagctatgctgttctaagagtctctttatccgtatcaatttcttgcctttgattttaaatcctgcaattaatgctcttcatctttaatgagatgggtatcatctctgattttctggattaaaaatttctagctatcttccatcttttgctggcaaatctcatgttgattaagtagtgatgaaaataaataagataatagtctctaaagtgcatatcacatgcacattgctgtccacatctttgctccctgctcatataatcaggaaaagttactagtaagctccactgacattattattatttttattattattattattttaagatttgctaatgtctcagtatattggactctcccattcacaggtgcagggctgcagtctactccaacaatagttatatttactaggaaaattaagacatttaaataataagttattggcagcttacataggttactatagtctctatagcaaagaaagttgacataaactgttaaacaatatcattaagttggagacgaaaataagctttgattttgtaattatttactgagaagccattatgcaggaaagatagaaaacccaagtgggttatattttagtctaagagaatttataattttatcagttggaaagcattcatttaaccaaataatataggctaaagggtgaactaatgtaagagaggtggtgggtcagcatttgaagaagtgatgggagtttatttggagcgagagttcaggaacagtggacgtgtggaaagagtttgtttccccactggaggctatctctgcatctagtttgttctgggtgagtcctaccctttgttaccactgatgtttcaacccgtgtttgaagagcagtgacattttaaatgtatagaggtgaatgtgtatgttcataggccttcatctgtgggaagccaagggcctgggtattcatgaagtagtgatacgcaggtgtttgtggtggctacccccacacagtgtgcccagtgggcctgcttctgcctgctctatagtctctcagtttcttgggtcttaaattcatttgcaatgtgtactttaaactgtgctcaaatatttaaaaattacctgaatcatcttgttcttgactataattcagcctcacctttagagaatatatttacactgtctgatactgtaccttaattgttttatattgttctgcaatatatattcacttaaagaattttaaatacacattaagattttataagatctccttttgtgtgtggtttagaaatatcctagctgcttcttcttcttttttttttttttaattgaatgttttctttatttacattaaatttcaagtgttatcccctttcccggtttccctccctcccagaaacaccctatcatatcctccctccccctgcttctatgagggtgttcctctacccacccacacccacttccccaccctcgattccccctcactggggcatctatccagccagcattgattgtgagcaaagggaaattggcctcacagaagtgaatctgcttacaccctgaacctggctgttgagtcaggctttgccagtgtctcttgcctcccactttcaatgtggtttgtcttttctgagacccatgtggaaaatggatttttcttttcctggcagtgtttcgaggtagggccctacagatggtgatgagatctttagcaaagagtgaattctggctgaattctgggctgggttagttaccaggggagtaggttttttggatagctggattcttcagcaggctcctgtctgctttccttctgtgttcctgcaatgttggtttgcagtaatggccccttttcaagtgcagctgcctgatctcaaacatccagcatccagaacctctatcctttgaaaaccacccagactcataccgtttgttatagcaacagcaaatgacccagatggccctttccctcatttgtaacttttgactagagagcaaataaataaaatggctattgttggacactgttaaatttgtagtggtttggatgtagcaaaattgatccagataattgtaaaatagagcccttctagtttatttagtaaagtcattaaggttaggcggaaactgattcctgtccaagtttgtacgtttctcgttaacatctatgtctcggaaaaggtttgaatatctataatagaacagagcctcatagtgtatgtaagtgtgtttggatcaaattatttagttccatttaaaatatactgagactacagagatggctcagtgataggagtgtttgttgttcttcctgagacttgagttctggtcccagtacacatgtgtggtggtcacaactacccattctaatcctcaaggaccaaagggcatcagagctagcaagtgctagtataggcatctgctgtggggaaatataccagaaacttttaagtgctagttagtgtgtaagcttcaggagaccaagtgcttctgctcctgctcaactctgtggccactggtgaccctcacctctttattctagtgcccatttctaatgctaactttatatagttatatatggtgatgttgcagaatggcagagggattgttgaagaagagacagggctcgaggttacaaaaggcaccagaagagctgatacagatgcttgggcacgtgtttgtaggggaacagatacgcattgctggagatgcacacagaacgggcaaggcaaggtggaggtgtgtttggatggtgtgtcaaagggtacatggctactgctttgttctagcacaggccgatcatactctgtgcctttaagtctttttagttaagtttttaagttatgtgtgtgtgtgtgtgtttgtgtgtgtgtgtgtgtgtgtgtgtgtgtgtgtgtgtgtgtgtggtgttagtgcatgcaattgtgaaggtcaaaagaaagcttttggaactctttccttctactgtgtatacctagagaattgagcacaggttttgaaagatgtggctttctaagcataaacaacataaggcaggcattcaggttctccttttatatggtcgtccatccatccttggtctggtgtgttcaggtctggatgttatgatatggtcagtgactgctgactatacattgtaatctataggtggcaatgcttcccttgtgtgaccactgtagccatcagtctggactgtggtttgtttgagaaaaagatggttgtttgttgccacaagcaatatgtagttagttattctctcagcacatggctcaaaatggagccattcaaggcaagacacagcctggagaccattgtttgacacaccatggaacagcttacagcaagcaggactcttaactttggaggcacacttatggttttaagtttttgtttgttttgtgctttcaatgatcaaacccaaggccctttacattttatgtgactgctgtccctctgaacatcaaccccaatgacagaaatttgcggttttgaattttttttttaatttcctatccaaaagagtgtgtctatttcttggcttttctgatgtagttgttgctttcccaacataaacaataagagataggtaagtgctcaggttcctggtcctaagattattacattattgctttagggttggtttgtttttagcagaatatagagggttaggaagcagactgggcatggagatttcaggagttgaataaaatatgttctgtagtaccaagagtccacagaaacgtctttaaacagtttggctggcatagcaagaagtgtaagagtcagtggctttaggatgtcaagaatgtgttgaagaaaagcagatggggccctgtagacagcccaggagctccaaggagggcctaggctattgcacatggcattgggtttacacaacattcattctttccatgcatttgccattcttaaaacatcaaattcatatcagtgtggaaagattctggacggtgaccaaaatccaatgggaaatcatttctggactcctggtgatgggcagaggcctggctggctgtgtctgtcctttgttctccccagcagtcactggctctgttcacttgcttctccttctatatcgtccccctggtgattctggttggagaatctccttcatgtctgagggcttgcctctgcccgtgccttctcactgagacatgagactcacaacacagcccatgcctaactgtgccagaagccatcagtgcttgctctctgtctctgactcgtaataaacatcggaaggcaagcctcacttgtcatctggtagacctcagtactggcagtgggctcttctgttcccactcagtatccgttcttccgggaggtgaatgatgtgggtgtatctcaggagtgactgactgctttgcacttgtccccagctcatcaggaagttgtagattaagtattctccctttgcttccctatgggctctggggatagaatgataaaatgtcaatctctttaattcagtgtctgaattagactctcatgctctctcagatgcatttgtgccatggctctgtgtgtgtgccagggatgctgtggggttagagttttcctgggatagagtataaatttggagcaagtacagctgtgttttcattttcacagcagaaataactttctctctagctctctccagccaagctgcttaggctgtgctgtgctgtgctgtggtggctctagctttgctggttctatgaggaagctcttccacagccaatgctgtacactaggacataggatctaagacccagtgataccactgtactctgatccgagacctgctgttgtcaacgttctctttcaaaaagagccctctctgtccatggaaggaaggagggaagagagcggcctcaaatggttatgtatgctttgatatagctggcaaaaggttagttactgtagctctaaagaaatatggacagacttaagcatattccaggtgaacttactagaatttaattaatcagctccttaaacagtgtgctctctgcacagacattgtatataaagcagtgcacatagctctgaccagtaccctgggaaaagtcagtctgtaggcttgagctgctgagctgcagagaggtggtgccccttgcttgtcttggagctctgaagaagaacactttcgaaactgtgatggtaaaactgtcagagtcagttctgggtgctgagttagagtcagtaatattcatgtgttgggttagtgaacttttggtaagtacccaattaagggaaaccttttgacagaaaccctacatgttcttgaggttcggatataacagtcccaggggaaatttttcacatcacatgtgtagaaaggcagttggccttcatcagtgaagatcatgactgctgcagctcatgtccactctctgtagggaaacaattactgtctccatttgccagcctagtgattgtgggactttgcctgttttcagtatgtttgtgtgtgtgtgtgtgtgtgtgtgtgtgtgtgtgtgtgtgtgtataattcgttggcatctggagaaaaaatcattgcttctagaaatagatttttaatgcagatgagcaaatgaatttattccgcacatgttgacttaatggagaaaggaatgctgagatgcttgagtttgtactatctgtcttgcagacatagttgccatactaaaaattgaaccctgaatatagtaaggagagactgtatttttaaaagccattgcaggagcccagaaagagtctactgcagtagacatgagtggatgatgaagatttggaacatagacaatgcaattctatttagctgtccagggaaatataacgatgaaatttgcagatgaatgggtagaatttaaaacatacttcagtgagttgggtgacccagactcaggaaggactcatgctacgtgttctttcttatttctagatcttactccaaatatttagacttgagatgtaacctggagtaactgaagaacccagcaaaatagaaaaggacaatgatgaggagccgtaaggatagagaatagtgagacatgggtcctgtgaatggggaaagggatgctggaggggggggctcaattgtgggtcagagaaggaaggaagaaagggtaatacagagggagacgtaggaaggagacagaaataatgccaagggtagttgggaagtgtgtggggcaaggaggacttcttaaggaaacactttatagccttaaagtacagacatgtacacatgcacatgtacatatatacgtacatgcataaatgtatatattagtgtcacttaaatggagttacaccatacagggtgatggggttctcctaggagttatagactgtctaataaaaacccaagagcccagcaaggaaagcctccattctagttgttggtcaggggaatccaagagactccaatgataatagagattgttgccattactcttgactatctcccttaacttgtacatatagactctactgtacacacctgggacagaggacttggaaggttggggttagaactgacccggaagcctcttctctgaggactggttctcacagtctcagatgactacactagctgccgagtaagatacacaaccaacaatcccacccagctgtaaagcctgagaaccaaggcaatagcagtcttgaaaggcacctccaatgactcagtagtgacctatcttcaggttcatcatacctagttagacttaaggtccgtcagtaggaagtaacttatgcttgttatagtaaacctggtcgattgttacccatggctggtaaggtcatggaccctggaagcatatctactacagccactttcccaaacaaaccagtatactttctaactgcattctaagaacttgtccatatgcccacaaataagtggctctcacccctcatcaagcaatctttttttttttcagtacatggctgctgcaatagagatctacaactggtaaaaatgaagagaataaacaactgtggggagccttgtgtcagttgactcatctacaatgtagtctccactcttaatgcttagggaacaaaaaggaaagggaggtggtaagactgtgagaaggccaggactccatctgcaagataggagttaatagacatgcagggaagctgcatacatgaaatagtaacaaaatggttacaagacctgagcagcgataacaccagttcccatgccgtccttgatggggaaaatctcacaaggttccactcatggatgaagaactaactctaggcggctggagaggaagactgagtcttctcctgtggtgaacccctggtagattatttaatccctagtacaaagctacacatgggtccatatcaacagcgttaaatgaatttagcagattgtgtctgtgtggnnnnnnnnnnnnnnnnnnnnnnnnnnnnnnnnnnnnnnnnnnnnnnnatggatagacggacagacagctgtaagaacaatagagttcatgaatttgaaaggagtggatgaaagagatggttaaaaatgttaaaaagagaaaactttgttcctagtgaagcatttgatggaagaatagaaagaatcagcaccatatatggaatggggttgcaccatgcaaaaagtcaagtcaggaaaacataagagaaactcggtgatccagctcaggagagccactgttcaaacaatagaaacatctaagatgatgcagagaatgggtagcaaggacaggcagaaacgagtgggttgggttgctgatgccttactgaactaattcttccatgtggaagtgaaaactgcttgaattttgattgaaggccaataaaattaataattcatatgaagaatcccgttttgatttttcaagtgttaggagatatcaggagagtcacttgaattgccatagttagaacaactgctaagaccatacctcccttaaaacagcaacagccatggatggtgtagaccactaaggcagcagaggctgtcctgagtgtggactgagaaaccttttcaaagagaaatgatgacctgctcgtttctggttagcagacagaaatattaattacaggaaagcgttagagacatattcaacatttctcattataatttctttgtacagggtgtttcttgcatgtgtgtgatatgctaagtatttattgtaagtaagaatgactttatctctctgaaccacccagtcctcacaatgaccctacgagcctggctgctatcctcctgtctgctgtgcaggagagcgaaccaagcacttggaggatgggatgcttgcccagtgtaaaccagggcagcctgatctcagaggctgtgcgcccagcaactcacctcctccctgcttactaaatcagaagaaaccacagataactcgttacatgtgtgccctgcattcttacctgtagttagtttgaaagagttattttgttgtgatttattttcgatcctggactcagaattcacttgggtcagaattcacatcagtccattcattgggtcagtaactaaatctgaatgctgacaaagcaggagaatccatgtgtcccgttccaggatccctgtatcattttcctcacctgtatgctaatcttagtcttgcttagccattataggaaattcgtaattactgaaatggctagtaaaaaaaaaaaagatacctttttaaattttacatttttggcaccactttatgtggtctggaaaatatcaccctgtgatttatgtagcaggaacctaaatacttgttatccatgagtggtattgggcagtgtttccccatattcaaggctggtaaactactgttaagatttgaatgttacaaatatggccggtttgtttttcctagttcaactttgtggggaagcttttgggtccgcgtggcaattccctgaagcgcttacaagaagaaacgttgacaaaaatgtccatccttggcaaaggttccatgagagacaaggcaaaggtaatatggccatggacagcggtgaccttgtcggccatgcgctgctgtgtctgtctgttattgtctgtttgttgtctgctgtgctaatgcctgggatctcagagctgagtaaaagctcaaacggnnnnnnnnnnnnnnnnnnnnnnnnnnnnnnnnnnnnnnnnnnnnnnaacagatactatcttagctatttaagattcatgtagcaaatcaaacagtagtgcttacattgtttattctgaatgaagcccgttcgttaccttttgtagtgaacagaaagaaaagttacctagagttccccactttaatataataatttaaattagttcctttggggcgtttttcctgtatagatcttttacctacctccaaatgctatgaggacctatggtccacagcagaccacatatggctgtggtctacgatttcaaggcccattgctatggctgtgtttgtgagacacttcacagtactcaaggagaatgtggctcaataatgcatttctcacaactccttccggccatccggtggtccgtgcttggtcttggcatacagtgtgggtacattgacctctttttttcggccctggatttctaatgctcattttatcacattaaaagatgactttaaatgttttaataattgcttcatattctaaaaaaattactctacatagaggtatcggtgttgagtgccctgttgttttgagaagttaaaaattattttaaaaaatattgagttacttttttgattagttacttccacttctgagaggagttttcatggaacagtgcttcctgccttgttcttggttgtcacatctcttattgttagagatttccaatacggagaaccaactccgcattctcgaatcattcattctgaaacattagacagtgacttttagatgtaaagttacttaaatgaagcaagtattgcctcttaagcaaagttggtctgcctctactcggtggcattcataggaaatatgatagatagatagatgatagatagatagatagatagatagatagatagatagatagatagataacattttccctgttgtacatgtcggaaacttgggtcgttatctggtttatccagcagaatcagctatgttattagttattagttagcattgggtgaacccctgtgtctgtgccagcagcaataatgaaagtaaaaaacaaggtatgtaccagactcacacaaagctgtaagatttaggttccaggcccccaaaaacttttgggtagaaattcagagtgtttccagtgtcactgtggaactaacccagcagacaagttagcttcacatgtcaccaggtgtgcctcctcagtgtgacacttctgtgttggcattatccgggaatgaaactgtatattagtcagttagaaatgatgtgtgtcttgtaggaaaatactcaacatttgctgatgcactaattcattgtctcataaagctgcttggctgtcaggtaaatggcagggatgcttgttagcaagagaggttcttgagcagaaggcccgttaatgctgaatagtatagagaaggaaagaagtgaggcccccaggtctcacccaatcatgtatgcatatacaaacacagtctcataaaatgtggctggctgtctgcacagtaaatgggatcctgaatatcaccagcttgccatcaaagtttagtgatccttctaaattatgctgtctagtaaggccaatgctgctccctgctgttggcatgtttgacacccaacatggacagtaaccagccatcctcgagaaggagtctgtattgtaaaataatgaattaacccccatcactcttgctccagtgactctgtggatagcctgagcagcactgagctgctcggagaaggaagtacatagacatctgccacagtagttcctcataaatgcctgtcactccgtgtacagcatttgctgtaagggtaccctgttttcaaccttgggcctctcttccaaagtgcttaccacccattcagaaatttctttctctaaccacatgggtccatcaccaagtatgtgtgatgattcagcatttagctgatgatcattctgtcaagccacagggtaactagaggaagagaatgttgtacaatttccatgccagctaaccactgccaatggaccagaatcagaagtctgtgccccttgatttcctaccaagagagagggagggagagatgagagagacagagacaggcagagacagagagggacagagacagagaaggggaggaagggactgaaggagggagggagggagggtgggactggtacctattatttcttcccgagcacacttccaatgatctgaaggtcttgtctctgcctccaggcccacctctcccagtcacctttctaggaacatggacgtgtgagggacactcaggatcccaatcacagcaagctctgtgctatattccttttcaaaactccttctttactcctccttttcctcctcctcttccttgctgctcctgtcatgtgattcatcagttaaaccttcaaaaacatccctaaaagcaaccaccagtgatagcttaagtgtagcaggtatctctctaggtgtggagcatcagtgtcccatttgctggcctctagccagctcttccctgatgagatacttggatattgattgtagttaatcctttactagtttaactttagcctgtataaattctcagttaatcgtgttggtttctagagagagaccttacttcatgtaaaaactcacaatagaaaaaaaaaatcacctgaaattctaagtgtttatgactctagcaaatttaatatgaactcatgttcatttatttgctaacttgacgaagcatgttgatagctgctagtggctgcttttcttgtagctgccatgatgtcttgtctgttgggccttcagttgatgtcaggccttctgttctaccttttgcccacatcacttatgctatagatgtgtcctactgtaggtagcacccttgacactgaggagtgtgacttcagcagccccatgagatgacaccacactaggtctgtcccatgttaaaatccttcctgataaggtaaaagcgcttgcccacagtcaagcaatcaaggtgggatttgacatttgagtacaaaatccccagtctgtatccctccccaaacagcacatttccctttgttatgaagccatggaacagcttgttagaactcagactgatttgcacagcaactagtcataagccatccgtcatgatgtagctgaagtctgggcccaaaatgaaaagtataaaccagtacttcacacaccatcagacaagacgggcattcagggtctgctctctggcagtcgcctgctaataagggaaaaccgacaagaatgaggcaaacttgaaacattttgggatgttttggattgtggtgaatgcttagtgtcagcctgcctgaaacagcaagcatcactagtgcagaaatgagctgtgcccagagccaagtggaacagcagaggtttgtgtgtagctggggcaggtaatgggccgggcgggaggtgacaggaatctgcaggtagccaagggcagatgattccttataggcagcatcagggcagaggagaccgtcccagcaagataggatgcctgtccagggttcctgagaacctggggaaaacaggatcaaagttgtagtttaaagccatccccgaggtgctatttgttatggagtcttccatgatgagcacgtgtcaaataagttttgtgtaatgtttgcttggtttttcctgtctcagaatgacaccttttcactgtgattatcttcttcaggaggaagagctgaggaaaagtggagaagcgaagtactttcacctcaatgacgacctgcacgtgctcattgaagtgttcgcacccccagcagaagcatatgcccggatggggcacgccttggaagagatcaagaaattcctgatccctgtgagtaccactcctgacccctgaccagtgacttgtgtgttagggtggagtctacgcaggtccctgacgatctggttcctgcttctgcagctctctctgccaagagcttcctgtgtggcctgcaccacagacctcacagtattctctatgagaattccttggcataatttcctacttccttttaaagcaatgggattttggacagattatatactaccaccaagggtataaggctgaaaagttggaagagcagaatcaccaatttagtttttgggactctgctataagtttttatgtgattctgaaaatgtcacataaatcccatgctcttccttaagtcatgaatgtcctctgtatgcctggcctgtgcgtgggttgggacatggaggcctaaataaaacattttctgtcccctggaggaatgtatagtttaggggggggaaataaaaacctcattggatggctaaggataatatgtagacacacctgtgatgttaagtatgccaggaaagtaatgatttaaaaggaatgtttctaccttctttccaaaagttaatttaagtatttatatgctagtgataaaacgagccttttttctttttcatactcatgataaactcattgctttccttactctcctatttaaaaaaattcatagtaagttagttcaggctccccccaaaccccctctgcctttctgctgcaaattatattctcttcccagtctagctgtgccaggcaccctggtcggtttgcctgtctcagagtcctcttagttcctttgcatttccattttcactttagtatcagcttcctacttctgtaatgttcagcaaggattttgccagatgttttgttgaatctgtagataagcttggagttaatttgtaactggtatcttctattcttgaataccaagtacttctcattctcaaaaacaatattctttaacaactcaagaacattttgtgagatgggcagtggtggcacatacctttaatcccagcactcaggaggcagaggttggagcatctgtgagctcaaaaccagcctggtctggagagtgagttccagcatagccaagtctacacagagaagccctatctcaaaaaaaaaaaaaaaaaaaaaaaaaaaaaaaaagaaagaaagaaaaagaaaaaaaagaaagttttctccgggtataacctggcaccacttattatgtaaagaatagttccaaatatttttttaatttatttttattttatgtgtatgagtattttgcctgcatgtgtgtctgtgtaccataaatgtgcagtgcctacagacaccagaagagagtgttggaccctctggaactgcagtttgtgagctcctgtgtggatgctgggaatcagaccctggtcctctgcaagaacagcagatactcttaaattgccgagttgtttccaaatatttgatattgtctgaaattgttaccaatggaacacttatttagaggttcaactggttttctttatattgattttgctctttgacttgtggcatatttctactatttctagagcatagtttttaaaaaaaatagaggcattaggaagattagataaaaccctagataattaggaatttttgacatcagcatcatgctgttgctaaacatgggattcaggagcctgagacactttccttggtgtcctgccttctttcccaccccatccagtcctctgtgttttcctactaggatgatcttgtagggctccctcctttattctactaataatagcttaaccacatgtgttggtttttggtatggaaagccaagtttgcatttactctgtctttatatgctgttctcttgacgtgttgcatggtacggtgtactgttagtttgtgaacatttacacattggtgaccctgagactggcttataggcagtgtttttacacttgtgtctccggtgttgctttctgggtgatagagctgccttaccgtaccttttctttcaagattgaagaactaactttagtctttcttgaaatgtagaccggcttctatcttgatttttctgggagtgagtttagttgacctacatggagaagaataggcttatgaaagttggctgacaatttgtacccattatcctttgagtgtgtctctgcatgactcataatgagcatgggggtcattttggttctgtgcacagcactgttcttttgctcttttgctgtgtcttgtgtttggttttgagcagtttgtccatcacgtgcctgtcatgactgaaatgagtacactgccgttccgtgtgggatgttttcagttgttatttctttgagttattctttctcttccttcccttcacccattcagtcgcacccttaagtgcatcttggctcctgtcctgctgctgtgggtttgttttccttcctcctttctctgtttgtcaggcaggggtgtttaaagggcctgatcaggttccctggtcctgcccccaccatctcagttctgctgggcagcttctccagccaacctgcatagcagtgacttcactttccacctatcttttgcaagtgtaacatctgggtcctcttccacatagttacctttgcctgcttggcctctacaagggtggttcacattttctttgtatgtctctttattcatggtctttgaaaatgctggcatttgaataaggtgccaaagcaggtattaattctgagcactttgcttccaaggaagctgctgttgctgctattttgtcttctatttctcttataattatgttcaactgaacccacggactctgtgcccttcaaacttcctagtgggcaacatgtgtatttaggtcttcctattgtgctttataggtttttctgtccttctagaagacaacatagcttagttgtcactctcagttgtccagaggccatgtgtgctcagggcctgtttaatgtgatttctctgttggcatgcattatcgaattcagagaggcccatgttaattggcgtgccgatcctgctggtataacctggagtcacctctgcaaagatgcactgtcaggcagataagcaggagagcctatcagggtcttgcctgctcctctctgggctctatcatggtgtcctctgttgagctgtatgttgcttgccctggacatggtagcatcaggtgtgctggtttgctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggtgttcccctgtactggggcagataaagtttgcaagacctagaggcctcgcttcccaatgatagccggactaggccattcttctgctacatatgcagctagagacccgagctccgggagtactagttagttcatattgttgttccaccttgttctttttaaggacactttcctcactcagtcaaaaaagccatctctacttcttagtgtatggttcttaaaatgtatggaatttgtgtgatttttttcctgtgagcatatgtccagtttcatgatactattttatttccacattgtttgtgtattccagagtttatttagctgctcttcaaataatgagtgttaatattatttcctatatatatatataatgtctacaaggatgccagaaaaaaccttgaacataaaggttgtgatattttggcaaataattgtgaatactaagttattgtcagtgaagacattgaattccaatgttactttgcattgttgtgattgttcttttaacattttttgactgtgtgggtatggtgtgtgagtgtgtgctgtgtgagtgccatagacaacttgcaagaatgagttctgtctttccactgtatgggtaccagggattgaactcaggtcagccatccagatggcagacacttttgtccttagaggcaggtcaccagtctagactttggagttaacttttaatgagtcacttcaaaacctttcccactttctccaggctcacataacagactaaactcactgggtagcaaagtgcacacataattgtgtgtacatgagtacacacaacacacatgcacgtgcatgcacgaccacaattcttttttttttttgaaagatttcatttatttcatgtatgtgaatacaccgtcattatactcagacacaccagaagagggcattcgatcccattgctgtggttgtgagccaccatgtggttgctgggaactgaactcaggacctctggaagagcagtcagttctcttaaccactgagccatctctccagccccccatgactacaattctaatttcctttctactctggactattggcaaagagtatatgtttcagtatttttatttttcacatagagagagttttaagtgagtctgtaagctctcatgcatggctccagtgtaattatggttgattcgtacctgcccatctgacattacaagagtaaaccacctaaaacattctaaaattgccttacacatgcctatacatttagtcatttaatatctgtgtattttaaaatattttcaccaagctgatatttaaagtgggctccactgtaacagggaacctaacttagaacaggtgattttaacttcagttttctaaacttttcctggagtctaaatagtgcttcagccatgatcttttgatcgaatctatttttagcatctataactgagtatcacacctcctaacaattttctacagggaagtactagcattttttctagcacattttatttagaatgtgctttgcaaattatttattaatcttcacacatttgtagcaaaatggctgataagatcttagcagccttattttagacagttggagtgacagacccatgcggatgacagctctgaggcaccgagcctcagagaagtctgggggagggtctgtgtgcaccagtcccacccacgctccgagttcacctgctaaggaccgaggttttcatcctccgtcctgttcctttcctacagatggtatattacagcattcttctccacggtgcccacgggattcctctaattccatggtgcctacttatttgtttccttgatatttggggaagtcaggaagaaaagacaaattcttagttgtaaatatagtgtttctttgagattttttaattcgggatataaatacttcacctgaattccctgtttatgctgaaatgtgctcatgattttccagtttgtggtcccctgatgaccgtgagcctgtgacaacgccagcagtgagtgcctctttgcagccaaatatcacaaaaagctcctgccttcgctgctctcactgagaccgattccatgtcttccttctccatccatctgctatggtcaggggtggtttcctgctagctggtccccagacttctcactgggctgtgtgatagattgtagcacaacacagaccttgtgtggccacactcacctcacaccctggaaccttcacattctcctgccctgttttcagtctgaagttttgttttgtgctttccagaacataaacctaactgcatagtttgatccctaaaaattgttacagtgtctcaagcgaccttagttctaattatatttaaactacctttaaggtagcataaggctttgcatgatttggtttctgctttctcattaagactgcttattgtcatttgtccatataataccttttttgattatttgcttatttttgattgattgatttattcatttattcactcagttttgtgatactcttcttgtgttccaggcctggaattcactatagcctaggctggccttgaactcaggatagcccatctgccttagctaggatctctggtctctggaatttaatactctgagtcttttttccctccctgtgtgtgaagctttgggccacccctctgatgactcgatctccagtcctcagatggccccgcccctcttagagagaagctccattggctgttgtgcagctaagttactctttcctctttgattgttaatgtttcttttttattacaaagtagtgatggtaaagttttatctgtttattctgtgtttttgttaattatcaaatggagttgaggatcattacaaagaaagagaaaggaagcaagatagagtcctagtttcagagtttaacatgtaggaaaaattttaaaaaagtacagatttttcaggaatctgattacttaccagatttataaatctagacaatccttgcttgtacaacattatggttagtgatcattgtcaacttggcacaagttagacttaactaaaatatgagcctctgaacatatctgtgctacgattattttaataatcttaattatcttggctgaggtgggaagacccatccactgtgggtgacactactccttagacaggggaacctggcgtttgtgtaaggaagtgagttatgagtgcgtgcatgtatactctgttcattgctctctacccgatatggacatgctatgaccagctccctcaggcttttctgtcagacaatatgtaaatgtttgggagtgatgagtgaatggagctgtagatagcaatgcctatgccatagctgtgtggccttgtatcattacagataccacaagtggaaattatgcatataaaaggagagacattagcttacctgtaattttagtatgggggaaacccatggttttctttaaaaataataatagaaaacaaaaacacattttcatttttatttgattatgttttctgttttaactgctttcctgacctcattttcttttaaaaaaaatacttgctttatattctaagtgcttttgtatttttcaattatcttttctgtacaggactataatgatgaaatcaggcaagcacaactccaggagttaacatatttgaatggaggttcagaaaatgcagatgtcccagtggttcgagggaaatctactttgcgtacgagaggtgtaactacaccagcaataaccaggtaggtgttattacttcttgcttgccattgcagcagtgtgaaagttgctgccattaatagggagacatatttgtcagtgtatcttataaacctgcattcagacattgtgatgtcatagtgatggagttaacttagatgtgagaaaaattgaacctaaacttttatacatcctgtactacttcccagctaatagtagtttggcagactgttattctccccagcacacattctataattgcctgaaatgaagcttggcgttaagtcagtaagcaccttaggtctcatgagatgaagatactgtgtgtgcttgctgactgtgaggataccctgtgtgtgtactgactgtgaggataccctgtgtgtgtactggctgtgaggataccctgtgtgtgtactgactgtgaggataccctgtgtgtgtactgactgtgaggataccctgtgtgtgtactgactgtgaggataccctgtatgtgtactgactgtgaggataccctgtgtgtgtactgactgtgaggataccctgtgtgtgtactgactgtgaggataccctgtgtgtgtactgactgtgaggataccctgtgtgtgtactgactgtgaggataccctgtgtgtgtacttactgtgaggataccctgtgtgtgtactgactgtgaggataccctgtgtgtgtactgactgtgaggataccctgtgtgtgtactgactgtgaggataccctgtgtgtgtactgactgtgaggataccctgtgtgtgtactgactgtgaggataccctgtgtgtgtactgactgtgaggataccctgtgtgtgtacttactgtgaggataccctgtgtgtgtacttactgtgaggataccctgtgtgtgtactgactgtgaggataccctgtgtatgtactgactgtgaggataccctgtgtgtgtacttactgtgaggataccctgtgtgtgtactgactgtgaggataccctgtgtgtgtactgactgtgaggataccctgtgtgtgtactgactgtgaggctaccctgtgtgtgtacctactgtgaggctactctgtgtgtgtacctactatgaggctaccctgtgtgtgtactgactgtgaggataccctgtgtgtgtacttactgctccatattggacagtttcaccccagtgctgagcagtgttaggcaggaagactctatgaatgcctctccctttatgcgcactgtcagacctgtggctactgaaaactactgagctgacacgtggacacagagtttttatttctgtctctgaattgttggttaacttataataggaaaaaattgctccaaaaaaaaaaaagccaaaaaaaactgagttggctatttaaaatcagtagagacaagaataatttttgttgatgaagttgttttagggttttcgaggggcagtgtttccccttttgtcccctagttctcggactagagcctgtgccaccactttagctagtaacttaaacttttctgttgagctgggaactgtatagaaatgtctctttcagatacatcagatacatttcagatccagtatttgttggaatttaaaatagtatttatattatatttccaagctcatttgaagaatgaaagttacttctggagtgtgctaattcaaagctatttgtgcgactgcgtggtaggccaggcctgagggcctgagcactgggttccttcagaaaagaagagctagtaagcagggctgcggatgagttgtgagccactgctatgctcagcaagtgggagtgttcctgtccaccttttggtttgcttgaaataagtacttacttgctgtagttttctggggtcaccatgactgattgccacaaatctggtgtctttcaggtagaagttttgtttttgtttttcctcatggcaacagaagcttaatgcccaaattccgtgttattaagccaaggttgaggttttgacaaggagtcaatttttcccttgtctcttctgttcctggggatggccccatcactcacagtcctccatatttacagtctcttcctcttgtcattcctctctgcctcccttttgtaaggggtgtgtgactggatggaagattgtggtcattccatcagtccttctcccataattaacacgccctgtctggttcctgggaatcaggcaacagaaaaggggttggcctgacattactcagcctactgatgttgctagttttatcttcacatgatgagagctaatccatttgcattatgtcacgtgcaaaacagtatattcattaggtatttatgaaagtcttctaccttgttctgtccatgcctgggcacttcctgctgcctgatgaggtaaccatagcaacagtgatattaaacaatgtttactgcctttcctgctgcctgttgccctgtggggagtaatgtgttttctgcaacattgttacatgtgcagatgcacacttgccttggtggactggaaacagcatatacagacagataagaaacagcctcccagggcacacattgctgtgctgtgagacaaatagatgtgagatgcagtcctgtaacatgtgagattggttttattagaatattatacagctaaaacaaatttctatagtctaagtgatgcagtaaccatggtaacagtgatataaacaaggcgttagactgcctgtcctgtaaaagcagagcatgcaatgtacactaagtgtgcaggaggttctgttgtctagtttataaaagtgtaccccaactacatctaacagagtcctgcaactatccatcatttagttatgcatgaccacatgtggagacagaagtaggtatcaccatcttggaatatgtctataaatgttcttttttttgagtgacacaaagtaaatttgctgcacaaatgcatatatcctggcttttattatatgcattcaagtatgtaataaattttattgtgttatctaatagctcttgcataccacattatcaaatagtaacttagaatgagtctccattctggaaaatatcacaatggaagatactcaataccagtgcgtgaaagtcagtgtcccttaaatcattggcaatttctaatttggttctctttccattaaggtggtgatgttaccaagagtaaggaagagaaccactttctttattctataatgtaacagaaaaacctcttcctcttctcatgtgagccatggttatgacgtgtgtactaccttttatctaaagctggccccagttaatggttggggctcaaatttatcttgagttttctttatggcaaggagctaaagggatctgcaaccctataggtggaacaacattatgaactaaccagtaccccggaactcttgactctagctgcatatgtatcaaaagatggcctactaggcgatcactggaaagagaggcccactggacaggcaaacattatatgccccagtacaggggaacgccaggaccaaaaaaaaaatgggaatgggtgggtagggaagtgggggggggggtatgggggacttttgggatagcagtggaaatgtaaatgaggaaaatacctaataaaaatattaaaagtttttaaaaaagatgaagaaagcctaggtacttggttacacaatatctaaatgtgagagaagtcatgatacaaagctaagaaaggtacacatagctccttgtgcctggcactatctagttcttgaataatatcaagaaggcctataatctcagaagccagactggtctacatagtaggttctgtgccagctggggctatatagtgagaccatgtttcaaaatgtaaacaaagagttggtttgttgttgttgttgtttattgttcttgtggtacagtaatattttcatggtattacaagctcttcaggtcatttcctcaggagctgcttcttattaccatgccttagttcctcaaacggaatgtatctcacctacagtgtccttgtttattccctattatgtggtaagttcacacaagccctgtgtcccatgtggtaatcgtgagcacttaaaactcttctcttgtttacatatttctcacctcatttccctagtaagtttgtagggtaagtgccttctggggcgactttggagtcgcaaagtcgaacacattggttcctggaaacttctagtgtcccctcaccattactaattcaggatacctttcagaatgcatctgaagttaaatcatacagaaggaagtaataacattttagtaaaatgtttccattttcattgcaaaaaaagaactaaatctattctttaacacaggtgatgtctttacccataatctgcctgtgcacttccttatcccaaatgggactcaggaaacatcagaagagacttgggaaacaccaagaatggaggggtgtgtgtattctaggcagcactccttactctacatttgcaggttgctgtggaaggctgacctagaagtgtcaaacccctcatggatgcctgcttctgtttccttaaaccctgttctgtgttggccttaggtggaactgtagcatccattgtgaatccctgctttgctctgtgtgtgaggcaactttaagatctctgaatgtcttggtctctttgtctgtagatgaacaagatagggcccactcatgggttactcacatttgctgccattctggaacagcctcattggtgtggtctcccagaaatcagagtgtcccactgtaacaacaaagaagctaagctctgcctgggatattcccatttctgtggcttactttgtgcttgtccttactgtattttacagaagtataagacagtgaactgtctgagatgtcaatgtgtgtgaagaataccatgctagaaaatctgacagatactgataatttgaccctcttgctcacaggggaagaggaggagtcacagccaggcctgttgcagttggggtaccacgtgggacaccgactccccgaggagtcctttccacccgagggccagtgagccggggaagaggccttctcactcccagagcaaggaggtgtccccccaaccggatacagacctcccccgccacccccaacacaggagacctatggagagtatgtaagtaaaggcaatagtgttggagaccgagttgatctagtccagataatgtgtcaccgttgcttctcttgttcacctcctcagcttagcaaatagttgacattaaagccacttagcaaaggaattcaaaagtataggatcagattcaaggctgcttggaactaagtcagaatttcagctgtaaggaatgcaacatggggagatatgctattaagcagatagctattaagctcgtccatgagtagactagaacactgtttctttcatattccatttcaggttgcatttgaggaagtcagtcagttgaaaagtgattgcctaaaagtcctgagatggagttaccttttcatgtatcatctccatctgctcagtaagcttcgtaaggaagttcgcctcagtcaagaaaattaaaattccatattttttttgcagtgattagttttctttaccaattcagagtctcaggtatggcttgtagttaaggtaagagaaagaaatagaactgaaaaagtagtacagaagtgaagggactcattaagaatgtcaatgcataggattcttggtattgcttccttgttatcacaggtagaaaaaatgagaagtcaatagatggtcgtactgaagggacttcaaaggaaagttgtcaagggcaatagtggcaggaatcagatactggaagtaagatctcttactctactgtgctatgaagtactttgcacagtttctaagaggttgcagttatcccagagtctctagaatcctgcttaatatcatctgtggctgctttgacttccacattctgaacttaacagaagtccatgagaattgtctttttagggttttggcctagactgcccttcccatatcatctgcttgcttttgctgcttttgtgtaggtcagctattgcaggagaacctcatgggggcagctgccaaactcttgggcattacagctattgtcacagtcattctctcacataaactgaacatgcggatgggtgggcagggatgggccatcctcagctcctttgacttagcagcgagcccttcatttatactcaacatgctgttgttttgaatcagattctttgttttgctgttcagcctctttgctctttttttcatcacctaacattgctggttttcctgttttcttatattcttgtgaaactgacagggatggccatgccttgagttcttccacaaatgttgacccttccaaaaggaataggggcaacaaatacaaagaatgctgttgacgttcttgtggctatgtgccatagccacagtattcccccctggtttagcttgacaggtcttggaccaacatggatagatgatgttctagaaattgccaggcagggattgtggagaatcagatcgtggaatctctttcaccatctatttgaaatgagttaggcaatggaggttaccactgacttgattaaggacagtttgtgtccctttctgttttcaagacttaactggtttatggcaccttaagttggcgagagaaaatgaagcactatgaagaagaaaggatgggggataaggatttaaaaaaacaataacctgaagaaaattagagacctttttgctgttttaaggatatcagactttccctatgtctgaggagagttcttctgcagttcagaaatgtaaattcaaaggtgtccttgaggcctggttagcttatttgcatagcacacatgcagccttggatttgattcctgacacgatagtgaataagaatttttaaaagtccttaatagatattcagtagcaaaaaaaaactttatttccataactcttgtttgattatatttaactggcccagtttaatttttaaaaattgatttagcacttattgtctcggtggctatttctaaagtagatatgaagatggggtgtcatgcagtggtttatttacacctagcctggaggaggaatcctggtgtgtgtgtgtgtgtgtgtgtgtgtgtgtgtgtgtgtgtacgtgtgcgtgtgtgtatgtgtgtgtttgtgtgtgtgtgtgtgtgtgtgtgtacgtgtgtgtgtgtatttgaaatcctgccatacttggcgccttgttgagaaagcctgtctggatgcttgagatagtgcatggtcttaataataagtattctaaaatagaacggcattctcacacaggcccaagaaaggcacagttaatggccatgttgtcattaattttgctatgtagagaactcatctcaagaatgtggaaagaggacgcgcagggaagtcctgatgcaagtggatgggtttctccctggatgagtgatggagaactgcatcatctgaaatgcctctgggcccagtgttttcatcaatagtcacaatcacaaaggatgctctgactcagtcacccagaagagtggtgctgtctgatagtgtgtgtgcgtgtggggagattaccatcccagagagcacaggcggcacgtgcaggggctgcaagtagagctgcctcgccatggtcagcacaaagcatccccttgaataggctaacaaatattccaggaaaccaaagatcaccattgctattttcaaaaaaatgctgaaaatagatactggatgtgttttcagtctttgagtgtgcgccagggccttcttgcacttgctttaaggtacagaaattagccataactactgtaaccccacgtttctttttctgaagaacaagaagttactttttccctatgacaccaacctatttcttatacccaactgattacataactgaaactttaattagtgtaacctgtagtgttttcactgtgagcactttaacagttcaaagtgtgaccacacaggaagacaacacctggcagagcctaacattgctgcagtctgggggcatgctgctttttggtcacagtaaaagaaaacacacacatgggcaggcatgcatccctgttgtacgtggcggctgcctttctgtccctgaaggatcttatcagttatatgcaactgacaaactgaaaaagggaaaagctctctctcggtgctgcttttatagcggattttattctccttgcacaaccttaggcactcatcagtcagtgccgggagggggatgcctggtctgggtcgagttcctgctgttgtcagacttcacatttgctctgtatatgtgggtttcctggcacaccaaactctgtggacagtatccagtgtcttacagtttacctcgatagggcacaagctctcttaagttatcagcgatcctacaagttaccccacaacgctctcccttccaggcgtaagtaagcaatggacctctggctccctacagtttctacctgacatggccacacatggcaaaagccacagtcaactcttcaggtgttcacgttgtcagggcaacactgccttgctgacctattaccagtgtattatttattatgactgatgtgttagtctgagaataagtaacaactccgctttaaaggaaataatcctttatcgggaaccaaatacttttgagtgtgcaaggatagccacaggcatggattcaagtcaccatgcacgacatgtctggcagtaacacaggttatgcaaaagctttgtaggcagattttacacatgctgtcactctctcctactgagaggagagaaagcggtttagagttctacaggggtcctcaggatgaaggtgagtgtctgtcctgtcctcagactgactgtcggaccgtcagctgccttttgttcacagcatgtcagcttgcaggcctcttttgtgctgtgcactcctcaaccacatagagacctgagcattgcctgcctttccacagctcttggcttcttttaatgccttttctagtcttaactgtcccctgctcaaagctgaagcctttgtcctcattaggcattgctagtgtcaaaggccaaagagaaaaaagatgattgaattggaagatctgaatagccgttgttgttttcaattgtagaattgaacaatactttatgccataaaacagagtgaatgtgcagtgagccaaggaggggagattaaggtggtagagacacacataaaaagagctgaagaaaacagccagaaaggaaaaggcagatgggtcatttcagaacgctttccttgtgagggaagggccaagacagaacagtggaaaagcttaccccagggaggagcagggccaacggaacccatgacctctaacacggccatttggaaagtttggcggcttgtctctctatcctggtgttgctgtgcaggccttataagcagctcaggtccggtgacaggaactggagcctgagtgactgctttcttgcttgattacgttcttccaggacactggactccccagtttgtttagctggctgtgtcatctcttggccacttagctctgtccctgcctttagctccctgacttggctttgtgggcagtaggctgtgtgtttcttgcctttatttgcaagagcctttcttggggcctgacagtttacagatgccacctaatggtaccaaaggtaactaacttggctgttactgtgctatatctaattcatggctaagtcttcatatgctctcccaccttcttaatgaagtcaaatggactattttaaacccgttttcgtgaacagtagagggttcattcagtgaactaagaaatatgaaacactagttgcatttaatgaggaatctcttagtcctaaaggctaacagggcattcagcatccttttggatgcactctgttatttttatccttgtcatttagcctttctgggatggagagtcttctctgtttgtagatgatactgatacagtagctggcagatctgcagtccctctccatgtctgtaactttgcctagcttgaagagtccataatggggtgtttctccatggacacttggcttcctttaccaagcccagagaggactaatcagaaactaattccatcaagtagaaaggctgatttcaaattcaaaaagcaagtattaaattgaggatacaaacaaactgaagctgagtggctgtggatattgggagtactaaaatagttttgaaaaaaagttatttggcttgttgtatttgcctgtatgcagttgtgtgtcagcaggtcagaggacaatttagaggagacagttctctcatttcactatgtggctccaaggaacagagcttgttatgatttcaaaaagataaagagatataagaatatgttctagggtggtgtggtgaggtgtggggcaagggggtgcctcagccggcccatgccgaagcatccctccccctgagggaccagccacaggacagtatagcacagaatagcgggatagtataggatggagtttatttagggcatggggaggggagttaagagagtagtagaggcagagaaatgcagagagaaggagagagtagagaagtataggccagctatgaccatggggaaagaggggggaaggaaatggggaagagagggggagcaagaaggcaagaggcaaaggagagaagcaggagtaagagagagaggagggggcaagcagccctgtttatagtgagccagtcatacctggctgtcaccaggtaactgtggggaggagcatacctggctattgcctggtaactgggggtggagcctagacagaatactaacagagcttaggttgtcaagcttggcagagagtgcctttactcactgagccatcatgctgaccccagaaatggctctaaaaagtcagatttgttgactccttcatgatgcataaacttaaattgtcttagaaattcaatcatattattctgattctctgattcatttaattgtgattgattcagctgtgaagcctgggcaatgtctcctgctgtcttaataaggtaccgttgtccctcagtgtagaagactgaactgagatgtaaatctcctaactcagcttgtggggaattctctgtgcagtcctagaagttggtaaaaataatgaaggtcttgggtatgtttctgttctacagctacaacttgcttattaaatagaggaggagactgttctgaaattgcctgtgtggtgtgtatggccttggaaggctgtactctgtaaattaaagggacagcaaagactcctccagttgacagctcagaatggcagaagcaagcgtccttgtccctgcacccccccaccccctccaagttcccaggaggtagtgagcaggcatctgcatgctccacagggatatggtgagtggtgagcaggctgctgtaagtttcactttcagaattgtttatgcaactcctggaaatgaagcactcctggcttgccttgcctggaaatgaaggacagggctcaccaagtctcagatcagcacccagccaatgccacaatggctcctgagggctaagagggaatggaacgagctaggattaggtccctagaccaaagctgttgctttccatatcctcactcatagaatgctataggccagaagaaataagaaaatgagcaaaagagtaccagagtcagagctagaggcaagctcattaagtgtagccatgcaccttatgccagtgacgtcgccactcatttgtgttgacactgaatgggcctgtggcacctggcgtaacttcatttgtgaatgaccacagaaccaataaagcagcaagctcttgtcaatgattcatggattccattccaattcagggacccattgtgttctgcgactgctttgaatgagagaccaggcagctgccctttacatggtgactctgaagccccagtatatgaagccccggtgtatcaggcatgctttgcctgccacttcaggagagtatttcctcacaagatgtcagatgtggctcaagcccattgagagtcagatgcttttaagtagaagcagaggccccccagcttgccctgtccccttccattatggtccattaaagctatactagatggaagctgttttgacgaaaaatggtctcctcacccgtcacttgggaacactttaccacttcctccattgtgctaggaatgaactcttttgaaatcccagtgcaaggacgccagggaggccattagggaaagccaggcatgtttgacatttacctgtcagtccttagcagagagtgtgtgtgaagagaagagtcaagacggaggagtgttctcactcacccttgcctgaagttttggggttttggttgtttcatttgttttattgttgctgtttctgagacagctgttactatgtatagcagggtggccttgaactctgagaccccctcttccctgcctcccaagtgctatctatggtcaaaggtgtgtgtcgccatacatggctttaccgaaaactaatgtgggcagattttggaactttgtgcagaagaaggctttgctgtcttcccctttccccagtgcagcccttgctggatactgttgacaggtaactaattcctgtctgcttcaacccgcctgtttgccatagtcaacattttgattaaaatagagtacagattgtgaaaaagttatttatgaaaatgaattttttaaaaaaaaaccataagcatgatttgaaaatcccacggatatctcatttagataaaaacatgaatgctgtataatttcttacattccgtttaacagaagtaagagcgaagatcaagaatccgcagtttgtaggaattatctgtcggatacctcacaagtcaggccccttcctaaactgcttgaatagcagactcatttcaggaatggaaaactgcacagaataattccacatgttacatgtatgaatccctgcaggattcagacattttttttctctcatctccttcgtggtcactttcagcttagactgtgaatataataattattataatccctgtgctaatgtcagatgtgccactggttgtgtgatctcctccagctcttacccccctcactttcatctgctcacagcccggtttccttcaggtggtcggcgtcctgtgtggctgcatcttcatcttaacagtgacttgatctttcctgtttgacactttcccagaaagttattaatggcagacacagtgcccctttttatcatcagggccccatgtttggaaaagactctgtgtgatttcttgatacaaagaaaaaacacagttgacttgaagggtaataatatccatagctaacttgtgtgtaaataatagaaagagaggaccaaagacacaaggtttatagaggatgtaggattaccctcgggtagggaactagtacccctaggatggggtagcctaggttagctgggagagatttctctggagactcctatacccagagaaggctgtggtccacagactaggaatttgatggcaggtatgtcactgataaagtttgttgtcctctttatcctcatagagatgttttatgctgtatagtttatttggggataaatagagtgtgaggtgcatgacaagatgtgggtcctaaaagacacttcagagctattacactcgaatttgaatatttaaacaaaacaaacaacaacaaataaaactgttgggtaacagtttaaaatgcaactatatcaccaactggtgatggctggtgaagggctcaggggcagatatagtagtaaactaggccacccagctagctgggctcatctagttctgcctcagttccatctacaaattgggaatggtagcatttattacctagggatgctatcatatgaaaaatactcggggttctatctgtcacccaagtacggctgctgttgactcgggctctgtctcctttaccagcagagcctcatctttcaggatggaagaccaccagaacagttcgtaccagccagggataagcagggaaaaggggtggtttcaggtcttggctggatttggagtagtagacatgtcctgcactgctgtgggaatgcaaatctgtacacgtgtgctttggaaaaagtttgtacactgcttacagcaccatcctcccctgctgccaggacccgtggtgcagctgaagcaactcccaacagagagacacaagggagtacagatggaggctcagtgggaaacccataggcacaaacaagctgaagactgctgtgacccaggtggaggagataaacaagcagcagccagatcacgcacagcagtgtttcaaagcaaggggaggaagcagtcattgccatgtacagcaatggggttgggtcccacaagtcatcgcactgaatgaaaaaaacatggccccagatcgtagctattctgactcttacctgcataaaactcaagtaattaaaaccctcagcttgtgttggaaatcatgatggtggagaagatagtaattgcaaaatgacgtagggttagttctcagaacagttggtgtcccatgtctcgatctgggtgttcattcctcctggtgtgtgaccagctgagccccctcagtgacagtctctaagctgagtacttagggctttcattttatgactcactttgctcttgagtaaaacactcaaacatttgatcaacttgcaaatgaagagagtttaactgttgggcccagtactgccttttgaagcagagcagctcattgtcccttcagctgggactgagtgatctaaagggttctcagtgagctctgaaaactgagcaaggaaaattcgtacggaacttaaagctgaatgctttcaggtccacctctgcattggtgggcccgcagcgccttcctatttccatagagctggcatctctgggcctgcctcttttggccagtcatcactcagacagagaacacgtgaaagcataagtaggtccatgacatccatccgtgccaaccatgtattcattcagagtgtagccttggatgcttgcttgcatagtggcagaaaagacctgatataagtactgggtattagtaaaaatctgctcccctgctgggttgaagaagaagatggagaaaaaccagcaaacaaaggagggtatttaaatacataaaaactcaaaaaggaaaagaggaagaaagatactagttcaccagatagacaaagcgagagtctgaacacttaactcatactcttgactggttatttcttgtggcatcctttctcagcccttcatcctctaaatcagaaattgtctcaagggtggtccctgactgctatcagtccagatgcacgggagcaaagttgattttatgtctacttggtgccttaggagatctatctgctcgtactctgcaaccctgtttgagcagccgtgagctagtggtaagtcctaaggaaggtagcagagaggctgatgggaccttgggacaaatcagagcttgggacaatggaaggtccaacagacctgggtgcagcagctggtaaatcctttgggttttgaattagagtccagaatgtagttcccccacaggaactaagagagttgccttctttgatgcaagaatctcaggtgtgcgatgacagggggttttttgttggattctgtttggcaagttttccagcagtgctggacatatcagtcacattcaggatcagtagagaaacttttacacatacgtgcaacagcgctgaagaggctgaggcagaggagcacaagcctgaggccagcctgagctaagtagtgagatcctctttcatgcacactctgagaagctcccccatctttcctgccatcgtggcatttctagtttaacagttaattgtttccccagttacagttatgcctgccctttgcttgtaagatttctaatttaactgtgtcactgtttattgatttttatgttgtgagtacctagaaaatccaaccagtgtccttctattttcgttaggcgcaaagtcagaagaagacattctgtagtggctggcaggcatatctctaaagaccatatcagaatctgtgcacacattcagttcttaattcacaccgtggaaatgcagacaggcaaggctttaagactttcacagaagtcgtgcttggatagctttgatcttttttctgactcagtggttgtagagttgaaagggttaagtctttaaatgaagcagtcatctttattaggaaagtactggccaaacacattcacctgcttttttttttttttttttttttttttttttttttttttgattaatcttacacaaccattggaagtagtaaccactgcgttttgattcccactttgcaatttgccaagttgaggttctgaggggttagtgacatctccacagctatgcaacccacccagtgccgcaagtggattcagaatgtggctgtcacatccgcagagcctgatgggagcagccttgaatccccgcttattagtgcaaggtcaacaggtgcccatgacatcccagagctaaaacgtcaggtttgatgcagatgatgtgggaggaaggccaaaccactttgctcctctgttcactatcactaaagatacttttgaagccacattgcccaggatattatttcccaggttccggctacaattaaattgtgaagtctttattatttgctttataaactcaacataatcattgtaaaccttaaatttgctgaagcttttcgcactgcatctgtgtggaaacttctcaccttttgaaatggccagttgtcaccctagtcgaagtgaaagtatccataatataattatctccctttaaaaggatgccacaccaaagcaatatttttaatcacacttataaattttctcaatttaaaatgcttgtcccaggtttaaagactatgcttgattttacttgtgacaaaaataaaactgggtaggccatgctgtttcttgtgtcctggaagatggcttcagagcaagtattcttgttacttggacctgtgccaggttgggtgtggtccagggaggttttccacgtgtgtcagaacacacgctcattctgtagcctgttgtccactcgggtccattgtcccggtgctgtttctaagcagaaaatcttagatgtgcgcttgatgaagaagaagcaagctttgtagtgagtgtgcacggacagctccctgtatgcctttaaacaggttttgatgacgtcattctggcattcggaaatagaatcgagttctaaaggtcatcatccgcagagcacagaagtctgatactgagcattcaccaaaaacggtgtcaatgcagtctgagtatcagggttttcagcattgtaatctgcaccgtgcctgctttcttctgtagtgctgcctgcctgggttcgcgttcaccacaaggaagtatttattgtcttttctgctacttggtcatcaatagcagtggctcagcaggtgttgtcatgttgccatgttgcctgcatgtgctccccgcccccactcgctttgcatgcactcagttatcacctctgtctcacagaagaggctctctctcatgatctctcttttagtccagtgctcggcatacacacattataaagacacttatatacacagacgtgcataattttaaacctgtaagagaaaacaaacagtatttatcttcctgaatctggttgattagcctagcataatgactaactgggagaagaaagaaaacccactgggtgatgtaagggagggcagtgggataccaataagaacaaagtataatgatatgtgcacatgaggtgggttgggggatgggagggaaggggaggaccagagaggagaggggaggggaggggctgatcctaactcacaggaactttgtagactagaggcaagaaaggagtcagaaaaataattacagttgccaaatatatgtgagttatcacatatgatatcaaatatgataacaaatatgatagtccaaaatgataattcagttttcaagctagcatctgtcatccaagtaggcagcagaggaaagaacatgtagacagactagcgatgagaagcagactccttcctgggcccactcaggtgccgatttgatttgtgtctttaggagccaggaaccacagtgcaagttaggaaacagaaagtctagatttgcattttagctaggtatgtatggaacagtgtttagatgaagacactaaagagctaaatgcaaagtccatgctttgtccctttgaaagattctaaatgatacgagagagactaaaggttctaatgaactgtgtagggtagacctcaggtttcatattgcagtgccgaggagtggggtgtgtaagataggttaaggatataagaacatttactggatggttggaaaaccagcaagacagcaaggccggggcacttaacatggatgtgccaggtagttgagggcatgcctttgtatgcctccagataacatgcaggggctccttagatacttcaagagcaattcagtaattgacttggcatgtgtttctgccatacagttaagtcatttctggtcatctgaggaatggctagaactgggaagaagctgaaaataatcacggcactaggtgagaggaatcaaggtggtttgtcctgcttttacccagtgttctgctcaggagaacagtgagcattactgcgtcctcattgtgtgtgtctgtgcctgatctgaagggatcttttaagacattgtgagttcataatgtaagtgaaacacaaggtgagccatccaccaggagtagttacagaaatgtgctcattaggtcaaatgctgccattgtacgggcacaatggactgtttcatgtggttgaaatgttgtaacagaattgaagccacccacttgaacttcagcctagaaagctgactaggccaagaggcagcaagggcagagagatggtacaggcacctggtgaactggctaggtttctacactggaggcacggaagtgaggcagagaagtagatgcctacctagcatgtcataaaagagaatcgtctctaagaggaaatgcagaagtgtgagaaataacacaaagatctctagtgtaaagaagtctctggtgcatcagagtagtgctggtaaagtgtagtgagctcctgtaagtcctacaacagtgagtaccttagatatgggactcagccaagctctccacatcttttctgtgctgtttcattactccactcaattgcatgttaaattatagcacataaagtactcactgctgtttgtacctgaaaaagaatgtattcgtataaaagtatataggaaataagggaaacatgaccaaccagtggctttgtgcattggaagataaaattttaaaaagaaagtgggaaagagaagacaagtggatagctaagttgaaatatcattaaattgtcagacaaagcatacaaaggctggcatgctggcccaggcctatcgtcccagcacttgggaggtagagccaggagttcaaggtcaccctctacttcacgttaagtttcaggccagcctgggccacttgagatagtctcacaaaaagaaatagggggaaaacagtgtttgcagacctcatacggtccaccattcctcagctactcttgttcacttgcctgcccagcgttctctggttaatgctcactcagccttgtcctcagtctgagactcttcttatccccagcattctgggaaaatcaatagaagagcgtgagtcagtcagctcttccttattctgtcatgtttgtctttaggtgtcccatatttccatatgctgtccattgagcagatatcattgctatggttggaagaagtacaaaatatacacctcgtagccaagtccaataatgaaatcatgaaagagagccacagattcatattgtgaaatagaaaacgtctatgttagtaattcagtgaactaccaattgcgtccttaaacagtattgcaataacctggcagaataattgagcaaggattgaatggcacagctatagacataaaagagtgcactgcataacattagctaaaattttaaattttagtcacttacaatcttaaatatatgtcagaactctttgcttgaactacacattatttccagacttctaacatgttagtacagaagctgtaacctgtgtagtttccaagttaaaaccatccccacaatgacctctgtgcaccacttggctttgtaggtcatcctttcctttctgcagtattgccagacagggatttctgcagcacaaggtaatgatgtcactcaaaacccagatatgcaatccttaagtggctcttgatacatcatcatcatcatcatcatcgtcgtcatcatcatcaccatcgtcatccctttgactcatgtccattccagcccttagcctccctggatgcaagggtctgtttctgttcctacattgctttacaccttgtgtccattctgaataatatttagtgacctttctttgcaaaggaaaagctcgcttttttatatattacattgaacttccttttcctttcttcgctggtctggtctgtcttccctcagtgcctgtctttgacatggtgaattataagggttgttttctttgcttctctgttctctctttcccactccattgcgtgcgagcacacacgttacacattggaagatctccacccatggtgcgagcacagtgccagcaacaccttgttaggagctacaggaagactttcaacaatgattagatatggtcctgttattagttattgccaacttttagcttagtccttggtcagagttcatgtcactgttttgctatgtctctgataatgaatatcacctcataatttatttttacagtggccagtgtgtattggccattggaagatcctagcgaagttagtcgtttgttgttaactctgaagaacattgtggctggcttgcttgtttgtgttacacttttatttcttttatatgacttttcccgttttgtattcatttcttactttgtgacaaaatattcaactgtatatggcagtcatgtataatttacataaaccttagttctgcaggttggtagtattcatttatgttgatatgttttataaaattgaaacaatttgaaacattctatttagatcattgtttttttctaaatcaaataaagtgagtctgtacatactttttaaaagtaaatccataatggccaagttaaggtagttagcattttgatatccttaaataaaactgtgcctgcaaaggtggtttttttttttccttaaggtttatttatttcatataggtgagtacactgtcactgtcttcagacacaccagaagagggcatcagatccccattacagatggttgtgagccaccatgtggttgctcggaattgaactcaggacctctggaagagcagtcagtgctcttaaccactgagccatctctccagcccatctgcaaagtttatacagttactgtaactatttcttttttcatttaaaaattattggagctaaagagatggttcagcagctatgaacatttacttcatttgtaatggactggaattacattcccccaaagttatgtcaggctgcctgcaactgcctgtaactccagctccaagggattttgatgccctcttctggcctccatgggcacctacattcatacacacacgcgcgcgcgcgcgcacacccacacacacacacacacaagccaaaatacatatatacataaataaaaataaaatatcttaacagacatgtacagaatggactctgtgctgagatttctttgaccacatggtatgtatccctgttccaggagttggacacatagttaaaatctctgaataactgatcctgatatcacaagacattgctcacagactatctaaatatttttaaaatatttcaatttgatgaatccaaagccactgggtaattacactgtgaacatagaaccagttgtaagacaagatacattgcttttgtggcctaatttaccagtggggaacatgtctgattccacttatttagaaaattgtttttcttgtctgttttgaagttcagagtcttatagaaacaatagtgagaggcagaggcaagaggatctcttatgagttggagaccaagctggtctacatagcaccatgtctcaaaattaattaatctacatggagtgtgtatcccacagaatgacaaaagtggatctctcttgtaatcactgtcttttcctcattgagttatgagttctttatacattctggagagtagaccaaatcacatgtatcatctgtaaatattttctctcatgcagtggattacctctttgtctcttttaagtagcatccttgaaagttaaaagctttgactatttctgaacttccattttctgtattcctgtgcttttggtagcctaccaaaggaatcagtgatccgaggtcaggagaacgtgtagttatccgtgcttactctgttctcagagtcctctatctgctcacaaaagattggatgcatgttgtgttgatgtttgcatatgatgtgtggttggagttcaatcctatcttcttaggtgtgcgtctttctggaggtaacccagcattacttattgaaaagtctcctgagacttgtcttgatgctttagttaaaaattgagttgcatttagatatgagtagtaatttctgactttctttttctgtgttcctgtcagtgttgtattgctttggttactgcaactatttatcaaatacatggaatccattcttggatccactggcatgaaggtgtattttgtttttattggatgcattgctccgtagacgttcagtagtagtacatatttaaattgccctttgtgtatatctaactatgctgtttttcatgtagctgcaagtgactgatagtttctcacttctcagatggctcctgttgctgtctcctaaatgtgtatctactactagtaaactttgtttatcagctaaagtactaatttcttttgtttttcaaggagagcttcattggatatcaaacactggacccagtgcaggtcaaatgcctcccaccaactagctgttcttgcctaagcccccattttctttggaatgtgctttctcattgttttccaggcagtgaccttcccgatagtcaggtcccctgtgtcatgagctggatgtgtttgagaggctctggtttcgccttcctgtacttacggttgtgtctctcttaggctttacttctggaaatgtttaagcttcttgggtgtgtaaagtgttttcatcaaactggggaggctttgaacctgttgtcactctgactaggtttcagcagatctcattgtccacatgctcacacacacatacggtgcggcccacgtctctgatcctatgttcctatgttcctcttccccagtctttgttctcagagtatctgtcttcaagttcagtgacttctgtccagtgtgtctgctcatgagaccagtgagctttctgctttaattactgatttttcaagtcaagcttttcccttggcttctctgtctactgacagtctccacttagtgacgtgatgtgctcgggctttacttggtcataagtttccttagctccttggctgtattcagtgtgttggttggagttctttgcctagcagactcaatggctcgacttcctcagaggcaatttttattaacagctatttgttcttatagaaagaccatatttttatgttttttaaagcatgtctcaacttcttgttttaaactagacacaatatattaataattcatcaactctaggaatcacattcttcaaggatccgttatttgtttttgttttatatttagggctattcaaaacaaattctgtggaggctgtgaacaccaggtgttgtctcttcagtctcctcctccttgtcctcttcctcttcttcctcctgtgctgtgtatattgacattcacccaggcactttgctcttaagtctccttttgaagcccctccctgtgctggatctcagaatcagccaagggaaacagctctgggcctatggtctttttctgagtcatgggatgtggcactgaggtgggcgtgtccgtctagggtcccaggaatatgttggtcttttatgcttatgaattaacacatttgtacgtctccatagtctctagcagctaataccgtaaacaagtggctctaactatttccttcagctaacccctcggaatgtagcctgtttgtactaaggagagaactaagtcaggagggatgaagaacactccctgggaagcatttctagcaggtgttccagttgcctcactgcaccccagtagcttccagactcctgctaggtgaaaataccacatagctctgctcataccaatatttcaccatggtttctttgttggtgtatctgcttttaaatgaatattctttgacactctctgtggtcaatgttccagtcctaacagtggtgatcttaattgtttcctgcatgagcttggtcttttgagacaatctgggagcttcttgctctgacagtttgactgaagccatacctcacatcatggtttagcatcaactgatgcctcgcagtgactggaggcagagtgctcttgctttttagaggatcttctgactgggtctccttctggtgtgtttcaggactatgacgatgggtacggtactgcctatgatgagcagagctatgactcctatgacaacagctacagcaccccagcacaaaggtaagagtcagcccctgctgccaggctctatgtcaacttgagtcagggcccctccactgcgaggtgtgacagccagccagtgggactggtttcctgtttgttgtttcttctgactagagagagaagtagagtccacttccaaatagcatacatcatcgcacgtggatgctctctctcctaaagcatccagatgtaagaactaagtttaattttatctactttggaaatttgacctaagtggttactatcatttaaaggaaggatgatggcttcaaagcaggtaaccattcagtcctaaggccctcaaggtccctaggaacagtgagcttcctgcctttctagagaacgtaatgccagagcctggcttgctattcacagaacattgcatcatcttagcagcgatgctcctgtttcccagcggcttcaaattctgtaaatgtaacaactttgtcctgatcagaccctccccacagtagagtgtatacaggaaatactaatcctacagtgcctgcaaagcctaaacatagacctagctgttgggatggagcatccaggagtatgcatggatatggtcccactccagctgtgagtgaatacatgggtcctcctgcctgtcaactctgatactgggcaggtgagagtattaaactattcttgtctttgctcatgacatactgctgactgtataaactgtgacaagtggcttgtagactttggctaacacgtggtctatttcaaaaaggggatgctttgttcttcgtgtttgtatcgttagtgcaggggacaagcactcctaccctttgttgaaagtgacaggcaaaagctgcatgagaattgttccacggctccttctgtagctgggccagcacttcctgaagtgtcctactgtagagagcaaggagtgctgttccagaagaaaccgtaaatggatccaggaagtgggccttaagtgggatcttctaacaccaggactgtgctttacagctatgcttgtctctgctttgttttgtaaatgtccataaatgtttcagctttcagcatgaagtgctctggcgaagcacatgtaccttccacctcacacacttgttgggtatacagtttctgcctggccctcttctcctaaggcttgcagaggctgcgcctgtaaaagaggagagcacataacaaagagattgataactgctcagtcaatgggtgggaatggctccttctgagcgtcactgtactcttcagtcagtagtggccccacacacatctaggtgcagaagccagggctgctgtatgcttctgctggaggtggaagtgttctggatagtgtggtagtactttttatggtcttttatattctcacttctagttagtgtacagtttctattttgatcatattctttccagagtcctccaagatccccatcaccctcctcacttaacttcatattctttcttcctctccctctccctccgcctgtccctcaaactgcatgtcaaaacaaacaaaaatccaataagaaaaaaaagcaacatgttacaaaaagtgcaagtgtatgctcaagcatacacacacacacacacacacaccacatatatactaaaaatagagtccattttgtattggccaactactgctggctatgaggcctgccctatattctggttgatagacccaggaacactggattaggaacaactgatttccctttcccagaaggtatcaattggaattagcttcttggttatagatgggactgtatgtctacctcccctccttactgctgggattttctctgctttaaatctgtgcatgtcttctgtatgcttctgtatatgtgagttcattcatatagcagtctttttgtctggaggatactgtttcctaggcgtcatccaccatctctggctcttagcatctttccacctcctctaactcatagatccctgagcctagctgggagggtttgatgaggacatcccatttaggaacatgagtgtttaaaagcctctcattctctgaacattgtccatttgtgagtctttgtcttaattctactgcaagaagcttctctgatgtaggttgaataatgtacggatccatagctatagtagtatgtcagtagacatcgttttattgctatgttcctttagcaaaacaatagtgggagctgtccccgagggcccatgtctgtttaatgttacttgtatgttttcagggctgacagtttggtataggaaaaacaatttttgtactgttccctaggaaatgtagtttctttgtatagggttgagtcttcatggtcttccccctgtctcctcatgttagcatgtctttgtttggctcatgtgtatatagtcatgttgctgagaccttagggtatattctcacagttcaagagtagtctcgtagtaaactccctgatcctctggctcttacaatatttccaccccatcttctgctgtgtggaagttgttttgtacatatatccatgtgggactaggcttcagagttctacattttgattgattgtagtttctgtcatcatctccatctgttgcaaagagaagtttccatgataaagggtgaaaactactctttttctattgatataaggataaatttttagagtatacttagggattatgctgatttaataaagtaatatttgtagattctcccagatccatgacttctctagcacaggtagtttgcaaggtttctagtaccagtcatgatttctttcttattgagtgggtgttaagtctaattagagaggtggtggttactgccaatgtgtgtgtggcactactgcacacttagaattattgtaccatactggtcattattgtgtttgaaggcatcatacctggatagcagtattagttgtatagaagtttgcatgacaccttctagtcagttctagttctggtcatttctaactggcacttggatcagttccagttcaggggccattgggtcatgtagtggaccttatattcaattaaaaagtgatttgttgctcccataacattgtgacattagtacaagagtatttttgtaggcagggttgctgtaggtgacagagtttgtaaccgtgttatcctgatgattactcttctcctctggtggcagaatcttacagcaccatgaacattaatgagtccaggtgaagcttggtcaccagctgggtttctccatgttcaatgatacgtgtaactgttggtagcaataaagccttacattgagttatggagtgtaaccaatagcgatttgatatttgggggtttccgtgaggccctttgaccagtgaatcaacaaggtgtaactcattcctgacactggaagttttacttgatggtataatatgtctagttggtcattgtcttttctgttatttggtgacaccatttacattcctttcatatatgttgcatatattttaggaaacttctgtagtattaggtttctatcatggcttttcaaaaggccattattgttaattctccctcctgcatctccttctttagcctgctgtcccactcccctcccccatttaagatttgtattatattttccgcctaatctctttctttaactctgtatcctatatcccttccttgaaagatccgctttccccctgtatctcccatcccttatttacctacttaacctctgtgtttttttattttgaagcacatgtctaaagtttaaaaactaaaatttacatatgagagaaaatagccaatatttgtctttttaggtccaggttactttacttaggataatgttcttttctctagtaacctgtaagtttcataatcatatttttcataacagttgaataatattgctttgtataagtctaccataatataattattcattcaatgtttgatgtgtatctaggctgttttccaatttctggctattatgaatagagccccagtcaacatggatgagataagatgtagagtctttggggttatgcccaagagttgtataactggatcttgaaggagatctattcaagatctattcatcctccagaggaattaccacattggtttccatagtggctcttcaagtttatagtcccaccagaatgaggtatcatttgttttattgattggccattctgactagaataaaataaaatctcaaagtagttgtggttttcatttcattggtaactaaggataggagtgtgtttctcaactgtttgtttcgtttcatcttttgataactctgcctagttttgtaccctgttttttaattgggtcatttccttgatgcttagtttttgttggtgttgttgttgttgttggttggttgcctggctggttgttttagttctctctatattctagatacagctatatctgtctcatgtatagttggtaaacaattcttcccattcttcaggctgctgcttgcttgaatgatggtattctttactggactgaagatttttagcagcatgatgtcccgtttggtaattgttggtcttagtgtgtgtgctatcattgtcctgtctttttctgggccagtgagttcaggcctatttcccactttctgttctatcagatctagtacatctggttttatgttgaggcctttgatccatttgaagttcttttttgtaggataattaacatcagccatccaatttgatgaatccaattgtctttcctccagtgcgtgttattggcttctttgccaaaaatcagatgtccataggtccataggcatttggccttgtgtgagtcttcaatgtgattccattgatcaacatatctgctttattgctagtaccgtgcaatttttattactgtagctctgtagtacaacttgataccagggatggtgatacctccagcattttttattattcagaatgtttttagctatctggatctcccccccacccccctctcctttatttcttaatttcttactttttaaataatgctaagtactgtgttgaaattttgttggagattgtactgtatctgaaggttgcttttggtagatagccatttcactgtattaatcctactgattcttgggcatgtgatgtatttccatctccggatggcttcttcaataccttcaattattttattatacaagtttttcacttgcttagttagagctgtcccagggcttttgctttagttttagttttgtttggaggctatggttaaatgtactattttcctgatttcattctcagtctatttgcttttgcatataggaaggttactgatttttgtgtattgactttttgtatcctcctattttgttaaatgtgtttactacttataaaagtttactaatgatgtttgtaaggtcttcatgtataaaatcacttcatgtataaaatcacacaatttgttaataaagatacttggcctttttcctttcctatttgaattttcttaatttctttcagttatcttactgttctagctaacatttcacatctttcaatgaatatgtatggagagtggatatcctagctttgttcttgctctaaatttcttatgttgagatatgtcactatatttctagtctctcaaggactttattcatgaaagggtgtgggatattgtcaaaggttttttctccgtcaaggagatggctatgtggaatgtatctttcactttattttatgaggttgtatgttgaaccgttcctgaaatctgggaaaagtctacttgattatggtagatattttttgatgtattattggatgtgctttgcaaatattttattgagaattttacatgtatgttcatgagagaatttgccccatgcatttcttttttttgttaggtctttgtgtaattttggtgttcatataacagtggctttgtaaaaagaattggggcatctttctgcagtttctggttttttttagattaatttgatgtatattgtttattttctttgaaagtctaatagagttctgtgaatccatctggccctgggattccttgggttggcagatttttaatggctgcttctatttcactaggggttatggacctgtttaaattgtttgttcattttgacttgatttaatattgggagatggtatatattaagattctcccatttatattaggttttccaggttcagacttttaaaatatgtcattatgattttcagaatttcctgagtgtctcttgtaatgtcctcctttcatctctaattttattaatttatgtcttttctctcatcttttggttaattgagccaagagtttgtcaatcctgtttttttcccctcaaaaaaatcaacacttcattttattgatcttgtggtttttgtttgtctatcttgtctgtttacttgattctctttcattgattttttttttttatcccaagtttgagtatttcttcccatacactcatgttggtattattttttcttgtttttgtagagatttcaagtatgcagtcgttaccaatataaaatctctacagctttttttttttttttttttttttttaatgtagggacttaatgttatgaagtagtgtcttacaactaattgccttgtgctctatgggtttgggtaggctatgctttcattttcattcaattcttagaatgttttcattttcatcttgatttctgttctgttttaaagcttatccacttttgagtggttcaaactccatgagttcccatactttctactgtttccattactgctgataacctagctttaatctatggggtcaaatatgatgtgtgacattattccagttttcttatatatgttgagagttgtgttgtgtcctaatatgtggtcagttttggagaaaatttcatggggctgctaagaaaataacatgttccttaatgtttgcatagaatcctctgtagatgttttgctttatgacattatttaactccagcatttcctgtttgtttttatcttgatgaaactatctggcaagagtggagtattaaagtcacctactatcactgtgttagaaatagtgtgtgattttactttcagtagtgtttcttttatgaacttgggtgcttttgtgtttggtgcataaatgtttagacttataatatcccttggtggattttttttcctttgatgagtatgtattgccctccatatcttctgattagttttagtgtgacttctattttgctaggtattgaaacagctatatctatttacttcttggttccatttgtttggaaaattttttcaatacttttaccctgaggtaatgcctaccttgatgttaaggtgtgtttcttgaatgcaacaaaaggatggatcctggttttgcatgcattctgttagtctatgtctttcatttgaggaattgaagaccattaacaatcagagttattaacaaacagtatttattaattcattgtattttgttgtggtggtgtgagattccaaccttttttgaccaactagtctgggattacttacttgctgtaccctcatcagtatagttagcctcctctttaaactgaagttttcctttaattaccctctatagagttaaattggtggacagaatttccttagatttgtttttattgtgaaatgtttttctttctctcttgatgtgattgatagcttagctgggtatagtagtctgggctgaatctgtcgtctcacaagcttgtagaacatctattcaggccccactggctcatggagtctcctttgaaaagtctactgggtcaagatgatcctgtgtttcttcaattgtcataaagacctttatatgtgacttgtgcttttactctagcaatttttcatactctttctttgttctgtacattcaatgttttgacttttaagtgcttgatattatgggactttctttttctaatctatttgatggtctgtatgtttcttgtatcatgatagaggcatctatttagattggagaagttttctttaagattttaaattaaatattaaattaaatattaaaaatatttctctgtgcctttgccctgggttccttttttcttcttctatctctagtatttggtcttttcaaattctgtgcatggaaatttttttaaaaaaaaattattagagttagcattttgtttgattaagctttccatttcttctatttcatcttcaagacctgaatttctctgttccatgtcttgtactctgctggtgaggcttgcctctgaagttttgggttgacagaattgatttttcatttccagttttatctcagtctatgttttctttagtcattctggttttttgtttgttttgttaaattctattttatgtcttaaatagatttctttctttttttattcacttgtttgtgctttcacggttttctttaagggatctattcgtatcctctttaaggtccttcctattttgaagtccttgtcttgtgcttcagctgaattatttttctcagaacatattgcagtagcgctgttgatctctgcaggaggcatgttgctttgtttgttcatctttgggtcttttgacctgtggttggggcatctggagttctgatgtttgaagtgtttcttgttgtagattcctggactggatttttgtagtgttttgtattgtttctactactactctgggtcctcgccaagtgttcctatgtggtacctgctagagtctaggtcttagctagtgtgtcacctgtgtaagtccttggtagacagaggagttctgtgggataacagaagtcacaaaggcatggagatgggctagaagtaaagtctgaaaggagcagaaggaagaacttgggggatgccatatctcaaggagctggaagtagccatcttatgttttgattttggttgttcctgggcaccagtcccatgctacagagttatcagtaggtaacagaagagaaaacatcactcatctatttagtgcaccattcaagacttcagtcaagatgatcctgtgtttcttcaattgtcataaagacccaaatttaaagcccttacctgtcctattggacaataatgctacagtgagtgtctggtaagcagacagaatgaaaagcaagttactgagaggatactctaagtcaagattggtgtttaagtcattaagcattacatcactggcaagagtcagccctgggctgcagcagcttgtgatctcattttaaatgtggtgatgcactaatatgaagggaaggaagcatcattcagtctgggattcttgaacgtctgccatatgctaggcactgctcttaaagtttgacgcccaaacgctgttaaaattgagtctcattggaaagcttcactggctgtaaggagacaaatgtaaatatttaattgtcaagtattaggagaagtttgagtagtttcatgctttcattcaaaatactccagaattccagtccagaatttatggatatatctgggaaaataaaggataaggaacagtcccccagatgatgattagggaagggaccacataccaaagtgacgcaggcacacaggacaacaaacacagcaacgtttcttgtgtggggaatactcataatgtaacacgggtggaatattctctctgggagctaagacttaagacttggaagcaacagggaaccaaggaaatgacgagtttagacttaatttagagaaattcattagtccatagtacagagaagctggattggcagatgctgagtgtagctaggggcagaatcagttaagaagctgcaactaaattataaatccttaagagtcaggaaagactcgctaagacaaacagcttatgtggaagtacagccacctctgaagtgaggttttcagggctacagctgagcacacctaaaggagcaaagtgcatgcatatgcaatgcagagggagccaagtgtcctgaagtgcaaacttcttgaagaaaactatggctcagataattagatcactttccaaataccattcacctccaaaacaggaggcaaacggtgaccctgggtttgtctgtctggatgacatccgttaggcttctgtgtcctgctgctgtacatcaaattcaaatgaaatggctgttttgccgagttggcttgaggaaaaaaatgttgtgctcttctgttaatatgctggggtgctgcatcaaagtacttcaattctgttttctcggggaactgaaactgaggctcaaagtcaacatggtagtaggtcctactccagtagaggccttcctccctttgacctttcctctgtggcctcttggtatattcttctgcatgagtacatccttggtgtctctgtgtatgcagaatctgtcttaggagagtagtaatcaaattggattagaacctattcgtagatttcatttcaacttaaactacctctttaaaggtcctgtctcaaagcacagccataaatcagggagttagtagcctatgggtccaacgtgggacttcagggaagggtacacaatctgccacataccacaaaggtacttgatatatgtacagcatatgtctcaaaagttaggaacctggcagaaaccagagcatccctaatatcagatctgttgagagcctctctccctctcagtatcctcccaatactgctaccttcaatattgaggttgaacctataccatcactgcataggttcggcgtgcttgtctggagttctggggcctcccaagcatacagagtcctcttggcccctatttcacgtttcttccacccttgttgtgacttagctgctttcactaattgccatttgaacatatatgacgtgctgctgtgggtaagcgtttgcctcaggaggctcctgtgtgaaaggcttgagcctcagctgctactgcagcttctttaattgttgaaagccttaggcggcggggggcggggcctcgctggaggacaggggtaactgcaggtgggtccttgggagcaccctcaccctagtccttctcccctgcttccatgaggaggaatcctcctccccacaagttcctcctcccttgtgttccacctatcatggtgctgattaaaagctctgctaaaacaagcctttcttctccctaagttgttttgtcaagagattaaaagcctagcccataaagcattgaaaaaccctggtatttaatgctctcagatatcttaagaattgtgtcttgaagccttactttatcagatctggattatcttaatcaacaaaacctcacttaatcgcatctttaatatacaggcttaagacagcaaaatgaagaattcaagtcttccaagttaacattacttccctgcagcctatagctcttgctgcttctgctgttggagagcactttgcctcagggccatgcagcaccctatgtctatgactcagatatctttctggacacagtgaagtttctcggaaaatatttttaatacttcaataattttcttgaactgtgaaacccattgtgtgctaccattgtagttgattgttgcttccgggtttcctgcttggtctccgatcagagaaggtgggagtggtgagcagagcttgacaatgcaccatcctctggagctgagctacctgcgtgagagctctaaaagcccaacatgtggcttctgccacctgagatggctgcagcagacacggcagcctccagtagatgctccgtgaaaaccatcaaataagtagtgaaggtctttgaattgctggatggctgccattttctttctcctaggtggggctattctaagtacagcttgccgcctctggccctgggagggaccacactgcctgagtagagaatttggaaagcatcacatacattagcgttttcaagtttcctctttgatgtgttgtccgttgcacatgtaatacacagacacagagtggttacaagcgcaaaatgctttgctttctgattcaggggcattgtctgtaacacttggagacctgtgctgtagaggagcagactctgacagaactgcactccccccccccatacacatacacacacacacacacacacacacacacacacacacacacacaccacttccaggcagttgattcaagctttctaagcctctgtttataaggtaaatggctgtgttttccctttggaggactgagccatgctgacatgagacaaggagggaagtatgccattcactctgtggtcttctgcaggaccagtggggagaacattagtgctgccttcagttcagtcacctctcatttcacaggtggatggctgtaggaagccaacattcataaatcagcgggtaccctattggtaggtgtttctaagctatgatcgaagagcggaagacctcgtttaagacttcccatctgctcttctagatttgccataacagagagattggaaaatgggttgtaatagagcaagacaagagatgaaatcaccatctgtcatgcatgctgagggaagggctctctccagaagacttttaagtttgctaagtcctgatcatcttcctatactatatattgcataatcaagtatttatctggagagcttagaaatttaatttttttcaatgtgaagcatcttgtcttagaatcacacattgtactataaaacagtgcagtttatttcatttcacacatttaactaatacgatgtcggcacagttactaaaaaaaggaatataactggtcgtttttaattgtcacttataagtcattggaagttattgatgatccctgcgggtatacaacttccgagtaactgtggtgacgaatgtagtaaacacgtaatgaaaggcctttgcagttagaccctgacctgacctgacctgacctgagcacatagtttccactgttcagcttcctagaagcccagctcccagacgtaaaaataccttccattctcaagcaagtcaggttagtttacatctgacaccttacctacaccccttatgacaattttagtctgtatgtccaagcatctgtgaagtagccaaagaattatctagcacttgtaataatcacaaatataaataaaagaaaaatgatctcaaaaggtgcacatgaccccaagagaccctggagacagcatttaacttctggtgaactaatttcttattgtacccaggtttttaaaataccttcaagtacacattttatcttccatctcttctaccatgaagatactttaaatttctgaaaaagcaattaataatggcaccccagtgtgttgggcaatgaactaagtctggcattggtcctgtgagttgtttgtgtattgttttgtgtcacggtgacctgagtggtgactcttccatttaaggaatctgaggtttgagaggttctacaactattctgggactgcacaaccaaagggcctcaggcaggcttttgtctaacttttatcctgccaagaagagttgtattgaaaattactgacgtgttccatggcaaataggtagaattgttagaagctgagagtactgggtggttttttttttaaatggcagctgctatcctgtgtgcctagtgtctactttgtggtggtttcctttagtatctttagcatcaaggcataacgtgctctcatgaactgacgtgtaaaggttgagaatagttgggaatttttattttataaataccaattgctgtttaatttaagatataaccatttaaacattatgcaacattaggcaaatattcttgtattgataacagctagttataccacttaagagctctgtttaatgatttggtctaagttaaagtttgttcaccatgctttataaaattgttgtcaagtgtcttttttgtgataatgatggtggtagtggtggtggtggtggtgttagtggtagtagtggtagtaatggtgatagtggtagtggtggtgttggtgatgatggaatttgcagtggtgggattcactgcatgcagcatgcctggcccatcacacacacctttatatagctcagttctttggatttttttttttaagaaaccaaactgaacattaaaactatgaacataaagtgtaacacagtatgagacagacactgacaaaagagataccaaccaaaattaatactccagaccaatagatgccttgtttcttagtggaatagtccagaaaaaaagaaaaaagaggtggtggtgatgaaaaccctaataaaagaaatcagcagcccaacccacacaaaagtatagccaggaagcttcctccagggcagtcaggacagatggacacatgaacaatgggattttcattgcaggaggcacctgggctccattgtgagcacagcaaagaggatagggacacaggtgagagattcctaacaggtacagtggatctgtctgaactggttgtcattttgacaagatatcagaatatcaggtgggaatgagcagagacccctcatctgtgactttaggggtgataggcaaggaaccctaaagtggagaggtgctggcaaggtggacaggaagcagagatgaggatggggccccttgtcactggcaaggcagaatcctgatgagcttccttcccgatgattgtggcatcatcttgtcagtgaagcccaagtgactgagctgtgagggatccagctccatggtgatggagcagcaaacatggagccccagagccagtgtcagggacctcctccatggcattgcttagcaaacaggacactgtcattgcattgaaaatgatccaatagagtctggggccctatcacaaagttctttaaatgaaacaaagcaaaggattttctccccacagttactaatgaagttggagccgatcaaacatgtgactctcctgccaagtgctggttatcacgtcaggtgctgtcatgcttgtcatcccatttgcctgtctgtcctacatcttagagagaaggagatgctgggaacacccatcctgcatctctgttcagttcaagatcccagcccagttctgctttccagtgctttaaatatgagatgtgtgtggagagggagtgttacagtaaatgggcagactacatgaactgtgctcacaggtggaatcgttacgcatttcttccataagtgtatggaaactcactaggggcaaaggcagcctagtggtaataaatcaattgccactgtcagttccctgtttaatgttcttgagaatacatgagatttatcaccgaggccttgtagaataacggcagagtatgaaaacagagtccaccagggagatgtacgacatcatttggatttagcgctgccatctgcttaatagtgctgagaaagattgcagtagtacttatgatcagccattcagagcactgacagatgctacgctgggtaagcatactgggaaggagttccttaccaccgtggactgtgtgctgggccggctgagcagagcatgtgttggtttctaaccccaactttaaaccttcactgtacaatttaaaggtctgcttaccagatctttccctgtctgctttctgtatttcatacggccttaaaaggtgcttatattgatttgtaaagttttcctaataagttttacatatacatatgatcttttttaaagcaaagtttatgtttacttggttaaagcagggggtgccatgtagcaggattttttaaagaggagggaggaagggtgagagggagggactgaaaaaggacatcatgcattctcaggacaggctgtggcatgagcccctcaagagtcacccatggatccgtgtaatcactttaggactgaaagaaagtgttaacctttgaagtaatttttgactctttcaactgaacatgaaggcttggtaaagaaaacagtgcctgtgaattagagtaagcctagatttaattctagctcctctactcccctatgctatgtgaatctggccaggaacagaaattcattgagtcttctcataaaagtgcttcagtagaacttattgtggctgtttaatgaagtagtgcatgcagtgtgggaggcagtgccccagtgagtcactgtagcctcctgcagtagacagcacacactgctgggggcccctcaccatttcctaggaggggagcaaacagggtgtttagaccgtagggacctttttccatacatatcctttgacagcctttcctcttgatacaagaaataagcagtctgaatggatgatgcattgcctttgtggtcccctaagacatggctgaaaactgtcatggattagattgttagcattcttacatctgccattaagcctgtggtcagtgcttaatgagttagaaaaatcagtcagtgtctgaattcttcacaatgtattgaaacctcattgattaaacagtgtttgatgcactgcgtctataattcattgggaagggattttcctgttaagagagtggtgtttgtagctgtgcctggattttcagtgccacagtgatcactccccagtaggagctctatgagaaagatgggggcaggatttctgagagcatccaggtaaagaggatttgatgccggatctagtttcccacttgctctattaagacagtgtgctatacttaccttcagtgagtaatgcaatctggggtgaagtttctttgggacatgttggactggggatgtaggtggaagggtcacacattaaatacttgataggaaatattttacatttaatagctcaccacatagcttgtagctattgttctatcccagttactgccattaattaattaatgtttaaggaagtgggctatagttttattttttggcatcttcttttgttagtgtaccacggtatacgttctcagcagtagagaaggtcaggtaggatagaacgagtagtgaagcagaagtgtgtatacataggaatcacacaccccactgccaagcagccatttgtgttcctttcttgaatctctacatccttatctacaaaatgggaaaaactactgccagcaccaacctcatatagtagtgtggggctcagcagagaatttataattaatctgtgtagtgtaaaacagggcaatatggcacttttgtgcttaaatatgtttaattatatacatatataatattattttatatatttatatatatatataatatcctattatatatataattatatcttatcttccttctgacacgtgtatgtgtttgcctgtgcttactggcgagctgctcagactgcctccctggtcatcctccatacactttcccggtattacttggtgtgtggtatacatataaaagcagtaatggtctctattttgtgctacttatttcctgtcctgatgtttttatttggtattctatagaagaccaggaactaatggacatcagaaaccacaggattaatcaccaagactcccttgtctttcataatctgtcatttagaagcactgctgcacctcaggaacctgaattcatgttgattgttgaagttaagatagagtcactcgctccacttgcagtcttctgaaaagatcaacaagaagtattgctgatgctcttaagtattgtcgagtttagagacataagttgtattgtttgtaactatgttctatgatctgataagaatgttttacacatagaagaaaaaattatgcatataagcttaaaccaagtagtagagataaaagtgtctcaggtaaggctgaatcaagactttattgagtgtttttcctatcttggctagtatgtctgcctggattttaatcgctaacctactgtttactcactgtgcctggttgggctgtgtaacctgtgctgtgtgattagaacagcagctatctgttgggatagttcctgtgtaaaagcagtgtagcttcaggaagaattgctgagagacacatgtacatactcaaaacataatttggcaggaggtttgttgaatggatgacatctaagtctgtgtctgctggtacagttttctttattgggaacaggaagaaatgtcatggaaagtgtgaacactctgtgcgctccacctgctcacacagaagcctgtgtagcaattacagagcttgtgtctgagcacacagctctttcttatcttccaatcaggtcttggtgtgtaggttagttatctgtaggtttgtttttgtttttctttaattttacagaacctttccacaaacagctatggttgaaggcccctcctgctgactagtaagcactgtacaaatggggttgtgcacatattgaaagaacttggcacaatctagcagatagttgctaggtaaatatttgttcctccaaagaaattaatttctgccatgtctctagcatcatcttttcatttgttcatcagatttccacaattcttactatgcctaaaattgtccaggatgctcaggaggagttgatgagcaaaatgcataatactctccccgaacgcctacgttctgatggtgacaattataagtgagttaggcatgtttcgatattgtcaagaagattgattgaagatttgaaagcaattccagagcttgtctgcatgaagggcatctgtgagaacaggagtctgtgtgagaagagttgtctgtgcaaaagaccaggaatgcagggctgcatcgattctgccgtccgaagtgctatggttctcttgtttgaactcaggattccaaaatcttctcaatagaaagtgttacttttttttttttttgagatatttctaagcaatttggtataagaacttttcaagactgtgttacattaattttctacctaaacttaatagcaataaaattgaaatagcttacacatttaaacctttgaagttagtcaggtggcagaggcagatgagttctaggccaaccaggtctccacagaaagtccccgtccatccatactgagactgtgtctcaaaaagacttatataaagctaaccaaaggctatggggctagagaaatggcttcaggttctgctcttgaagaaaccaagtttgtgagtacaagttctgtccccagcacccatattgggtacctcataactgcttataaattcactttcaagggatccaatgccctgttatgatttccaaagggacctaaccacatacagacacatacgtaaacccataattaaattttaaattaaattaactttggaggtaatagaagagtgttgtttggacaaccaacatatcatctgtggcagcaactgtgtttagtagattactagctgtctaaggtgtgcaggctctagtcccccaaattggcaggtatgtcacttcacactgcaagtgggactgtgtttatatattaatgtaaagaattgagttgagcaaatatctgggggtttatcataatcacccagcagaaaagagagaatgtgtagctatggaagaaagacaacagtgaatcaacagtgctgactatgaaggtcaaagaagtggctacaaacagatattgcatgttagctgctttgtttgtcatattctcctgtagaaaccaaacagaaatacaatcaacacacagaccaaggagtgccctttgcagctgtagctgtttctaactttccagttctttctcataaaacattcagccatcaattaaatttgtaagaaaaggaaatataataatcaagaggttgttagtcgccaacctttatatacttaataagtaaggctataaaagaaaatagcaaatataaaatttaaaagatattgaatgatactatcaaacccttagactaatacacatttaaacctttgaagttagtcgggtggcagaggataacagattgcctctacattcacaaacaaaacaaaacaaacaactatattattcccaagttgagatagaatttccatcaacacataatagtctgtgtattaaaataagattcatcaagtttttgtaaaagaaagcaataaggtaatgggaagaagacaagaagaatccaaaacaattctagtgtcagatagtaagaaaatgccagcagcaaggatgggcatgtatcaaagctacacaagacttaactgaagagcatgcagtgctccacccaaccccaccccaccccaccccccaaaagctaaggaactggagcaggacaacatatacgatttgattgttagtgtcagtcatgatattaaacacacagtcctgaacaccttaatcccacatatcaatacctatttgggtcaaaatctccccacatcacagtcctgaaagtttaaaattcgggataatgagattctaaaagataaaatccagaaaccacaattttcaacaaaaagggctatagggaaaggctggaaacacccatttgggtgagaaattagtatactttgcattgttgcagtccaaatgcctccaaatcagccaaccagccaaccagagaattcaaccaagcttagtgatcttctgggctccagattatctggggtttcagggcacactaaacaatgagcaagccttggctagagatataatgtcttacatttcccacttagaaacaaaaaggatgggcttttctttctcctcctcctcctcctcctcctcctcctcctcctcctcttcctcctcctcttcttcttcttcttcttcttcttcttcttcttcttcttcttcttcttcttcttcttcttcttcttcttcttccttctcctccttcttctcattttcttcttcttcttcttcctcctctttcccctcctcttcctttccattctccctcttccctcctccctacttctttttcttctttttcttttttcttctttcatttttgccttgaccattgagtaacacttttataactgctccagttctcaagttttaaggggtgttgagattaccacaccctaaagattctagaactgatcctcttagttatgtatccataactataaaaaccaaagtactttgtaaacattatttgaaggtggtgaagctagcagaaggaaaaggatttcagctgaatctccaaaccacaatgagaaattttcaattaggtgggattagggccttctgagaacaactctcaagatagttccagtaatatttctacctattgattctggtatatttgatggagaacacagattttggaatagctacatgatgggacaggatgaagacttctttttgtatgtgagttcttcatttgtgctcatattcttaccagcagatgaaatctgggaagtgtaacattaagaggggaatgacttctgggaaatgactcatcccagaaagacagaaaacacatgttcttttctcaacggcagatccaggaacttagcatgaatgaaaactgtttgcctgaagaaactagcacagctactgattaattaaaagtgtgtatacaaagaacagaaagatgtacgtcagcatcactaatgaagctctgctatatgtgtggtctgtgcataagctaaaaggatggacagctacatgtgacagaacatgtaggagcacagcacagactgggaattctgataggggatgtgataccagcaagaataccaaaaggaaactccagtcagataacttgccagcaatcccatcaggctttgagagaatccagtctgatgttatgcagttcttgaggacatggaggagtcaggacaggtttctagcttattttctgaagccactgtaccaaacctgaccctcacatcagaaagaggcattacaaaaaaagataaacccaaataactataggtagtagtcactttttttaatatttttattaggtattttcctcatttacatttccaatactatcccaaaagtctcccataccctctgccccactcccctacccacccgctcccactttctggccctggcattcctctgtactggggcatataaagtttgcaagtccaatgggcctctctttccagtgatggccgactaggccatcttttgatacatatgcagctagagtcaagagctccggggtactggttagttcataatgttgttccacctatagggttgcagatacctttagctccttgggtactttctctagctcctctattgggggccctgtgataaatccaatagctgactgtgagcatccatttctgtgtttactaggccccagcatagtctcacaagagacagctatatctgggtcctttcagcaaaatcttgctagtgtgtacaatggtgccagcgtttggaagctgattatgagatggatccccggatatggcagtctctagatggtccatcctttcatcacagttccaaactttgtctctgtaactccttccatgggtgttttgttcccaattctaagaaggggcaaagtgtccaaacttttgtcttcgctcttcttgagtttcatgcatttagcaaattgtattttatatcttgggtatcctaagttttgggctaatatccacttatcagtgagtacatattgtgtgagttcctttgtgattgggttacctcactcaggatgatgccctccaggtccaaccatttgcctaggaatttcataaattcattctttttaatagctgagtagtactccattgtgtaaatgtatcacattttctgtatccattcttctgttgaggggcatctgggttctttccagcttctggctattatatataaggctgctatgaacatagtggagcatgtgtccttcttaacggttgggacctcttctggatatatgcccaggagaggtattgctggatcctccagtagtactatgtccaattttctgaggaaccgccagactgatttccagagtggttgtacaagcttgcaatcccaccaacaatggaggagtgttcctctttctccacatcctcgccagcatcttctgtcatctgaatttttgatcttagccattttgactggtgtgaggtagaagctcagggttgttttgatttgcatttccctgatgattaaggatgttgaacatttttttaggtgcttctctgccattcggtattcctcaggtgagaattctttgttcagctctgagccccatttttaatggggttatttgatttttctggagcctaccttcttgagttctttatatatattggatattagtcccctatctgatttaggataggtaaagatcctttcccaatctgttggtggtctttttgtcttgttgacggtatcttttgccttgcagaagctttgcaactttatgaggtcccatttattgattctcgatcttactacacaagccattgctgttctattcaggaacttttcccctgtacccatatcgtctaggcttttccctactttctcctctataagtttcagtgtctctcgttttatgtggagttccttaatccacttagatttgaccttagtacaaggagattggaatggatcaatttggttttatcctaggatgaatgggatgcagggatggttcaatatacggaaatccatcaacgtaatcctgtatataaacaaactcaaagacaaaaaccacatgatcatctcgttagatgctgaaaaagcatttgacaaagtccaacacccattcatgataaaagtcttggaaagatcaggaattcaaggcacatacctaaccatgataaaagcaatctacagcaaaccagtagccaacatcaaagtaaatggtgagaagcttgaagcaatcccactaaaatcagggactagacaaggctgtccactctctccctacctattcaacattgtacttgaagtcctagccagagcaattagacaacaaaaggagatcaaggggatacaaattggaaaggaagaagtcaaaatatcactttttgcagatgatatgatagtatatataagtgaccctaaaaattccaccagagaactcctaagcctgataaacagcttcaatgaagtagctggatataaaattaactcaaacaagtcaatggcctttctctacacaaaggacaaacaggctgagtaaaaaattagggaaacaacacccttctcaatagtcacaaataatataaaataccttggtgtgcctctaactaaggaagtgaaagatctgtatgataagtacttcaagtctctgaagaaagaaattaaagaagatctcagaaaatggaaagatctcccatgctcatggattggcaggatcaacattgtaaaaatggctatcttgccaaagcaatctacagattcaatgcaatccccatcaaaattccaattcaattcttcaacgaattataaagagcaatctgcaaattcatctaggatagcaaaaactcttcttaaggataaaagaacctctggtggaattaccatgcctgacctaaagctttactacagagcaattgtgataaaagctgcatggtactggtatagcgacagataagtagaccaatggaacagaattgaagacccagagatgagcccacacacctatggtcacttgatctttgacaagggagctaaaaccattcagtggaaaaaagacagcattttcaacatatggtgctggcacatctggtggtagtcacttatacatgacaacttgcataggtagttagttacttatgcatgtaaacttcatttgccaaaatatcaaatcaagtctagtagtgtatgaagacaaaggtttatctttgtaaacaaattaacctcattactgaaagagttgaataaaatgagactcctatacttccccacagtaaataatcacatgatcatttccacagatggtaaagtctacttgacccaacttggtgttcattgacaatgccatgtagaaatgaggacaaataagaattaaaaggtaattgccattagcttgataaaatttgtttccaagtaaaaaatgtaagttatttttttaaaaaccagcaaaatgaaatattatatatgcaataccttctcctttcctgccaaatacaatgaaaatatggcaattgttccctgtggtgctgagagccttccagcatggtgaggacaggagaaagtagacatgttgggaactaaaaagggggtgccctgggaaaaggggggaaggggaagacctgcaccctaccagagtttcacctatgctctggtcagtcaggcgtgagagggctgctatctaccttccactcatccccgggtaagcctctgacccactcttctgggggtggcaaaggggcagcctttcctaggagccccagagctactttgctaaagccattggggttatgggcaaaagagaggagggaagaaaggtttccaacacctgcaagagtgagtgcagcagatctagatgagcagagactctctatagttttagagctttattgtagaaaggcagcggaaagagagaaggtagaaaagagagagaggaaaggctagagagaaagagagtaagaggaaaagaagagaggagaagacaaggagagaggagacggtgagaatgaggggtaagagggagacaagtaagagagtaagaagtataagaaagcaaggtggggctgaacagccctttttatggtctttactgttgctagataactgaggagggaatgagtttagcctttaggtcagaagcttgggccttagccatgcttctcttgtgggggctgtggggggtggtaacttaggcaggggccagagttccaggagcataagggaacacctaccttgtcatgaaggtgaattaccacccttcggggttcagacctcagctcaactgaagaccagcctgactgtgcatagcccaatgtcccacatagatacacagactagagcagaccagactggaaaggatggcctaattgccaaggccgtgcctgactgaaattactaaaagttttgttgaaaagttactggaactgaccattaatttggttgtataatacaaagtatacaagttacatatttctgtgtatcaacaattcatatcttagcacttcaaagaaagcaaattagcagcaccaaaaactaaatcttagaaatggtttttaaacatattcttcattaatttatgtgtgtgggtgttttgcttacaggtttgtctgtgtatcacatgaatgcttagagaccaccagaggccagatatggatggtggatgtcctgggactggaattatagatggttgtgagccaccatgtgggtgctaggaattgaacctgggactcctggaatagcagccagtgcttttaactcttgactattttttcagccctaaacttttaaaataacttttaaatactttttaattttcattgaatgtattcagtgtacatggttggctacttaaggacattttcatgcaagtataggtcatgcatggagcgtattcttttaacatgacataaaactcagtatttaagttgaaattgtggttatctttattatatgtacagtttctgagtcactggaacatttttatccctccaattatctcctttatacctgtttttcatatccctttcacagcctcggccccagacagcctcttatgtcttactcttatgtctgtagttttcactcctctgaatgttccatacacacataaccacacccactgtgtgatcttatacatggcacacttgcaggaattgctttttttcttcttctgagtaataggccatattattggtatatcactttggcctacccatttaatagtggttagcagtctgggccccgtgcttgctgtcattggataatgctaccgtgatcatctctgctcaggtctttgtgtggacttgtttgtagataacagaggcattgaaatcactacattaaaggatgatttgtgtttaacctttgaagaagctttccaggcattgacatgcacagtggtggtacatgcttgcgagccccagtatatgggtgagtaagtcaggaagattacaagttcaaagatgggccacactgaatagagattttgaaatgtttgtgttatatagggagtcatacttttgaaagagggaggaagagacaggagcccggttgttttcaaagtgggagtgctgtttagaattctcactgggaatatggcaagcttcttagggataggcttggtaaaacttcaccttgttctgtactgacagtcattaacattgattgcagagtataatggcatctattaaatggagataactcatgggcttggattttaagagaagatattatttcatgtcaaccccctctgctatctgtaaaatcattacatcaaaactgcaggctactttgtggtttttctaacagagcagatagaaggattgacagtaaaaacacattcagagattgaccagtgagccagcggaaaactgtgaacacgctataagacattgataaagatctcagtgccaagagtgcacccaccacccactgcacattgatgtagataactaacacaactggaaatacaaacaaatagacttggtacacattcaaccttgatctcctttatgccacagagggcacgtgcaggccctccctcagctcctctgatgttgcctcaaaaatgatttcatggttttggaacttgagcatatactctgttcatcttgtgaagctcaatcttaacccatcaagctcctgctcctccagatggagtcttgaaccctgtcccatgctctcctcctctgaggtccacatgccacatttctccaccttgcgtctttttgttgcttctacctagaaaatcctgtgtggggcttgactgctgtgtgcagaaaggtcagttgtaggtactggctctgccattggctgtggccacgagctgctgggcagtgttcctctgaatccatatatttaactgctgggatggtagaacagttcatcttttcctgcacatgaagggagtggcagtgagttgcagcaagtataagaccatattcactcttgttattattaggtctgtgtcataatgtagaaacacttcactctcaggcatcactgcatgttggctgaatagatcatgtgatggtagtatttccagggagagaatactgctatgatactgtcaacagtgtctctgagcaacctttctgtttcacttagagtttgtagcactctcaagaaaaatgaacgttgccaaacattgttcctaatgagaaagatgaactttgcctaaatgttcacaaagaaaactgaagcctgggttcttcctttacctttcaagcctgttttgtggtaactgttcccttgatctcttcttcggatgtgggtacagtaagatggaaaacatcagtttaagatgaagacccggttgtgtaggatgtccacatggcattgcctagcatcacagtagtgatgtctgtggtctgtgaaactcacagagggcacattgctagatttctgtgtaggggtcaccagtggtacttggcagtgggggtccttagcaaccaaggattgttatccttttacatgcttttttcctggtaatctaggaaaacataatttttccaattatatgacttgatctgcatcctttaggtagagagtacaggactcttctgtcccagtaggaagggtgcctgtggtctctcggtcaggactgaggcatacccatacccttctctcagatcttttgagctgtgttaccatgaatcagcacaataaggttttgtttatttatttatgaagcagagtggaaagcagttcctggctagtgagaggacgttttgaatcttgaagtctaggcttcagatattcttgtccatccctcttcgaggcaaatcagccttccgttaggatgcttcctggaagctcccctccttgtgttttcctgtctccataactacttcctctataacaggagccaagtagctgaggactgggcagatgtgttatcactggctcccatccgcagtccctagttcagctgtcaggagttcactgatgaggaagaggaagtgcaggtgcagagctgactctggttaaagagcactggtcggtcatggaagtggcacagacacagtgtcagcaaccacacagcagcttacagccgtctataaccccaggaaattcgatgccctcttttagcccccaaaggttccaggcacatatgtaatacacatatatacatgcaagcaggatattcattctagtatagtaaaaacaaacctttcaataaagaaaaaaaaatgcatgttaacaggcagcctatcttgctggttttctcccttgacatataaatgaacttatctcatttgctaagatagaaaagttctcagagcaaaggagtgtatacctatctgaaaggagtgtatacctatctgaaagaagcaattgagggcctggtttcatgggtatgtgacccagagggggctgcttcttgcaccttggatgtgtctctggctttttctgatagatttgatcatgagatttttaattccagtaatctcctttgtcagctgaagtgacatgccttctttctaaagcactcagatgtatcacagattagactgccatgactgatggttaaattagatgttggtgaaaagcaagtcagagtagctgggctttttcccaacttgtggtagccttgccacaggccgtgaatagatcactttgtgtctctgaaactgcttcctcatcctcggtcagattgtaagtctttagctagcatgctttttccctctttgtctagcttgtttattactttgccaatgcagacctttcttcttcttcctagaaatctttctgtgtctcctagaactgcttgggcaaccttcccttccgtgatctccacaactctgagctgtccgtgctttacagcaccgcactgggcatacccacttgtttgatttgtatgggggactagacgttagacacatttcatctcaaagacagagttgtatttgctgctgcattcccaaggtaggcacatagtaggtgctatgtatcaattcaacgagcttggaataaagaggatgctgaagagccataaagaacatctctcacagcctagtgtcccaagtggtagtttgaaaggtgttgctttcaaacgagatttatacaatgaaatagccaaatcactgggaacagccgtgtgtatagaagacctagcacagtgcaccatcttccatgactacaccacattccacatgtatgagttatgttcctgtttctgtcataaaataccctgacaaaagcaacgtgtaggttactctgtctcattgtttggggggaaggcacagcagctgaccacaggacaaccacagtcaggaaatagagaatgatgggtgtggatgctagcttgcctttgtattcattcctgaccccatcccagtggaatgtcactgccttcattgacgctcagtcttttcactctggctaacctagtttgcaggctgtctcacagctgtgtcagcagggttgtctctggggtgattctagatcatttcagacagttgtggttacagagggtcctccattaagataggagccgtggacacaggcatcttgatgttctctgaggcatgtgtcttgcagtgtgtaagctggttctttggtccctgtggtgaacagaggagaggaaaaacgatttggaggctctctggggagatgaactttaaatggaaagtgaaaccttctagcattggagtgtgttgctgtaacaaatgatccaggcttaatatctgcgagtctttgaaaataatcatttctattcactgatttaagatggtgtagcctgaatgcccgtggccacatgaccctcctagatcaatttcttctctctgatttgacaatgcactagccagcatgttcatatcatttatagcgcaggtgacacttaaagtgtttcccagtagaaaggggctgtaggaggcaactggtatctttgattggcatttaaaacatttttattagacaaagtgattattacatctgaaatgaggctttacaaccttaattataacaatcaggttaggaacaacagccggcatttattttgtatataatggcaggccagtgaaagtactttgcatgtgtgaactctaattactccccgttcgtcatcagcctgtcatctgagccacagctgcagtggtaacttatgaagcattattacaagccactttcttcatttaagcatccttcctttctgtccttgattgagcatgttttatgtctgagacacttctagaagttgactctccgaagatggagctgcctacgcagaatggtgctgcttccaacggggagaacaggatccagtcccgacagagactttaagccaaaccctggcaatgcagtgcaatgcagtgctccataatgatcgcctttgctcctgagtgctttacacctaataataaaacagccatacttcatcctcccgcagctgtgtgaaacaggtagctgtgagatgggcaggcgctggtctgaagcatagcagaacagcaatgaccagcatggactttggggattcccgtgggctccaggagcatgtgctctaaccacggcccatccccttccacttgtcaggctcatgacagctttatccaagtatacctactcatttgcaactgtaaggcacaatttatagaaactctaaacaagattgggaaaggctaacagtatccctggggtctggctactatgatggagtagtcatgggcagaaacagcttttggggtccctgtgtctacacatatagtggtagtaggatcactccatgtgatgtgggaccaacgccagcacatgtagtaccttggggagtgtatgggctaaaccctggggtaggaaagcttgtgcaggagggcatcctgctgccatttgcaccttgtctgagttaggaccctagactagacttctgggcattctggggaagtgtctggaaagtcaggtattactaagttggggaatataagactctgagcttattcattgacagggatcttcagtctcgtcctggctctcaaagtttcatctatcaaatccacattttctagtttgtgaactagggattgaacttaaaagaattttgaagtatagtgtgtgtgtgtctgtctgtttgcgtgcatgcatgtgtgcatgtgtgtgtgtgtgtgtgtgtgtgtgtgtgtgtgtgtgtatctctgtgtatctctgtgtgtgtcagtaagtgtgtcagtgtctctgtgtgcctatatctatttggatatattcaggtgagtgcaggtacccaaggaagccaaaagaggttcagctctcttggaactggatgcacagggagctgtgatcccttcacgtgggttctggtgactgagcctgtgtcctgtgtcagtgtggcaagtacccctacacactgagccccctccccagccctggtcagttcctaaagtggagtaataactcaacaacttaagaaaagtggacttttttcatagaaattcatggtatataaactgactttaatgccatgttaaaatttatattttaatacctctcagctttataaaataaaattactactaaatatttcaatataatcagttgaatattttaaagactttatttgcatgtaaattatatgtttgtgtatatgtgaatatgtgcgcatgggtgcaggtacccatggagacctaaagaaggtaatggatcccctggggtgggagctgttagcctttcccagtctctacccaatatgggaaccaaactcaggtcctttgcaagaacagtatgttataaccactggtcatcggatcatctctccaaccaactctgtgtgtgtgtgtgtgtgtgtgtgtgtgtgtgtgtgtgtgtatccagttactacgtagtattgaaagagaaggatttttctcatctgtcattttccattatattgtaaaatgagtaaaacagattaaatatcataatggttttaagttccttattcttatttttggagtataagagtaagttctttaaaagttcatcttttaaagagccatttaaaagatgtgatgtaacagtaagaatgaaatttagtgataggctgcttgcctaacatgcccaagttacctacttcttatttatcacttttaccaaattttattttgtatcttaagaagaacattaaaattgtttgacagtttcttttaccccccacaccccctatcagtcccacagtggatgttctgagcgatgtgatatctcccagccagatttaacagttctgaaaggtgtgtaattcaggaaactggaccttcaattttcctgacctgatagggctactgcaccattctcatagagtcagggggatttcctgattagcctataaatttgtcctggccttttcaattgaatgttatttaaattgctggcacacagtggaaatgctgtagattctgttttagactggaaataaagagagcttgcaggaaagcaagaatcctgttccccatgcagatgtattatgctgatggtgtactcttgtctgttacgtgtacagaagcattacgacgataaaaaacaatgtgcctttcctaattagaaaggacttcatggctaacagtgctcagactcagtgacttgcaggttttttttcaaggcagagtgtggtttgctggtactgtcttaattattgctaaagcactatgagtttacccacatggtttggtgtcaatgtcagcagggtggaaaagacaaatagcatctcgagtttttattattgtgacaacatttttacttcatgaatcctgggggttctcaggacacacactgaaagctgaggctctgagccatttaaaagatgtaacagtagtctgtgggagaaagacggatcatccctgggtcaggcagcaccagggtggggcaatttgtctaaattgtgttctacatgtgcacacttctcaagaaatggattgtcctctcaggctgagctagtctgtcaccgggagcagtgggaatcctccactatagagggatagcattcccccatctcacttgaacgtagctctaagtaaggccagttcgatctccttccccacagtaggtgccattagccctgaggtgcagggtccctgtgggaatgcaggtgagcggagagccaggaaaggccaagaggcagcatagctggggtgagcaggccggcctgacttcacttagagccacttccatcaattgttacaacctgattttgtggctttttatccaatgtcctcctgaggaaataccattaaatattatgaaagaactcttaggtaaggaaggctcttattgaaagtagattgaaatattttttagctatttacccttaaggaatttcaaatcttcacttatctgtgataatggaaaaataagaatactcccaaaatttcatttgaaatattacttttcatttattctgctttatctatagaaattctccattattattgtaaggattaatgactcttagtagaacagaaatactgatcagggaagttgctctagatcaattgcctatgtcacataataagaatttaccaagtattagcttaaatcttattatttgatgataatatattcagaaagattttccttaaagagacgaattgaataattggaaaatcagccttgtaaactctatcccaaagatgtagtccttagtcatctgacctcgaaagggcagtcagcagtgctactgcccaaagctgtcagaacaacaggaacaaggaatagttacagcgttcactgagatttcattggggtacagatcacttccagtccccatgctcttgtccaactgccgggaaccctgattctagagttctgacgtatgatgtagtcacggggagcagtgtgatggcaaggcatatgtcacctgtcacattgttctgatgattaaacagtgtgccccccttcacagacttgcagaattaggactcaaaggattagtaaattaaacggaataaaaagaaaaacacagagctgaatcaaaatatacatctcttccacccaccacccaggctttcttgaatcttaccccatgaactctcaggaagtcttagaaggtccccaaagaaagagtgaggaaacagataaacccatggggtggggcaaggggcagcaaaaccatatttaagagaaggtactataaagagtgagcatctggggaagagccctcgcacaggcagccagggttgagggagtcgtctctgctgcttccaagagctgcttctgaagcagtgtctgcctggcttggtctccggtgcccaccagtgccgagcagtagtgtctgcataaggcctggcagcaccatgctccaggagaaccatgacagctccccccaacagataagcgatctgaatatctagcactctgacccctttctagcacaagaaagtattttaagtaagggtgtgtgagtgagtatgtgcatgtgtgtagatgggtgttttattgacagacaagcaagctgagagtctgagaagcaagaattcttgcattgccaacatttgcaaagcttttttgaaacaccagactcagcatactaaaaatggcataccttgagagaataattctcatagaatggatgattttgtaattaatatccatgtggataagaagacatgccccataatggccaaaccagctctgaagtgggatggaaatggtaaagctaaaaaaagtattaggaaaaaaaaaaaaaaagatacaaaggccaagagatggatccagcctcgcacttcagaaggagcccagcagactacagagtaggaaagcacagtaaggggtatatagttgtcggctgacagcatctagggtcacctgcaaaatgggcctctctgggcatggtgttccatgtcactggggacctgcaaaatgggcctctctagggatgctgtcccatatcactttgaaatgggaagacccatcgtaatggtagaccagggactcaagactatatgagctgcacaaatggagctgagaattagcttgcatcaatccctgtttcctgactgctctgaccatgttgctatggtggaccatacatcctgaaccagaacccatatgaagcctttttcccttaaattgcccttgtcagtgtatttcatcacagcaacactgagaaagacactaaggcaagaacaagaatttttagaaagaagaaagaaagacttcttaagacaaaggtagtttttctactcgctgcaaagggcatgacagctgccaaagaagcaggctggccatgtgttctgtatgcagagaggaggtgaaaacctgctagcaacaagcaagctgtatgacactcagctagccaaagggtacttgccagactccacagctttgcaggtatgagggatgcagcctgctgtgagcatcgggctgacccaactgaccttccagcctcggtcttctcgtggtcattcctgcacagtaaggttaacctcagacagcgacacttttgaagaataaaaagaaattaatataatctacttcagaggtttgtggagcagagtccgatatatggtgtatataatatgattataaattaagtacatagttatatattaggcaccaatgccttccgtatagtaggtaaattaggaactggctttcaagagtccatccaagaaatactttgaagttcgaccccattcacctcttcctgctttcctcccgcactatcccccagctcctctcctccgtgttgaatagtcttcgctttcccttcccacctcagaagaggaagctgtgtgggcatccataggcctgtgctgctgacaggggcagattccacaccctgtttcttagtctgaattctcagctcagtgtctagcacacacaaaggtcccatttgtgatttttttgaatgcctgattctactcaggatctaattttattttgtcaagattcttctacacttacaaagtaacaagctttcagcctttctgtctcatcccctcagaacgggaggaggcaatagatgccccttgtttagcattaccactcataacattgtgtcttcccagattgtctgggtacgtagttttttttcaactataatgatatcattcattcattcactcattcagtatattaagcgaacagtcaatgagttgtaccttctctatcctggacgttgttctgcaggaagctgagccgtatcactgaaaagagcagacacacgtccctttctcatgggtcttgccttcatacttaactgaaaagaaatgggaaagaagtgttgtccatatcagttggagtgctgtgccctagagtgagacgaaggatcagtgttgccatggtgaggtgggctttagtactcttcctgtagccctggctggcatggtgcaagcatacttgaaggtgtggagccacacaggagtctccagactttttgttctcagcacgctagatagatttactctggctaagagttagtggcccttgggtgggcagattgaggttacagtgagttaagaaggctgatgtggtatggaggtcttttttcctttgcagtgtctgttagaagtttagatgttaagaggcagtcagcacaaaaatataaatcttagagggaacactgtaaaagatggtgtagaattgagaggcttgggtatttagattttactcaaagaagcgatgtaaaatcaccaagggggttggtaaataagaaaagaggacttgacatctgagctcagtgctccaacctgacagatctaacagggactgtcaggtttatggcaaagtgacaccagtggtagaaaagagccaagaagtactttgtcctccacagagccaaatgtttgaggggacagggggatggtgagatggcttcccaagactgccttgccctaccagaaacaaagggaggagaccacagaaagagcaccttaagaaacagaattatttaatgttttaatgacacggtcctcgggcatgccagggagatgattcattaaggggaaagaagaattctgaggacctccagagggaagcattacatatacagaccatgaaaccagtagacctcagggttggtgatctgctgggagatgttgtgcatatatgttaggggacatggtgctactgcagagattgtttgccgttcctcccagcttgggcttcaggccgtggacacgtagagaactatgggaaagagctgccccagtttccccttgtgaagagtttcagagactgagctgggggaaggatgaggtggttgaggcctgctgcaggggcatgtcaacgttgagggcttcctttgctgatacaaatagaagagtttagtaagattggctcagtgactctaaagtagaaatgagcagaaagatctaactgccaggtctaaggacagaggaagtgactgtcaagcattccttcttcactcagggtgatctgggaatggggccttggccttttggagtctatgtccactgcatgctccgcctgcttacgtctggaaggaggagagaggccatgagatattccagctggtgccctcaactccctcagaagaggtcagagaatcatgccatcttgtagtattcaggctcatttgttgatgtggatgatggaagcaagaaacgttctaaaagttttaagcatgagcgagctcattcctagtgaactgagaaaaggaagtaggtatagtggatggagctgttgtgaacttgcccatcatccccttactggtgccttctccaggcaggacctatgctgagagtctgagatcacatcactgggagcaggaggggagagagaggtctggggaggtgactaggagaagcccactcctaacttctgggtacgggaggcactaacctgtaccttctctgatggagcgtggactgtaaagcctcacggggttgtttgtttgtttgtcttggtttttttttctgtttgtttttattaatattgtatgctgggcctttaaatgggcttttcttagtgttcgcgtcccctctgcggtgccatgacttttagattagccatgggaaataggacacatctttggttaataggcatttgaggtacacgaaatgaaatgcagtggaagcaattctgatgaagctgacaggtaggagaatggggcacagctgctcctgcttcagagcctgatgacagtcgtgcaataaataatcagaaactgggtgaagtgacagcaatgtcaatttaaagttttcacttgtcaaaactaagattgtcttatcaccaaaccaacgttgggccaaattatggcgccttttattatcttcctgatgactggaaaatattcatgacctgaccccatgctgaggtgtgtgtttgtgtgtgtgtgtgtgtgtgtgtgtgtgtgtgtgtgtgtgcgtgctcctcacagataaattcccagcctgtatgggtggttattaccagtgacgtcatttaatgaaggagccagttgttacactcttggtttattagtctcagtgcctgtctgtcatgtctgctctctgctctgagataaccaattgggagttgtctggggaaaggaagccctttcagttttgtgaagggcagtctgagtttatctgtgcaccaattaaaaattttaagaaccatgatgtttatttgtttaaagggaccattataatattacctctgactctgaaaaagaaaaacaagactcatttcaatttagtttctcgatggtattatttgtccatttattcacaataaaataaggtgatcagactcatttgcagtcatattctatggctgctccttgaggaacactccaggatctagccagcccagcagaactgtcactcggccatatacatgggagtaacttcaccagggactctgcaggcagaggccagggttcagacacaggggtcctgactgatgttggacgacatcagcattgcctttaaacctctggctggtctgagtttgtgccattaagaggagaaaccttgtcatttaaagttatagtggtatatagaagagccttgttcgttctcttgcttgatgttgcattttgttgtctttctgggagtggaggtctatcactttttttccagctaattcttcttactgtaaatgttcattgtgccccagggaaacttaggcctacggaaggaggagagagagcagaagccagagaaaaaataatgctatgcacagttactgggactatgtgccatggtccctggggacccttacatctgggctgattgtgggaaggggtcaagtgaactctaggggagcaaaggtgtgtggagcagtgagcagctgtggaaaagaagtgagatgcctttgtcctgtgcatggccacagagccctgattgtaggtgctactgcaagcaagcagagcgcccctcagcttctccagggaggcccattgtcatatgacagtaaaagcagttttagattgggtgggatcatgcccaagaaaagctgccgctaagtcacctggtcaggttgtgtgtctatgtgtgtgtgtgtgtgtgtgtgtgtgtgtgtgtgtatgtgtgtgtgtctgtctctgtctctgtctctttctatctgtctgtctgtttttgtatatatctttcttcacatgtccctccatgcctgctgtcaagcctctggtataggccaggatgagaaatgatgacagtaacctaggatgggagcnnnnnnnnnnnnnnnnnnnnatgggagccagcttgattgtgaatgggggaacttctgtgacatttaggctcaaatttgagtagaaagtaggttagagggtgacagagcacctctaagcaggagtggtaacaggaagctgaatctcagtggaacagcacctccctgaggtctgaggggctgggtgacttcctggggcctgtagattgttaggtatattttacacaagaaaggaagcacagggtgaggggtaaggtatgggtatagcctgcagctaaggtctaggcgttagatagactgggctgtgctgttactggtgaggttgtaggctggttccctgacatccttacctgtaacttagattgacagatctctacctttgtcccagaacatgtgtacctaaacagccagcaaaagataccacactgctaaaggcatgaagtgcaacctaggctccactgtactcggtcataagaacttgaaataattgaaggtgctagtttcttgcaaaattggtgggaaagaaggcagcctcaggggatagataaatggaacctaacctcttcctcagaggttaggaattcatggttcggtatcccagcttctatctgtaaaaataaccagaaccatctacagttcaaaggtggtactactcttttcgtggcatctgcacagtcttggcgattgcaggctgtccttgctgtctcaaggacatggtagattagaacctaggcctgcctgtctgttaaaaagaccttgtaactcccctgggataattcatctgctctcctgttgcacattgtccaggcaccctgcctgaggtttttgccactcggatggtaatatagcaatgctgatggaaaaaagcagaagcttccaggcctccagcttaatagatgaataacgggccctcagccgtcatagtaccaacttctatggaaagtacacaggagtccaagaaactgtctcggtgttttggaaagactggtgctggctgcctcctaccccatcccccacagcacctgttgtgaacccagcctttgttgttggcatacagttctcagcctgtctctctgaggactcctcctgcctttcatgcactgtgggacaattggccagatagatgtgctctgaatgacagacccgggagttaagagtagagctttggatagtcaacaagtctgtcttctctcagtgttctgtcatctgaggaattaattccccttttgcccattgtattcttagtttatgtagttttgagtacttggttgggtatgatttaaccccacagcagtcacgtcttgtgctgacagtgttttcttttgttcgtgcagtgcagctgattactacgattatgggcatggactcagcgaggacgcttatgactcctatggtgagtggccgtaatagtacaagagagagggggtaagtggccatggacagaccttaaaagtcctgattggaagacagagccacacgtgtttaaatgatgaaatcattttgtgtgtggaccctcttcctcctcccattggctttgtggacacattgccatttccagaggatcatttaatagttaagtgaactatttaaagacagcgcgcttaggtgttttgtttgcgtcgatggccagtgctgaccttctcactgttttaacagagcaggctgccagactgctgacactggctgacatgggtcctttttgaagtagctttgcttcttgctagtaaaggagctgacgcctttgagattatagctcgcacccttctcccactcccatctttatattttaattcattcccaacctcaagacctcaggaaaattataccaagaatcagttcataaaggttataaaagctgagcctgggaggagacacgagggtctctcaggctcattaggaggtaactcctctttgttcagagggagcctataaaggtgctaggcagtccatgaccacagtctcaatatgcaaaagggcgacaggtttaattaacagaattgacggtggtagcgacaaaatgatagtaagaagtgcctttgccgcagggcagagggatcaggaagcctttgttggtggcagggcgccaagaatgcctagtgtcctgtgcacttgaggcaggatcctggggacttgactcttgacatttccctgaccttaaatgaaaacccattttctagtgcactttgaagtgcattttatatcccctgctaggggttggggtggccagatattggctgttttttattttcttttgtgggttgcttttttttttttaattcataactcttaagagagatgcattggcttggtgagtgctatctacttaagttcgtgtgagttggccagagggagtgacgttgattgcatgtttgtatcagaagaggtcattttaagcatttttctctcacagctttttaaattggtctctggggacacatggcttttcgattgctctgtgttacagcagggacttaactgtttgctgtctgagaactggggataccccatgaaagtcctgatactggacactgttgaatttcaggaggtaaaagtggtagagtgtctttgggtactgacagctgtccggcaggcgtgctgctcatgctgtggttgtcactgagggagtccacgctactgtgcctccctccttcagtccccgtggggagaacctggaatcagacttcggacttctctctgtctgccctttccactttggtttctggggtttggttttttttttctcacaaattattatttattgtttttgtctttgttgttggaagaaattagaatggtcctttttcattctcttcagagttttgttatagggtgttggattggctccaggagggaatttttcttggagttagttgctgttctcaacacaaaggtcactctcttctcaaggccatcttgttgctgatgacatgatcattttgtgttgtgttcacaatatttttaagaaaatcccctttgtgtttcttttattagtccatcagagacatgtatctcctgtatgacattcaccactggttctgacagatgaagctcctgggacctcatgacagtggcctaattatgattcatcttcctgattttagggcaagaggaatggactaactcaagacataaggctccttcggcgaggacggcgaagggcgtctacagagaccagccatatggcagatactgattgtactgtctgatgttgtgaaatagccaatctccaccgtcctgtatactgttcaaagtaatttttttctatgaccaatccctttttaaataaatcaaaatgcttaaaatctgaatggatggaacttaaagccactttgttgaagcatccacttgacagggagaagaaggacatgtaaaattttgttatttgcagtctgtatatgaaaactaggttatgaaaaggaaaaaaataactttgattaactagtgttaaacaaaaagataggtttactaaatatgttaatccattctttaacataagtctcacctttcatcttaaaggtttccatagaatttagttattttatctttcagccatatgctagtttttttttttctttctttctttcttgccaacttgcgtaaaaagggagccgattacaagtgcagacaatgtggtattcttttgtaactgagtcctgaaatgttctgtagtgttaggcaaagtctcctcttgcttgatactaaataaacttttgaaagaaattttgtgtgtgtgagctaacgatttcatgtttttttttttttctatttaaaaagttcttcataaatagctgtaaacagggaaagggctcctctaacagcgcttgtcataaaagggtcacactaaatattgtacagcttcctttaaaagtggtataaaattaaacgtgccatggtatactcaccataggttcagatgcggtctaaagagtccacacggtatcaagctactcactcaggtggcacgttaaacccatgcaaaccaaatctgactttaaaaactggttctaaaataactactggcttttctgaaaaggatgtgatcagatttcatcttgtcgagcgttttttcactagtgcaactttggattttttatgagacttttggtaccttaatgaacacctcgctccatgctggaagcataaacagagagcttttaaagacattctgacttgcctaattgaggtcgcactcgccaaggctgaggatgtgtaagccttaaacggtcttcattttcaaaggtaaataaacgaaataagattttaatctcacttaatttatcttaatatataactaataaagccagggagattacaacttagccggtttcattatccattctagaaaggttttaagatcacctaaattctcattttaaaaagtttaatttgttttagtcatctaaaaagccttagtctagccagtttaattggggccaattcttccctgttaaacaactgtaaaacctcataactagtcgtgtgtaatacatcttttggttaataattgagggcattcttaaaagtgacaagggtttaataaagttatttgttaatcatttggcttaagttttaatggtagattatgtaaaatgtttatctttagtttcggaggggggctccttatatttattttgagtaaacagatttcttcttttgttaggaaatgtcgaccaccttggactgtcagagagctccaagtgacttagagcagacaaaggtaagcaccttttgtccatgattctgagttgctgaggagatggggaacagttcctgctaatgcaggtgaaacacagaggcaccaccaccacttcccttgtgacagcaccctcaggtctaaagggacctcctggggcagcaggggacattcacagcatgaatgggtcagaggctagaaactgggggcacaggctatcagcacctagattcctggcatgattttcaatgagaatggaacactttatttagttgacggtctgcaacagttttcctttatttatttatttatttatttatttatttatttatttattttattattgggtatttatttcattcacatttccaatgctatcccaaaagtcacccacaccctccagatgttatacagacactaagagaacacaaatgccagcccaggctactatacccagccaaactctcaattaccatagatggagaaaccaaagtattccacgacaaaaccaaattcacacatcatctttccatgaatccatccctgcaaaggttttctgagtccgtaagttaacgcagtctgccaaactgaatgttaaataagaacctttaatttttacacatatgtgtgaaagcaaaaagttacagaaatatacaagcaaattttcaaagcctggccttggagaatagtgctttgtacttctgaatcttggaaattggggctttttgtaaaataaaaccaaaccaggtgtttcatatagttctttcttcctttctttttttctttttaactctggagatctgtaaagcaggcatctgtaaaagagggatggttttaatttgctctcactttgcagacaagcaccaccactcaggtcctgggccacatgatctttctgatccttctcttttatggtgtgatatttgagggtgttatcggagggtttggttctttggttttgttttgtttttgttttttgggttttttgtttgtttgtttgttttgtttttgagattcactgtccttctgtggccctggctggcctggaactcattgcatgagtataccaccatgcctggctggttgatctcaagtgtttatatttgcgttctggcacttagctgtacacatctgggcaggtgtcccttcctgtcagtacctaggaaatgatgcaccattcagtactataactttcagtaatatgtgatactaccataggcatcgtttaacagacattgatacagtcacatagagctcagtggtcaagattgaattcatgtatttaatataaaggagaagaagcataggaacttttcttaattgtcagaattaaccgaaacactcaaattgctcatagaaagaaaaggaatctctcctaatagagcaaaatggtgatgtttattcagtttgttgtttgcgtgggtttttgttttggtttgtttgtataggggaggaatgtagcatgtcatagtgtcagctttaggggttcctttctttctgaagtactcttgtttagcagttggcatagcaagtaattaatgtggccttttctttttcgtggcttacacagcaaatagtttattatcataaaattctgtaggtcaaaactgtggcacagggctacaggctgcatgttggcaatggtccattggataagctctgggaataccaatcccttccctgtagggcaatgtgaagtacacacactcccttgctctctctctggctcagaccctgtactgaatctagagtgtgccagccctcagggatgcttcttcaatcagaacttgtgagtaggcagagggtggtcttctaacagccaggaattgttgaatgttgtctctatttcatttttccagagtccatagctctgtcagactgtgaatggggattactccaggaagtaggagctggtcctgtctgttttgggtgtacctactggctgctatgttagtaacacttgcttctctgtgacttgtgacttaaaggggattcctgacagagcagtatctgccacaaccagcaagattcagagcagggtaggagcaggaagcgggcagacacagaccctgaatggacaaacccccagggacacacttccaccaaccagcctcaccttccagcatcccatcactttccgacagtctgttcacagtttgtatctctcagtggattaaactgttgattcactagagctgtcctgaagtgaaaccctccctagcgtgctttacttctctgctgggcaattctcggagcagtctggctgatagtcaagcatcccaactgctggacagtctcttgccccgtcaccactccctccggcaaacctgatttcctcctgctgctctaagaagtgtctgtagtggccccatactgtgctcatgggttctgttcctggactgtgtcttcctgtgagtgttctcatgtgattgcattacagagggtgagttagataataataggcaaaattagatagtggggatgtagtgacttgaaagatacaggacccttcattttaagtcacttgaaatctgatcgttctagtgaatcagtattccctgcccttttgcacatggcattggccccaaccttcaggactcagttcagtgtcctctctactgttagctcttccatcatcctctctgaactcagcccgggtcccgtggtaattatactgcagtcctctgccctctctaaagagctgattttgtgactgttacttgatttcggtattgatgtcactgcatagtagttgcaagctgtatcagtggccaagcatgtgcttatcacttcctgttaactgtttcattgaattctaattactataagtgttgccatctgcattttatagaggaagcaaccacgcttcggaaggtgaggtcattacgttagctctaaatcctcatagctgatagaagcaaggtttgaatagagctgctggggtctgaagccttgaggttttcaaacactgccttgtcctggtctccttgttacactggtctcatcagagtgaaggcttctcacaatggggagctgtctgctcccttctatcccaccagtcatcagccaaacatcgtgactgtccctgctcctcccttccccatccctgccccacgtttctgcataaggagatccattgacttttcaatgaaaacatcgtgtcctgaacatcatgtgttaataagtatttcaagtcaagtcactcttagtgttcacgtggggttattctcttctgagtatctgtctggcaacaggtggaaagcatatggaaacaaagacagttcctgcccttgaaagtgtcacaagtctgctgtgaaaattaggaagcaaagtgccaatcagcatggcctgggacatatacaagtaagatgctttgtagatgcctgtagagggatggcatacccgggcagggtgcttagagaaagaggaagttggcaacaggggcttagggccagatgaaagaggatatcttcacacagaacaggccacattataggagtacccatcacccagcatggtaaccttgagtgaaacctcctctctactgtaggggccccacccatgaaatgaacacgacccagatatcggccttgatagagctctgcaggttaaagcatgctcaaaacaaggtcaaaggtctttcattctcttctgttgctgtgtgttcgcataaggcggtgtgatcctggagcagttggcaaccatgttagatgatgaatgggagagatgagctgggctagtaggtgagggacgagactggtgtgcaggagctccctccagcttgcctgctctgcagacagagaccacaccgccatgcactaaattccacccagaactcaggacaaacctcctagagcccagcaaatgaagagtggagaactcgggtaggtgccctgctgtctccaggctggctcagcacacagcctcaggcggctttagtcagtcagcaaagagagaaccgagccatgcccaaggcacagggaggcaagccgagaggcccctgtgggggaagagatgtcatggaaataattacaatgcagataatcctacttctccatctagctcaaaattacatagagatacccatcatgctgtattacagagaaaggccccatataaaactgatggctttgaaatacagtcagaaatccaactgcccctaagtcactgttttcaaaatctgcagggaataagataaggtttatgtcctctatgcagtgttctatagggacaggaaggagagagctcattcttagctttaaagtagaccttgtcattctgggaaagggatgctgtaagtcggttcccatcccatcccaacctctttatctaatgggaaattgcagtcacttgcagatgactctaattccttaggaggactcctagttccaagagctcaccccacctccaaccctgaccttcagagatcccctcccaggctgaattcattttcagttcttccagttagtgctcggctgtgtgtcttgctgctgtttctgcctctgcctgcagatggggttgctcctcgcctgcccactgcgcggaagcctcactgttgttccacagacacctcactccttgtgaccccttcctgtctgtccgctatctcccagataccacgttcccttgccccattggtccagctcataatctagcacttgcctatcaattccagtaagacttgaagcacaacacacacacaggaaaaggaaaccttcttccctggccaaaatctctgtacccagtcaccactcagaagacccttgaaacgttctgaattctgacaaatgctctgtgactaggtatttgaccttctttccaccgtcaaaataataaacatctgtggtacaatgcatggtagattgaaggaatgcggtagctttgtatcagataggaaaaaaaaaatgtaccaggatttctttggtcttcttttacaactttgtaaacaggttgtgtgtgtgtgtgtgtgtgtgtgtgtgtgtgtgtgtgtgtgtgtgtgtgtgttgagagagagagagagagagagagagagagagagagagagagagagagagaacactcaggtactgctgcttctgtggggttcatggcacctggtacatggtgggctggaggcatgtgaatgagcaaggagagataagggtcttgggttccgtttaggttgccttctgtgtgccttatagcaggggtgagatcctcacccatcctgaggcccgttctctccttccgggagcctgcttgcttttaacagatactgttgaacgtcaggctttgtaccaatcattagtaaagggcctccctcctggagccctgaacctttttgggggcgtcacagtgtctttgcctatctttccctcttttctgcttctctggatcctgccatcttgccagaggtctctctctctcatcttcagccaaaagagtccgctatttctgttagagattaccggctgacaagactcaatccaggaacaatttgaacccctgcttcattgcgtgggttgtctttcacatgccagtaagctctcaagcagacgtaagcgagtactttacattttataaacttgattaaaggttggaagagctgccatattaaaagtattttatttctgtgtgttagtcctttgatacacagtttgtgtcaggttcttcagtgcgccatatgtaggtagccccagtatgtttggggaataaaagactcagagacagtgactgcagaggtggtgttgggtgagggtgatgtactgggtcaatggaagcaggcagggttgaagctgaaatgggattgtgaaagtcagtcatgcatgtctatagggatgagagacacactagagttgacaggctgacgtaggtgtgaggtgctgaaggcactggctgcatggtcttcttgtgtggttggggacttagtagctatcgctggaacataccaggttgccaggagacatgtggagcaagatgcaatagaaagaccagaaggtgctaggtctctgcaagctatgagcctgtcactttgtcccctagcacaggtgtgtgcagttggagcatgacacagggaccccacatgctggggctgctgtattcccttctgagtgtcacctgggtgtggtgtttattactaaaggggttattcaaacgtgcagtctccttattagacaagaaatgaaaggcaagtgcccaggacagacccacgagaagtttaccgtctatttcccatagttggggtgacacaagcatggcctttctgaattcagccctgaacacagtgcaccaccaatgttttctgccctcacttcagccagtctctgctgcactgcctctgccactgtgtgtcctgtgtgtgtgccgaatccccgcctgggtgctctggccagaaacccaccatttggcccagatgttatcattgttgctttgtcgatgtgtacaaacgatcttcatctttctcttttccaggacctgcttctggggaggccgcttaaggacactcacctcaccatcatgcctactcggcaaatgaaccactggctcgccaacgtgacagtcatcaatcgattattgttgttttgtcccagatttgtgtttttggaatgcttttatgaaacagtgtggtttttttattttaatttagaaggtttttatttctttttaaagaaaattctattttgttgtgtgagaaacaaaaaaaaaaaatgctttgtattgtagctaataaaggctccccatcaaaatctcttctattttaatatagatgaagaccaaaaatctagttatttctacacagctctataaagcttgcatactggagagccttgtagaactcttggtcctcacaagacttcaaggacctacacagattgcatatgcatgaataacatccatctctcttatgggccagtcaatgggctaggcaagagagacctgtcctgtcacagcctgtgatagaggcctcagcaggagaggtacctcaagcagagcagggactttggtgctgcctgtgatttgaaatggaacacaaaggtcatcgtctctgtgtagtgccactctgtcccttcttccattggttgctagtgtgttgagattttcactctgtccaccctgggagcatgtgtttcatgctggaagctcacacagcatgcttcctgatcctggaatttccagagcagtctcaagagtcgtcgaggtattgctttcttcccgaatatgttggtttgggatgcatcttgggtttgggacaatgtgtaactacagaataactttgaactgttttaactttttcttatccttttattatacatccctaaaacacagctgtctactcctaaagttctgacctttatatttatcaactatccacccttccatcttctatgtggtatggaaagcttgtgctagagaacacagcagtgccctttagctctcaggctgcttgtaaaacaaggtgggaacagcagcaaggggacaagctcgggagagccatagcagttcaacataccctttagtccattcaaacaattagcaacctcagactaccaggctatgataagataaatgagaaactctttgctcccttcttacttgctgactcaactgaacctctggggctgtgagccttccagctcaattctggcctgtcaccgtgattccacttttgatacctaaattctggcctgtgactttaccaccttcattaaacacatctgtatttactaagaacgaatacatgctactaactacaggaacagcagagaataaaccagagggagtccattccagtggagacaggcccccacccacaaatggaagatggggtggtggtggtagagctgtggcaacaggagaaagccccactccaccaggcctggatgaagaataaaacaacgccttagcagaccaataacaagtaaacaagggagtttcactgagaccctgggtattcaaagttgctgagatgggggtagtcctagtgctagaaggatggcagggatgctcatgtaagaagtggaagagtgaaaaagagacagagaagagtggagctagggagctagctaaagaggatacaaaatggaggattacctttgagtttaatggatgccattaatgggatgagcagagaagttaaaccaaaaacccagtatgtgtcgccctgccttgccaattatcaggccataaatctggtagtattctccaaaaaaaaaaggctaaatctcataaagtccaggaagggaagagaaagccaacataatgcaggatggcagcagtagccagatttcaggtgaattttgagaggagagcacttagcactgctggtgagatggaagaaatcagctggatgatgcaaagaatctggtcccaagccactgagaagtactgtctttctgagcagggaatattggttgtaggaggagcaggtgatgcttgtgtgagctgcacatcagaagaggacaagctcagctagagagaaaggcctggcagacagcctttagatagagttcaatgatgctatgctgtgaggattgatgtctgagaagagacccatggatttctaagtcattgaaggagtgcaccagggagttgctatgggctgagagcaaatggggtgtggtagtccacacaaaggatctcaagggaagaggcttgttccctcatgccaggtgggctagtgagccccaggattggtggccaagagagtgaagcagtggcttggattagatcaagaaaggagcgtgggtttgtcagctcttagaaggacttcaccaaggctagagagagagagagagagagatacagagatgagaggcttggagccctgtatggaagacagtagtggggttactttccctggcagatggtgagaggtctttgctcaggtgttgggcttgacaccagcaatacaggaaagacattggcaagggtagatgcagcaaagtggggtgaaattgcagccagctgagcgaatgcatcctgtgtcaattctgtgtcagtagggctctacacttggaagagtcttcatcctcctgtcttaaggctgta

SEQ ID NO: 398 - DNA, 1483 bp, Mus musculus
agaaatagaaaagtttcaaaagggagaaggcaaggaggaagagaagtacattgacgtggtgataaacaagaacatgaagctgggacagaaggtgctgattcccgtgaagcagtttcccaagttcaactttgtggggaagcttttgggtccgcgtggcaattccctgaagcgcttacaagaagaaacgttgacaaaaatgtccatccttggcaaaggttccatgagagacaaggcaaaggaggaagagctgaggaaaagtggagaagcgaagtactttcacctcaatgacgacctgcacgtgctcattgaagtgttcgcacccccagcagaagcatatgcccggatggggcacgccttggaagagatcaagaaattcctgatccctgactataatgatgaaatcaggcaagcacaactccaggagttaacatatttgaatggaggttcagaaaatgcagatgtcccagtggttcgagggaaatctactttgcgtacgagaggtgtaactacaccagcaataaccaggggaagaggaggagtcacagccaggcctgttgcagttggggtaccacgtgggacaccgactccccgaggagtcctttccacccgagggccagtgagccggggaagaggccttctcactcccagagcaaggaggtgtccccccaaccggatacagacctcccccgccacccccaacacaggagacctatggagagtatgactatgacgatgggtacggtactgcctatgatgagcagagctatgactcctatgacaacagctacagcaccccagcacaaagtgcagctgattactacgattatgggcatggactcagcgaggacgcttatgactcctatgggcaagaggaatggactaactcaagacataaggctccttcggcgaggacggcgaagggcgtctacagagaccagccatatggcagatactgattgtactgtctgatgttgtgaaatagccaatctccaccgtcctgtatactgttcaaagtaatttttttctatgaccaatccctttttaaataaatcaaaatgcttaaaatctgaatggatggaacttaaagccactttgttgaagcatccacttgacagggagaagaaggacatgtaaaattttgttatttgcagtctgtatatgaaaactaggttatgaaaaggaaaaaaataactttgattaactagtgttaaacaaaaagataggtttactaaatatgttaatccattctttaacataagtctcacctttcatcttaaaggtttccatagaatttagttattttatctttcagccatatgctagtttttttttttctttctttctttcttgccaacttgcgtaaaaagggagccgattacaagtgcagacaatgtggtattcttttgtaactgagtcctgaaatgttctgtagtgttaggcaaagtctcctcttgcttgatactaaataaacttttgaaagaaa

SEQ ID NO: 399 - protein, 240 aa, Mus musculus
EIEKFQKGEGKEEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKSTLRTRGVTTPAITRGRGGVTARPVAVGVPRGTPTPRGVLSTRGPVSRGRGLLTPRARRCPPNRIQTSPATPNTGDLWRV

SEQ ID NO: 400 - DNA, 218155 bp, Homo sapiens
  misc_feature (1)...(218155): n = A,T,C or G
tgccacacactgtcccaattacttttcatgtcattgaacattttttctcacaatcacattacatggtggggacaatttctctctgttttgtggataaggaaactgagatactaaaagattaagtaattagcccaaggacacagagcctaaaaatggcagagatgggatttgaacccacaaatgctaccttgagaacctgaactcctagccattgtgtctacagcttccacagggtaccagaggcatagaaaacacaccactttaatattcacaactacctagtgaggtgaccacttttcctcccgtgatactgattagagagcttggttcagagtggcctgttaacttgtcctagctcacatgatgagttaatgagagaggcatggagtgaaattctgggagagcccagaaactgtgctctgtctgtggcaccaggatgcctctctgtctctggcttctcaaccagaagccacgtgtgtgcataacctgaatgaggataccaaacactgcagggagaaaacataattaaccagagtagaaatccagtaagccagtgccagatgtttcaggtaaaattatttactacagcacattgcaaaagggtttggtcttctttgcctcctctagatctactctcaacctttttcaaccacagtctctaccctcagaggcttgcctttatggaatacatcagttgggctcccctgatccctgacttcggttccaactcagccagtgggaggcattcacaggagatcagagggtggaagagtaaggtcagggtgtttagtgccttggctccttcctggacctgcccctgttcagcagggctggtgtcttctatattcagccacagctcctgctggaggcctgctcccacctccacagctctctcaggttctgacatctgctctttcctggcctctttaggcacaggatgagaaggtctcccactggtggcctagacggccaaactcttccctttgtatctctttgccttacccacaccttataaatagctgtttatgaaactctctttaatgactccttttgagtacaccatttgtttcctgccaagattctgaccaatatatgaaataataggatacaggaaagaaaacacaagattcactgtagcatgataagaaaaaactcagaggtcaggcgcggtgtctcacacctgtaaccccagcactttgggaggccgaggcaggcagatcatgaggtcaagaggttgagaccatctggccaacatggtgaaatcctgtctctactaaaaatacaaaaattagctgggtatggtggcctgcgcctgtactcccagaactggggaggctggggcaggaaaatcacttgaacccaggaggtggaggttgcagtgagctgagatcccgccactgcactccagcctggtgactgagcaagacttcatctcaaataaaagaaaaataaaagaaaaagttcagaatagttttgttggaaactatgtgctgggggaaagtgagcattttgtgtgcattagttcatctcagcttcacaattggcctgtgaaatggtcataatattgatcccactgtgaggcttaggttttcagtaactctccaagaggaaacaagaccatatctaggtgatgctgaggttcacagtgcatctgttcctgctcaacaatgagcagaggcatagtggggagacaagagcacagggagtcagcatctcaagaaagacctccaagctacagctgagcccatggaaacatctttggtgcctgtaagaaagaaagggccacaacagggggcgcacacctgccttccatctagtctccctcctggttgcttacagctagtccccatccagcactaacttgagccacagcttctccctcagccccacaaaggagggacttcctgctcacgccacaccttgttctgcctggaagactctactccttcctagtacccagagtccactcagaaaggcagtcccatcctcctgccctccctttcctgtatgttctgattccctgggtcatacctggctgaattgtaagatgcaatacaggaaagggagttttgttttcttgaaccagcaaaaaatgtacaaccctattgttttatttctttaaagactgtgagtgcctcctccagatcatctgagaatttgatggtagttgtacagtaatagagccaggagttgaagtggtcgtgataattgcagatgccacctcggatagaggctgtcagttgcttcctaaacatcaattgtcctctattccttactgaggaactctacttttgttggaggatgcgatgtgcccagggaaaacactatagttaccagttctgacccttgcaaataagggtatccatgtgtgatacagtttggttaatgatacttaagaaaaagccatttgatgaggcttccaacaaggcgtcctatcagctgcacagactcaacaggtgctgcgaattttccctttagctctttcccttttccttactcctgcctggaatcaggtcatgatgcccatggtggaatgaagacagcccattttggccctctaagttcgatgaagcagaaagatggcaggggcgtggcacaccaacaacatcttgtagctgctgcccctggcttgggcagcctactctgggacttcatggggaggagggtaagacaagggtgagcctatttggttaagcacttacaggtgtgttttctaatccacgtcccagaataatctgtacggcccagtaccacagccaccagccacatgtggctaatgagcatttgaattggggctctcattagtgaataactggttttaatgttattttaactaattaaagttaaattttaaaatggaagcagtgtaagatttttttttcattaaacacaattttatagtttggatagaaccgcattttaccttaggtgttgaaaattttacattggattgacatgtactgtaggtgcaaactacacatcagatttcaaagacttagtcaaaataaataagaatgtaaaatatcattaatattttaaaattattgattatatattgaaacagtattctggatacattggattaaataatcctattgaaactaacttcatctgtttcttttcacattgtcaactggcttctagaaaatttaaaattaaacatgtggctcacattaattttggacagtgctgctctactgatgctgcacccattctatgcccctggagtgtcaggttctgtgataaacactttaaatacatgccactcatggaggtcctaaagtaactgtttgcaggggagggggtaatactgccttcattttgcaagtgcagaaagagaggcacaaagaggctgccttgccccaaagctcccagattattaggggcaggcgcacagtggtatcagactccttaacttgtggcctcaaccgccatatgctcaagggtaacttactcttgaactgtgcacagatcatgatagtctgtatatctaagttgctaatgcttgcagaccaacaggtatggctacgaagactgagagagaatttgctctcaggataagatttgccagaggaagctggagcgttgcacatgccagctgtcattagaggtgtgataaagttgatcgaggttgcccaggtataaccagtaaccgcaatctctccattaacaacaagcaatggattttgaggcattgtgtctcctcttggtataaatccagacatggtggtgatgagggctgatattagtgggaaggctagtgctacgctagagaaacgccaaagaatgaaattcacagagacgttcagtgagtttgcagttgagtcaccaacaaaagtcgactttgattttgagaaaaaatgtttctcttgtaattcagtgatctaacttaagtccacaatctcagctttatgtccattctttttccacagccatttttgttaagtttgtttcttcctttcttaactaaagaaaaacacaagcccaagctggcatttttctatgaaacccggatgtgttcacatttgcagtgggcactaaacactttatcacccccttggtagctgttcggacactaagggtaacttgacactgacagaaatattttgtttctgattattttgccaaactcagatatgtgcagttttgctgtaaaacattctactaatgtgtacagaattgtttcatgtgtatctctatgcatcctgacaagaaatagtggactaggagatggacacggatatttttactactgtggcaataatgttttacatttcgacagtgctttccaaatcacagcatcttccaaagcaccagaggtggtgataacttgatgcactgttgaaatacaccaagtactttggcactccagcatcacatataaccttttacaccaggaagcaaaggatggagggtttttgctgcattgagcaaaataacaaaacacatttctgtgatggttatgtccaagagcttagagcacttttcagggttttctctgcaaatctttattgttctcatcagaactcaacaaacaactgctattagctaccctttacaagctcagaaatagggacagagaaagctttggattctgaaaatattaccaagtcaggcagtgacggggtcagatacgggccctgtcacctctcatccttggctcgtctgtccccacctgcctgtgtacaggatggccagctgaccctggacacaccaattcgcattattttccatcattactttttgtgcttatatttgaaatagagaaagacttcacattgagaaacgtccctcctttaagcttgccttatttttttctctcactcctcctattctatatacctttctttaatcttcctttggttctcctgccttctttttctccatcacatttttctttctcctccccttttctttgtctttttccattttcactgtcttccacataagatcatctttcaccatcctccttcctaggatggagttgcaatcctatctggggtttccttctcaaactcaagtggttatcaaccccaacgcaaactttgtggggcatgtgcctccacatgtggccactagggggtgtgtgcacaatatctgtgtgtgtggttatttatttattttatttttttaagctgcagaaagacagagccaggatggctcgattctcttgtcaaagaagagagctgacgagagaaactgaggtttccatccaccaaatactgacaggagggtatagatttgcagggcagatggatacagagacagaaagacaggtgtcttcaggtatgtgagtgactgggattgaaggtctgattgtatccatcctcacattgggtggagtgtgtgtttgtgtgtgtgtgcgcacatgcgcgtgcgtgtgcatgtgtatgtgcatgcaagcatgtgtccaattctccacttactatctctgagtcacttaaaccttctgagcaacagtttcctcatctctaaaaagtggtggcttgtgactacctgaatgaggaagttttttggagcttgtttgagtaaaatacaagagagccactcatagaccaaatagtccttggtgaaggcactccagatctacactgggctttgaactgtgtgaagcctcccaactttgaagagttgctttgtgtcctcccccacttgtgtcaaggcttttcagccacagttacaagttttgaaaaagtatttcctgctgtaactgactggagtcagggatcagagtgaacactcttgtcttcctccctgacacataaatgactgatttctaggtaaggatgtgccatcttttggtgcctgccttacatgacaaatgaattggcctcagatggctgggtagcattgctgttccgggactgcattttgggagacacggatccagaatgaatgctgagtgcttgctgtgaactgacctctggaccaggcactggggctgggcagctgagcaggctctgaggacagtgtgaaggcaaaggggtccacagatgacgaggaccagatgtgttaagtgtgaacaggagcacaaacaatgctggtggagaggacagagagtggaaaagctttaaaatgcacatggtgcctatgtgagcttaatgcttcaatttcaacctcaaaatgatcctgtgaggaggatagtaagcaaggcagctggggccaagccgaggtctctctggcctttggtacagtcggattaggatttcacagtatggcactgcagagttttggagtaactgggataggatccacctttcttaaacaaaacgaagaggaagcttgtggtgtgaacagcagtgagaagcttgtagtgtgagcagcaaatatgaaaacttcctcatagacacactccctacattttgtgtctcctctgatgacactgagtttgctgcagctgtgtctgacttattgcagttagtgtcataaaggccaaggacttgtctttctctctccaggagtcagtaggtgggtgaagaggaggcaggtgtggattctggcagacagcgctatggcagtgggctggggccacagggacttgctgtgttctcagagatggcccagtgtcactgagtggggtgggtttgggaagtacccttttgtctctggggctgagaagctagtcccagacctggatgtgagaagaaagagcagccacagttccttattgcagtgcggggcttcccgtccagacctgagcgcctggtcagtctaaccacaaactctgcagatggagtaagcagccccagtgccctggccttaagggcctttggagaagtctgttctgtccatggctatgtcccctgtacccagagcagtctctgcacatagtatgtgctcagtgagtactggtgtattctagagagacctcttttggcctggaagccaaaagacctgagtgtgaatactacctgcagctgcttgtaggaaaatcaccggctttcccaagacctgatttctccttttcaaaagaatcagagggttagcgcctgcaggaaggtgatctcatgaagatgagcggagtgtgcagcacagcatggaggtgccccacagccaacggctcagccaggttggtgggtggggacaatttcctgagcatctcacagagacattcatctccctcctccccggaggaccctgcatgagcactcacagcgcttggcacctgccctcttggaaggttctcggagaaggagggtctggagcagaagattcagtgcccttgctgtcagtttcccagtgcatagccctcctccacagctgctggtggactgactgccaactcagatcagggagggatgaagagccagtcaggagtgttccagattgctacctgggaaggcagaaccaggaagggagagaaagaagggtcagagagtcaggtgggcctgggatccccgccgacagctgtggagccttaagcaaggtggtattaaactgtcccgggcctcagtttccttctttgtaagtggtgatcaatagaattttccttacagggtgttgcgagaaccatagtgaatcctaagtcataaacatagggctggcacttaataaaaatagtgattactcaaggtctggactgtcaccggggcagatggtctgaatggaagacacagagggagaagagctgttagaagagagagagtctaagtgttccaatgaagccgctgggcatccaggccccattgtcctcttctagcctcatcccaaacattctctgtccccctttccccctttacaagcagctgtcagggaaccctaccatagaatgtaagttctgtgacacaggaatataagccagaggtgtatgcttcccttcagttgtaaaaggaaaagacattgtcctatgagtccctcctgttgtccagcaggactactggcatacccctggttttgggggtgtggactgggaagctcaggctctaagttaattaacaaagtggcatagtgaggcaggtagcagccaggatgcaggcatccagactcctgcccttctgggtgagggtggtttgggaagtgccctttttgtttctggggctgagaggccagtcatagacctgggattgagaagagcagccacaagcagcctacaagcctgacgctgggcccaggtcagaaacagaggtgcgacagtcacaggtccttcactcagttggccaggccggggcgaagcaccacgaccagcagtgaggagtccacagatgggtgtctgcccagcatccctggagttacagctgaagggaaggcgagggaggctcagaaggcccagaggacagccttgcagccggaaaaaacccaaagcaaagatcagctcagcatttccgataggcagagtgctgttttgggtatttcattatgagttaacatatttattctcatgaacttcttatgaaataagtttggttgtcatctccacttgacggatgaggaccctgaggtgaagaaacttgcccaaggtcacagctagtgagcagcagatccatgattccaaatccaggctgtttaaccccagaggctttgcttttaactgtgccatttttctgcttcttgcaagttgagactgaagagagccatgaagaagactcttactggggactctgaaatgacaccttagccgggggaggagtggagccttgagagtgagggcagttgagtactcgggtctgggacttagagcttccaagatttctaccacctcccactcccctcgggtttgtaaagctgcctccatttgcattgggagtgcgggggggctgcctgggggactgtggcgattgtcctcaggctattggctgagagtggtatgccactgacttattcttccaagagacatttccagtaccctccatccctgccccctgtactacacactggtgaccttccccctcaaaaacaaaactcaaactctgtccctgatgctcatggtctactgaaaacagaattacagctgtctgtgaatgacctctgaccaagctggggggacacagagaagggacttgtgacttgctttgccagggaggtcctgagaggctgtccagggaaggtgacattgaggccgggacttgagctggctgtttgaaggcaggaaaaatggcagggcaaggactggagtccttcgccttcctgggggacgtttattccacatgcctcgggaaatctgaaatggccttggagagcatttgctgggggttgggggtgggcggaaggggacagagagcattgccaccgacaggcggggcgtcccagggcctctccccaggagcggatgagctcagacgcggctcactcagctgtgtccaggcacagccggtttatgacctaagagaatgacaacccaggagcaagtcgggatgacaaagacgcccagaagggcacgcgcttttatgtaaccgacctctgagctggcggatctcaggaggttggcgctctgagctcaggcgcggagaaaggacggcgcccctgccttactctcttataagtacgaggggacagcaacgcgacataacttagagaagtccaggaagctttagagagcagggcggtcccgctgctattcctcagagcgcgactggggcgaactggggcgcccttcccagctccagctcggcccttgtcccctcttcccaggatcactcgctgggtgaccttgggcgagccacttgacttctctgagccccagtttcccagtccgtgcatctgaaaggctgtaatagcgtcgtggggctccccactcggccctcagggccaaaggtgggcgccggacacgcgggaggggcccttggacgcaccccctctcgcaaacgcccggttagtcccggcggactcgcagtggagagcggccccaggaggcggcgggcggcggggcggtgggcgccagtgcgcaggcgcggcgcggcagggcggggcggcgggcgcggggcggggcggggcggagccgggcggggcggggccggcggcaggcgctgggcgctcggcgcggtggctcagagtgcgcggggcggcgcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaaggtgaggcgccggccgttaactgccggccggcggcggttgggggccgggtggaaacgcgggggcccagggggcccctccgtgccctctgctgtcagcggacgcggcggagacggaggcccgggtggcccccggggtcgtttgcacggggacctgggaggctgtgggacacctaggggaagaccctgatgtgaattttggggacttggaaggagaaggctggggcgcatgggtgagacttgaaggaaatctttggggactcgggcacacccaggggaaacttctgggtgggggacagcgaccatctgggggcttcgttgggaacgaggttgaattatgtcatggaaggggagcgtgttggactcggggaagtagggcgtttggtttgtctaaggtactggagaaaaagctggaggaaaatggaaggacttgagggactcaaatgcagaagaggtgaagggaacaggtgcttgcattgttagcgaagtttggggaccttggaagagggttggggtcagaccccagcacctgagaggagaggagctccgtggtcccaggggaggagcccagttccccctcccagccctttgtctctcctgtgtccaggctccaacagccctggcggggcagtcagccctcccaggggatgggcagcccatgccaagccttgcaggctggcccttggagaagtcagtaggggagaagaggccggcaaaagagcaccgttccggagggcgttgggttgggtgaccctcattggtggctggcttgaggttcggaatagtggtgaagggagtccttgccattttcacacgactccagccagctcagggtgtgaaagatcctaggaagtactgcgggtcagggatacagagatttctggaggcacgcctacccgggacagtgttcccctggctttttcctcctgtggcttcctgaatcatctgctggcatgcacggtaaattaagccttccttcctgggagcagtctcctacttttcctggaatatgtgtttcagatgaagatgggtgtgggtgccactggtctgtcttttctctgggaaatggcagcaacatgatctggtcagatctgttaccttttgcaggaattactgtgcactgacagtctgtggttccctagatgaatcggatctgctgctcttagtgctcgccctggcttttttattgttggaagtgaaagatgaggcagacatattctatttgtatatagatacctatattttaaaacagtgacctccagtttttgcctgtttcaaccagttcttcagagtagagtgtgtgtgtggttgaccgatggtggaggagagactctttactgtctccaagaatttaagaatatttgaattgttgaacagaaatagacttatggagctccctcattttattttaattgcaggcttatttttatttctttaataaaatgggcttgtgaaaaagtgaatgggcatgcattcctaaataaaagaaaaaaaattaagttttatttctatgccctctgaacagttctgcagttgagtttgtactcctgtgcctgatgatttacatgtatcttttattgcctgctgggctgtcatctctgtgaaagaaatttcttcatacattgcatgagatccgtggcattggaaatattctggactgtggactcaagtgcatttttcctaataaagaagctgaatcaaagttaggttgtactcaattaaggaacagttaaactgaaagtacagtgcgttatcttattttaaaagtcagaattattttctctgccgtgttgccatagtattgtgttgctaaaacgtccaaaattcttttggattctgtgtttttaccagtgttaatggcttccagttacttgaaacagatatttactggggaaatgttgccatttagtgttttttaggtattcaacttgataaacttacttttcatagaagtaattcttataagaagtatatttctcacatgtgaaggaaggaggaggtgctgctcagaatcttgtcttactgttagtttagatgacttcagactgaaacatttttctcttaaatcacaggctgatattcggaatgcagagctttatcatttaaaacattaattacacgcttatgtaactgcaaaattacaagtgttttaaatctgaagctacatgattgtgaggaagctttgattttaaatccaaccatcttgttatgggctattttttcttatttagttatatttgtgtttgcctctaatgcaactgtgttttcagcagttattcacattggagttggtatttcagcactaaattgtagaatgggccagcatggcaaaccttagcgtgccatgtaatagatatgttttatggtatctctaaactctaacaaggccttacatttgcatagtattttaaagtttccaaggcactagttttgtcctcacacttgcattccggtaaggcagatgttcatgtcttctcttttcaggaaggcagctgaggatcccagctatctaagcttttgggcaactgagatttaatttgaaatctcaggtcttctgtctctgaagaggttgttctttcttattttggcttcctaaaatgttggaatgaaatacttctcacttgctaacttcagaccctgcagaaatcaatataattagtatgattgtttccaactgacttaaatgtgtaggaaatagtatatatcctttaggaagtttatcctgatttttacagaaagtttctgtctgcacttgccttctttgaagaagcaaacattcacggtagatttatcttccaggattttgatgctgaggccaagaggcagttttgaattaaagccctcctgtgactagtgtattagtttaataatcaatgcattatgataatgaagcagtttatagatgaggtgtagtcgttctttaaaaattcagtgttcgtaaagattgatcaacttcctaactgaattactctttttctttcttgagctaggatgacaataagagatatactcctgtctggtatacattggcttttatatttttccagacttgtgtttcatcgtgggcactgattgctgattttattttcattttaccagaataactggttctcctcctccacctcctaaatgaatttgtttcccgaatatttatttatttatttttttgagacgaagttgcccaggctctgttgcccaggctagagtgcagtgacacaatctaggctcaccgtaacctctgccttctgggtttgcgcgattctcccgcctcagcctcccgagtagctgggactgcaggtgtgcgccaccatgcctggttaatttttgtatttttagtagagacggggtttcactgtgttggccaggctggtctcgaactcctgacctcgtgatctgcctgcctcagcctcccaaagtgctgggattacaggtgtgagccaccgtgcctggcctctgaatttgtttctctaacaaaattagtggttaatgtttatttgatgttaaaagtcagtcaaagaaaataggctttgggatcccactccggaccccgccttggtgcctgtagggtgaattgacattgcaattcttgccaaggagaggttaattgcagatgaaagtggtgttgcatgttttatatttgctagtaggggatgtgctgactcttactaaaaaacatctttagaaatgtcttatgcattataatttaatccaagtctctgatattggtttggatggttttcaatacaagccaagtaaccattaaataagattacataacactgtatttttaattatctgatataatgtatggattggtggctggctcactgccaagttacatttagttgtcgttgattacaagagaaagtggagctgaggattcaagattaaggtggtccagatttgtgtctaggttgataaaagttttttgtttgtatatcaaaatggtttttatatcagtttctcaaatattacaattcttagcattacttagaataaatatggaggataaaaatatattaaggaaggattattattttatgtacatctctttgtaatccacaaaacccaggggcttaaaacttgatttttggggaccccttttggaaaacatttcggatttgcttgaatgtcacagacttgtaaagtagagagtaagaatgagaactgcagaactgtatttaggtatggtgccttcatgctatagtttgtgattttctgtttcatccaaaggaggatgtgattatttagtttttagttttttattgtttttctttgtgttatcagtttttttttttttttaagaaaatgcgatcactcacagtgttagatatgccatttctgagttttatacagtgtattatgattaaaagtgacccagtgattgtgagttacagggttttggtattggacattagtaacaggcttatagagaacctgccatgctggttctctgtgttgggtcccaggggtagggaggaaaaacagtctgcactggtgagaagctcctgctctcctctgtgtgcgtttgagaatgaattttcggtttgtagatgccctctttcctaaggaacatcttagtccttcaactatgctgaaatatttaatgattggatggcttagatttactgttaataaatcagcttgtggacatttttgaggcacttgttggtactgggtcatgtttgtaatctcgatactggtaacagctcagagatggagaggttattagcctagtttttcagttgtagaaaccaagattctgacagctaaagtgacttgcccatggtgacatgcttataataaaatgtcagagtgaagggtcaagctttgttcttttacaggtccattgttctttttaccatgtcctactgactctcagtaacactgagagtctaaagggctaagttactggccaacctgtgatggtataattagtgaatgatagaaggagaatcaaaaccctggcttttttatgtgcagtttgtttttcctctagcctgtgctgaattgaaagataaattatatagcatccattttcatacttcattcttcacatttctgccctaagataagtcctctgacctttttcaaaatgggttggattgcctgttttctggtgtcacataacacctggtgctcttacggtgtgatcctcatcacactgctttgtttggatctttgtctttcttggtaaagagtgagttcctcggaagacagggcctggtctttcctctgtatcttcagcacctagcatacgtctgagcacagggcccttgggaactcctgtcttcatttcagtgttacgtgttaattatcattaagggtagcagaatcagaaagtatatttggaatttagcagtcagtaaagagctttgcttcttacagctttagaggacctgaattggaggtggggatgaagtcaacagttctgcccatatcaatgaaagaaggttctgagtgaaatgcagggttgaacaagcagaaaagcatcccagtgctctttaaatgtggttgcacagtagggatccttctctaggagataatgagaagatgttgtcagatctgctttgaatcagatgtttatttacttttattctttcttaaggaatttatgaaatcactgcactctcatcaatttgctctccttctctaaactcctaatgatatttctcatgacagattaaaaacagaattttggaagccctagtcacatgccaaataaggtttcttacctgagagagttatccgcagtttcagatgccaaagggaaactccgaaagccagaggagcgattgaaaccgcaaattgagtgccaacagcaactttgatatcaaaagccccatttgcctgttgtcaccagtcccgctgagtgaagatagaatgacttatatcttctaccaaaacaatagaaggagagtgttccttggcgttggggatgatgattataaaagccaccaatttgaggctcttccgtgccagctgctttctgtgcattctctcccatccccgcaagatcttgcaaggtaggaggttttattccctgcgtgcctcctttatttttttcaaatgaggcctctaaggctcaaaaacactaagtaacttgcccagtcaaggtacacagcttataagtagtcaggctgaaattttaaaccaagtctgcagtattttgttaagatactttaagaaaagaggtaaaaggacagaactcaacattgttgtttttaaataaatgtttcattatagcagaagcctcttaggaatttccattggtgatgaatttttaaaaggggttactgaaaatgtgttttaccaaaaaggcaagctcacttttttttctcctgtgctctccggcagtcttcagtaggcattcaaagtaaggatttttaaatatgtatatatttcagtgaccaaaaagaaaatagaaaaatattccatatagaaagccagtgaaattcttgctgaagttctgtctcttgagggagcctcctagaggtgcagtgctctttgtattttaatactttgcttatcacaaaaacagtcgagagtatgatatcagggatttatagtcagtttatggtatatttgtgaattcttcattctctaaaaataggttcacaaaagaaaaaaaagtattcccacagataatgcttttggctttctggaaggggggaatatgtttaaatatacttgccctgcagttgctaatgatagtagctaccatttatcaagagccttttctggtttacgtgctttatgtatgttatttcattgaattagtttaacagtcttaaaagagtaagtcattttaccttattttatagatgagaaaaccgaggtcaggaaggtcacataatttgcctaagaacacatagctagtaactggtgaatcaggattcagatctttgtctgcccaacactatgacactatgtagggcacctgttagcatcagatagaggtggaagctttgagtatgtcttgtttttcatgttttacttttgtggggaatttggattatgcagctcttcaaattacatgcctagtattggactgggtgagcagggcagttgcgtaccatacagagggcacacaggggcatggcaaaacggcataggaactttctgaccagtggcaacatctggtaggtagcatttacttgggaaacagtgttaactcaacaaggaatgagctggtgcagaaagagccatgtgattacaggtgacagctttctagtctgtaatcccctgcaagttactttatttctcagagcctcagtttccccatctgtgaaattggggaccttatgccttctttgtagggttgctgttttagacgtaagtacagtgtctaacacatagtaggtgcttaataaacgttacctgcaatttttataaaatgttgtaagacagatgtgtgagtatcgacatcacttttcagatataatgtatataatacaaattcaatacataaatcatctactttcatttcttagggtaattttatgttgttagaattattttagttttccaatccaggaaatattgaaggagaaattcagtctttaggaagcttctttcattaatatcatgcacaaaattagcagcagctctgattgatttttattatgctattcaagacacagcacctgaagcttaaattaacaaatgaagcttccataaacagttttaagactgcatatcttaaaacatgtctggacacccagcagcctctttccacaagcacaagataccttactctgaattggtaagctgtaaatttccataattttttacatttccataatttttcgtcaatcagcccctgctgctattttaagaattttaaaaggtgctcctagcatattattgatgttcttcgttgatatgataaagggcaagagtatgtgagggcacccttttaaatgtctgttttcgatatatatcttacacttggggtcactgttgattcgtgctcccatgggagaaaatatagaaattatgatgaagataaggggcagttttcattttcaacatttttccttgttctttctctgcttcaatgtttgtgccgtttgtgctctgcttttcttccactagatggcgctccacatagctaggttaccttctttctttcgcattggtagctatttctgaactgagtcttgatcaataaacgtgcattgcttttgattttcatgcattggtatttttcatattattgatctcttaagaggcatacttgctaatcaatatttgcagaaagccatgcctttttttgtagccaccattgctcaagcgcctgaggtatgcctggcactgtagctaggttcttcacacatttcttcatttaatccatgactttcacgtgaatttagttttgttgttctcattttacaggtaagaagtggaggttagagggatttataacttgttcgaggtcacaaagctaacttatattatagggattagtgtgccctaaagaaaagtatactccaaaaacattaaattgaaagcttttgtcaaataacttgttaggatagtctgacttacggttactggccatggtaatatgtttattttgggggaaaattatactcctcacagttaatttgctttggaatatataaatcaaattcccaaatctgatttgtataagaaagcacacaacagtaacaaaagatttgtcagttggtgtgcaaatttctgcttcctcttgccttctgtttactgacttgagtgggctgagacttgatgagtactagctataaaatgtgggaggaattttggacaaagccaggcttcctgttttagtaacttttagcagggctgaatgctgttaacaagtccccaggacttaaaaaatttatcctttcattttattcatttattcgacacatatttgttgaattgctgagttgacctgtgtgttctggaccatgactttacctcactgagcctctattccctcatctgcacatggcaggcaggatgccacctcagtggttgtcatacattttaaaataactaaaagagtataattggattgtttgtaacagaaaggataaatgcttgaggtgagggatacccatttccctgatgtggttattatgcattgcatgcctgtatcagaatatctcatgtaccccataaacatgtacacctactgtgtacccccacaattaaaaataaaaattaaacaagattaaatgacagtggtttcgtatttgtttaatttcactataaatttttaacatagaatatattcgttgtatctaagatgagattattacacatatatttctgttcctcatatattatcttttacaaatgaatacttaaataccttgacatgtatttattaaaaataagggccttccctttcatagctgtcatacaatgatccaaattaggaagtttaacaaccacacagtgctgttatctcatctacagttcacatgctgatggcaccagttgttctggttttgtcttttacaggacccaagtcaagatcacacatttcgtgtagtgtcaggcctctttagggtttcagtttgcagtagctgctttgtccgcctttgcctttcgtgataggcattttggaaaactatacaaaaactatacaggccagttttttgtagaatgcttctccatttaggttgtctgatgtttccttaaaattagatttgtgtcacacactgtcttggcaggaatgccaccgaggtgatggtaggtccctctcagcccctcgtacccgggcacaccacgtctgtgtcgttactggtgaaaagttcaatcacttggttaaggtggtgccagttttctcctctgtgaagttactactttcctttggtaattaattaatacttctgtgaggagatactttaagactatgtaaataaatatcctgctcctcattaaactctccctcacatcttttagatccattaacatttcttacctgaattattactgtgatggttgtaaaatggtaattttccaacagtcattccatctacatttattggttgatattctactgaaaaggaatcttttctgctccttctttctccctctttctctttttcaatccctctctccctctttgttattcagtcgtatctgtcttctaaattcatgcatttttctttaattcagtgggttataatcctttactatcaccgtgtaaattgaagctcacattgtttaagatttggccattgagggccctttgctctggctcctgggtccatttgagaggatcatcccctaaattggcttagtatttttttaatctctgtaacagcaacttgttctctgcttatcttgttcttgctctgccctagccctcaaatgagccattttccccaaaggtgccctggtttcttttagtgtggaatgttgtttagaagccaagatctgggtgctggtagtcattgctttcaggctctttcatggacagctgggaagtagatacctatctgtagctgtaccttcattgtctttatgcgaaactctacgcctagggacagcaaactttttctgtaaaggctaaagagtaaatagtttgtgggctgtgcattctactcaacctctgctgttgtagcagaaaagcagccacagacactatgtaaatgaatgagaatagttgtgttctgataaaactttatttatagaaacaggcagtgtgccatgggctgtggtctgcttacccttccctgctctcagcagagaaactaggagcccaggctttattaccaaacttggtaaaattcatttgtacccatgccttccaaaataggggcacaataaaagttatttgcatgaatgaattaatgataattgtgggctctttctattgcagacctctcatggctcttttggacatcagtctcttatgacttgtcaatttgttcaggtccttgtttaaagatgagaggcttttagaaacataatgtgcacaatatgcaaaataatactgagaaaaatgattttataaactcgtgagggtatttttcttgtcatgatgaaatagttacctttccctaatgaaagcatatctcaaggcatagccatactgcaggcagagcacatggcccctgctttggtctggtgttgctgcattctgcatagggtcagctgagaggcacgactccagcaccaatcaattgggtgaaaaatttcaaaattataccccttttattgtctcagaactgtgtttcttcacagttttctttatgtaatttattgctctaattcattcaaaaaaggattttattacagcagtgagaaatcagggagtgatcccattctcagagaagagtatgccattaggaaggaccgtctgttttttttgagacggagtctcgctctgtcgcccaggctggagtgcagtggcgcgatctcggctcactgcaagctccgcctcccaggttcacgccattctcctgcctcctcagcctcccgagtagctgggactacaggcgcccgccaccacgccaggcttattttttgtatttttagtagagatggggtttcaccatgttagccaggatggtgttttttttttggtttgtttttttttttttttttttttttttgagacgagtctcgcttcttcacccaggctggagtgcaatggcgcggtcttggctcactgaaacgtctgcctcccaggttcaagcaattctcccgcctcagcctccccagtagctgggattacaggcatgtgccactattcccagctaatttttgtatttttagtagagacagggttacaccctgttggccaggctggtctcaaactcctgacctcgtgatccacccgccttggcctcccaaagtgctgggattacaggcgtgagccaccgcgcccggccaggaccacctattgttaatgcacagagactgccatcaaggtgatgtctgacactggaaagaaaccaagcgctagagtacatcgcagccgatgccagcagcttgagcataaagatggaggttcattctgtttaatgtgtctctgatgactctaaaataaattaggctttaattactgcttaaatttttatttaatttcaaaaattcaaaagtcgattttaaacctgttggtgcgtagcttctttggtgttcagcaggctattcgtcttcctctctgtgagaagcagcatgaggttctgcttgctcctttctctagaatccaaaggagtggtttaacgttctgggtcacaaaacaatccttggatctgtggagcatcctggcgtgctgataaaggaaaccgagcaggcttctttcctcccgtggcttttatcttctgggtcttgaagtgccttataagattttgatttaacaagttttactggtttttttttgttttaacgtgagaagtactaaagtgtctctttctctcttaggctcattaggaatgtctcctttttgacatgctgcccatcgtttggtgtaccacccattcagaaccaacagcgataatcccctgccctgtgttacacggtttctaatagcttcagagaataaggagacaaaaaaagccatgccattaacagtcgattgattgtattctggattgtatttttctcatccctttttcccccttggtcagggttttgctgcttttttttttttttcttcttctttccctgagacagagtcttactgtctcacccaggctggagtgcaatgatgtgatctcggctcactgcaacctctgcctcccaggttcaactgattatcctgcctcagcctcccaagtagctgggattacaggtgcccgccagcacacccagctaatttttgtagttttagtagagacgaagtttcaccatgttggccagggtggtcttgaactcctgagctcaggtgatctgcttgcctcggcctctgaaagtgctgggattacaggcgtgagccaccccgcccagctgggttttgcttcttaaatgggcgaaggatgtgttgctacctgtggaaatagtaagcttgaatagcttcagtttcttcatctgtaaaatggtcatgagagaatctgtgtagcatgtctggtgtatctgtaagtactcaaaagttaattaggtgagtaggacaagttttcttgttttcctccttcatggagcccagcatggaatactaggcccagaattgatactcgttgtatactccttgaaatgttaacttagaagaatgtgcgtgaattcttgtctcacctgtcttaggtagggcaccatgttacttccaataaaaggtccatggcagaaagtagtcttttaggtttggagagtgaacattaaggcaaaagagtagcataatctattcaggcttcagacttttagaccctttcaggaaatcactatttatagacttctgggggaaacacccctaagactggttgggtgtctgtttctccacagtctttcctactggattggagaagttgctgttatttctccccttgttcagtaaggatcacatgcttaggctgggctaagtgctgggatgcagagcaagctaatactttatccctgcttaaagagtgttcagctcagtggggaagtggccaaattaaaagacatttatattgtggggtggaagggctgtaataaagacaagtgcacacggcactgtggtgctgcatggagctttgttattccgatctggtgagggagtgggcacttgtgtgtgactcctcacatagtggtagaaacgtcctgggctccagagtgtgatggaactaatgcaagttcacttctcagagtctctctgcttagtattaaaccatggcatctctgagctcgtagggctccctgtctggcttacagtgtgcagtgaatgcatccctgttctcttcgctcgctctctgtgtgccagctactagtgtagtaccatcctctgtgcatgcaacattgcatttatcacactgcgatcgtgatgtttgggtgggagttctttctccaatgagaatccagctgccttacaagcagggaatctgactcattacctttgattccttctccagtgctcagcgtggtgcctgggagatagtgggcactcagtgtgtgtagaatgaatagccagttggtctcagcttcctcattgtggatgacagcaatgaattcattctttcagaatgcaagtgaaagaagattgaaaaagtgttttctctttattagaacttccggatactgattatgaggagagatctgccatttttcagataggtgtaccaagagtgttcactctatggcagtgtgggcactagccttggctctggtactcagactcagttggaggtacccctctgtcacggaagagttactgggcccacgtacataccttcactgctctaaactccaggttttcactttgtaaaataggcacgacactacctcccagacaccagacacacgatgaggattcagtgacctgcatcaagatggtgcctactagactccaggccctagagagctggggcatttatccttgctgggtctccagtgcccagagctgtgtctgaaatgcaaaagacaaactgtgtttgttgaatgaatgacgtatgtgaaagctcttcctagcagtcttatttggagaataaagctaatgcaggaatgtgtggagaaatgggacaagaggattagacagggactaggatgaagggcctcatgcatggctaaggagtgcaaatgtgttttaaggttctggatcacagctgaaggatgtcatgcaggagaatggcgtgctcagctctgttctagatggatcgcttgtgggtactgaacagggaggttgaaacgttttgtattatgtgagtttagaattacatgtggtctttctagacaccagccttactaaaatgcattgccctgactttgaagttgtggctgaggatgagatcactcagggagtgtgtggaatcaaaagggaaaggacaggggagggatccttgtggctctatcaccattgaaaggttggtcaaaggaaaagaatccctcagttcttcctttccttgcttacttagcatgactaaataaaaagtttactgaattctgtaaattacacctaaaactgtttatttgaaaagttttttttttttttggtgatgcattttttaagtaggaatcttaaaactcattacttccagtgatgcttacctgcatgcttcttgagccataagctgatgagaatttggaggagagacctttggtacagagagctcagcaagtgtggtggagtagctggggtgtcacaggctcctccgtccggaaagcttcctggctcctcaaagcttctcttcattggtgaccacgtggcttccaaattgacttggacttggttcacactttccatttagacgacgcgctttgtggcttcccatccacaccagcacatgcatgctgaaactgctgctttcgttctgaatgtttttggttagtgttgctacttctggtagtggttggacttagatcttcatgtcctgaatatgaatcctgttgcttgatgagggtctaggtcatgcctcgggggtactctgaggatatgtgtggagtgcagagacaacattctagacagatatacactttttattattaacaaactttggccacaacctttgatgtataaattgccggatttccccagtcctttcattgtggctttggacaggagcaggctcacttgtctgcttcaggctgcctttctcttgggttgcacctcagttcttacttatttatttattttgagtggagcataggggcctcttccaaaatgggtagagctcaggggctttcttattgaaatggtcacatgataaaaacgggctgaaaaaggagagttccaggagaaaagcccagaaaagggcccctcctcagaagacagcctttaagcctcttgcttactgcaggaagccccaccttctagcactgaggccgggtctgatcttccagaggagttggaggagtccatgagaatggccaccattcttgcttgctgctgctgatgttgcagttttgagagaacagcgggatccttgttgtcctctagagacttgagtctgtcactgacattttttcagttcctttgctcatagaccatacgaggaattagtgatgtgtcagttgagagttcacaatctcattgttcatttaattcactttaaagttgtcaatttctgtgtgagtaacctgtaaaagacacctttccagaagagttttgccgtctgtttgaaaaaaaaatctttataaactttcctaagtatctggatttggattccttatttggagagaaaatgttggccccagctcacatcacatttacataaataaagcagtatttcttctgattaaaccaaatcccaatattcacaagagatttcataccaccaactttgccttgaagcctgacacatgcagtatgcatgaatcgaaccagatgcccagtggaagtatgcagtatgtcttgtttagtttctaagaattcagacttcatttgagttggctgattctcctaaactcaggtacttctgtgctatgcgttatctcttatttaacaccattggtccaaaatgttaatgagccagtttatattgtttaatagtctctaaattctttgtggcaagtccttgaaatcaagcactgttaagaagatcactcaatttagtttaataagaagttgtattcttaagagattttattttagaatgaggtgtatctgtgtaggaaaaaaatgctttttcttttttcaagtttcagattcagatgttctctgagacctatttgaaataagatggaaaaacaaagtgagagtgtattggttttctatggctgccataacaaattgctacaaatttggtggctttatgaccatggggtcctggagctcagaagtccgcgtggctcccactgggctcatgttacggtgtgggcgctgctgtgctcctttctggaggcttcaggggagagtctgtgcctgagctttccagctctggaggctgcttacattcctcggcttgtggccccttcctctgacttcatagccagcaactccaggctgaatgttttcgctctgccatttctccgctcctctctcttccacctttcttttccatttgtaaggtcctttgtgctgacattgggcttacctggataatcctggatagtctccctatcttaaggctaggtggttactaacttagttccatctgcagccctaattcccctttgacatgcgacttaacatttacaggttctggaggttagtatgtggatgtctttaggggagccattattctgcctaccacagaggtatgactgtgtgtggcaaaaaactgtttatcaagtacctagtgtatcttcagcctgttttgttttggtttttgagacggagtttcgctcttttgcccaggctggaatgaagtggtgtagatctcggctcacggcaacttccacccgctgggttcaagcaattctcctgcctcagcctcctgagtaactgagattacaagagcccaccaccatgcccagctaatttttgtatttttagtagagacgaggtttcactgtgttggccaggctgatcttgaactcctgacctcagatgatccacccttctcaggctcccaaagtgtaaggagcataggtatgggggccaccacatctggccttcagtctggttttaaatctcaaattatacatcagcggtcctagagacattaagtgacttgtcattgtcacataattattaataataatgatctgtgatttgttgagttcttgctaagtgtcagataccataccaggacatttataggccatatttttcccaacctcaatatatccctcttagatgcatgacataaattccattttacaagtgagaacacaggctcttctggaagttgtgactgatgcagtgtcacatggctagctgataaccaaatgctttggacttcatcagtctgattcccaaacccatgctgtttctactaaattacagtagattaaaatggaggggccttatggagttactttgtcttgcctcccacatcacagtgcagtcttatctggacaatctgtgtagtattcagagtgcctgtcagggtatttgtcaggttgtttggtatcatatgtcaaaatgaccaggtagttaattaattgacttgacaaattttctttgttttccttccatcttcccacttttttgttttttttgagatggagtcttgctctgtcacctaggctgtagtgcagtggtgcaatcttggctcactgcaacctctgcctcttgggttcaagcgattctcctgcctgagcctcctgagtagctgggattgcaggtgcacaccaccacgcccagctaatttttgtgttttcagtagagatggggtttcaccatattggtcaagctggtcttgaactcctgacctcgtgatccacccacctcggcctcccaaagtgctgggattacaggcatgaaccacggtgcccgacccccatttttattaataagaatatattgtgctcctctttaactgctgcatttgtttttcccccaaacactgtcttctcatcttaatacactgcagtttgggaaatggaaatcattatccttgcacttgcttttccctctgccttttcgtgctaggtgtgttgtattatctaaagcaccttttaggtaataacactgttaccattgagtagatggggaaaccgagcatcagaaaggctaactaactctcaaggttatgtagtatgtagtagagcaagaacttcaatttgtgtccatttggtttcaaggctctgtagctcatggcctcagaaacttttcacattaggtgggtaaaaaatatataaaaatatagagtaaggataaaaaaggtaaatgacattgaaagatgggaatagaggaaatgttgaaagtatagtgacttatttgccaagtgaattttaccagcaattgatatagtagaagttcagaagagaaagattattttaggctgtggtcattgttgatggcttatgaaagagaagagattattatttaatttccataaaatttattctgagatattcataatcagaaataaaatatgtaataatgacaatgataactactatttattgcacatgcaattccaggatctgttttccagatcttttcatatattatttaatctttgcaataatgtatataggttacatatacagatagatagatacagccatatatattgatagataataattatcttatagatattgttttatagataataaaactaagcctgagaagttaaatcttagtgtttactgatatgtagcagggcactattaaaactgagctctgttttgacttcaaaacctgtgctttttttgctgtgctgtaaaaagtgtatcttattcacagatttttgcttccgttctgcatattcaacatggtcacttgaaatgatttcataaaatattggaaaaatgtagagaaactaaaagtttctgacataataagtaaacagttgtaaagaatactcagagaacacaaatatacatatttaaaagtaaggctaaaatgtgcttgacttatattgaccctgatgagctcagtgacatgaaacaaactaggacttgattcagtgatttgtttccattgctgtctgcagtaggttgaattatggcccctaaacatgtccttatccattccccacagtttgtgaatgttaccttacatggtaaaaggtgctttgcagaaatgatgaaaaatcttgagatgaagagagtatcctggatcatttgggtggacctgttatcacagtggtctttataagaaggatgtgcaggagtcagtcagataggagtatcacaaccaaaccggattggcgtgatatggccataagccatggatgctgcagttttcagaacagggataccgtgttcagatgtgtcctcagtatctgtccatggcttgtaaggaaccgggtgctcagcaggaggtgagtggctggtgagtgagcattaccacctgagcgctgcctcctgtcagatcagcaccaccggcattagagtctcataggagtacaaaccctgctgtgaactgcacatgtgagggatctaggttgcatgctccttataagaatccaatccccttgcactcctgtctatggaaaaattgtcttccataaaactggtccctgacaccaaaaaggtcaggaactgctgttctagaagatgggaagggcaaggaaaaggatcggagcctctagaaggaatgctgccttacatacccattttagatttctggcctccagaactgtaagataataaatacatttttgttactgtgttaaaccactaagtttgtaataatttgttacagtgacaacaggaaactaacacaatggctttaaataattatgaactttttaataataatagttggagacttcaataccccactttgaatgatgtatacaacaactaggtagaaaattagtaaggaaatagtagatttgaacaacattgtaagccaactagactcaacagacatctgtagaatctgccccctggtaaccacaggaaatgcatttttctcaagtgcacatgaggtgttctccaggatagaccacatgccagttcatagaacaagcctcagtgagttttaaaggattgaaattatgcaaaagatattttccaaccacagtagaatgggattaagaatcaataacagaaagaaatttgggaaattcaaaaatatgtggaaattaacaaactccaaaataaccagtgagccaaaaaagaactcataagtgaaattagaaaatattttgacatagatgaaaatgaagacactacatgtcaaaacttaagagatacaacaaagcagtacttagaggaaaagccctatattaaaaataaaggtaaatctcaaataagttacctaaccttccatcttaagacactggagagcaaatgtgaagtaagcagaatgaaggaaataacacaggttggaatggaaattaatcaaataagagaatagaaaattaatagagaaaagtcaacaaaccgaaaggtggttctttgaaaagatcaacaaaattaacaaaactttagctacatggactaaaaagaaaagagagaagacttatgttctgtagatgtctgttaagtgtaaaattaggaatgaaaacagaggacattccttctgacctgatggatacagaaaggattatagggaatactatgaacaactatatgctaataaattagataccttagatgaaatggacaaatttcttgaaagacacaaataactgaaacttgaaaatctgaatatactggtttataaattgttaaacaacaacaaaaaacctactcgttaagaaaagctgagatccaggtggcgtcactggtgaatcctagcaaacatgtaaggcaaaattcttaattcttcacaaactctttcaaaaatcagaagaggagggattgcttctgtcttagtcctttggcatgctataacaaaatttcttagaccgagtaattcataagcaacaaaaatgtattgctcagagttctggagggtggaaagtccaagattaaggtgctgagaaattccttgtctggggagtgcctgttcctcatgaatggcaccttctatgtgtcctcacatggtagaagagtgaaagggcaaacaggctttcacaagcctctgttggcattaatcccattattcatgagggcagagcccttctgacttaatcacctctgaaagaccctacctctttataccatcaccttgcaagtcaagtttcaacatatgaatattgcggggacacaaacttttagaccatagaagcttcccaactcattctttgaggccattataaccctgggtcccaagtcagaaaaagacatcacaagaaaactacacatcagtatctcttatgaatttagatgaaatcatcttcaacaaaatatgagcaaaccaaatctcagaacatataaaaatggaggattatgcaccatgaccatgtgggatttatcctaggaatgcaaggttgggttagtattcacaaatcaagtaatagaatacctcatatcaaaagaataaaggacacaaacctcataatcatttcagtggataaagaaaaaagcttttaacaaattctgaccactttcatgataaaaaacacccaacaaattaggaatagaaaggaacttctaaaagctgataaagtacaatatatgaaaacccacaggtaccattatatttgtgaaaggatcaggaacaaagcaaagatgttgtctttaccacttctattccacattgtcttggagagtctagtcagggcagttgggcaagaaaataaaaggcatacagattggaaaggaaaaggtacaactaagtatttgtaggtggtaatcttgtgtatagaaaacaaggaatccactaaaaaactactaaaactaattaattttaggacatttctccttccccctcccctttgcatttaaattcaaaatggaatatttcttctgataataaatgtagtatatactttactggattataagtttccaagattcttgtctgttttgtagaaccctgtgtaagtaccacctgtacaaatgtctagtacatagaaggcactctttacatacttgaatgaatgcttattatagaaaaaaagtggaagatgtaaaaaaggtagaaaggaaaaaaaagagaaatgtgctttccataaagcaatcaatttgagataactattggttatattttagacaattttcttcattctccatatgaaattttatattaagtttaatattctgtcgtagtcattttcttaagtcgtcagaaagttgtgaatactgtttttcatagctgtgtagtacttcatgttacatatgtcatcatattgttaactgattcttcactaatgagcatttccaatttgggaattattaataatcctgatttgtctgtcctgtctttacactctgtccatctctgttcttaccttgattggcttcctaaccaccagcattattcttctcccttttcaggtttgcagtttaaaaggtagcagtgcaacaagcaaatccaatgaagtcattcttttgtttaaaaatttttcattagttatcagattagatcttcaagattgttttaggatggtattcactgccctgcttacctgtccagtcttatttctgccactcctctctttgaccctgaggttacaatcatgctggatttcttgtctgattcatgaaagccacgatatatatatatatgtatatatatatatatttaatgtaagccttctgtgtactgtttttttttttttaatcacaggtgcttttttatcttatgtgcatatcaactcatattcttatggactcagttcaggtgttatcacctacaggaaactgcattgtcacccactttaaattatggcttgagtacccacttctgatctcttagagcacgctgcatacctctgtcatagtctgtcacactggattggaatcttctttatgtctcccctgtagagggtatgctttgtgaaggcagggactgtgtatgcacggtgcttgaaacgaaataggtcttccataaacgtttattcagtaaattctgcagtgaagctctttgtacacaagtctaccagccaaataatttctttaggagagctttttagaagttgaataactaggtcagagttaatcaacattttaaaggttcttgacttacatcgtcgactaacgttgtcaaattgatttatagatgagttgtattagttacactctgccatcattgcatgtgagcacttaagtggggccttctaaatcatattttgtagtaagttctgttaagataattggtgctgtcactgcttgggccatggctgtttaggaagataccaagtagaaagcatttatttggcaggcttgcagcctgtcaccgtttatgagtgcttgataatgggaacaaaatgtgccaaactagaaaactgaaggtttggttttccatttcccgtcctggtgtttggttgcctttcaaatagaatttgttgttccttgatactgttaaatgggcagagagctttctttggcactcagcataatgatctaaacagtaataggcacactgccagaataaatgcttttcagaatttggaaaagctgttggagaagcacttctttctggttttcttctggggtttgcgaagttaataaaagatgtcattaatgtcactggacattacattaatgtataacctcagagttgctgattaacttattatagtggctaaagttgtccataggcagaaagaaaaataattaacaataatatatgcagtctttggatttgcatttgataaaacctggagtaggattacagagcatttcccagtgttgccctgggaaatggtaaatggtcagatttttcttttttaagccttagtacgtaagaaaagagggggagggtagaatgagctcttggttaccagactggtttctggaagaaacctcatgttctctgaaataattctttatcagttacatgctcagattgtccttatgcttctgcagacccaaatgtacctacgtgtcatctttttttcccaatctccatttacttctttgagtttttgggcgcgtgtgtatgccggggtgggtgagaggtggcattagagactggaagcttgctgtttgagatgatgatttcattgtttggacaaggggtctgatagaatggatataaaatgggctctgcagctattagctgtgaggatttgggcaagttagtctacctctgcagcactttgcacctctgaaaagttgactaacaccacctagtaggtagcagggatgttgggaggtgtgtatgaaggtcagtggcagtaaatgaagtatttgtgaagcaccttattaaactagtgcctggccagtagtaggtgcccaacaaatgttaattcctttctttttcataaggctgtttccatcagaacatctaggaaagaacgatgtacgtaaaataacaggtagtgctttgttgttctcatgcttattcctggagacaatatcattatttgttttttttgtttctcagcatttctagacatcaagtatctttctccaccccccaaccctgtatctcttttgcattaaaaagaaaggtcaaaactgaagggttttctctatcgaattgtatttattaattaaatactctttgcaactggctgatatttgaaagttgctgattatatttatggactcttttcttttacattaaacatgtggcacagtggtctgacctgtctgaaaatatcttcttctcaaaccagtaattattacagttgcattatacagcactgaacccaaagcatgatggattgtggcaagtaaacacattctgctgccattagtggtttgttgtggtttgtaactgcccatgctggctgtcattgccgtcagattggggtgtagtaagatgttgtcatggtggctatgggagaaaatggagggaattttctgcccttcggaatctgaagctaattagtccctggaactaagtagtataaagcatagacttcagattcgtactctgagtttgcattattctttacttttcctttatgaacagaggaggatattcatgtcatgagggtatcatatccttatgatagaggatatttgtgtgatgagggcatcagccttaggtgcctggttctgtcccctgcatggcttcctcctgtccatctgccgtctcttgcagggctgaacttactcttccagatttggagatacttggagtgtttgatgcttgaatcctgtcatgacctgcttattctctctccctatctagggctgttgggactgtctgtttctgggcctggacaggacatttttagatatgtttagagcataaatgaagaattcccattggttttgatgtaagatgactttgaatgttcactatttttggaagacaggatagcatggtgatgaagatgaggcctctggaattggaccgcttaggtttgggtctgtcttatccctgtggcttactagctgtatgtcctgggggaagtaatttaacccctcactacctacatttcctcagtaaattagaggtaaaatgtggaataggtaaaaataaccaccacaaagagttaatgtgaagtaatatgctaacatatgtaaagcattgagaaataaaaataaaatcctaagccacccaactgactgggtagacccctcttggccaacgggaccccagaaaaactttaaaaactaagtttcccagccaagataagatggaaggctgatcacgccttagtacactcccttcctcaccatcgctagaccttcttccctaagagttaaacaggaaccagccctggaaaatgaagaatggaagactttggctgacccactgcctgacacctgggctaggcccctcctctccgccggctgtgcctggcagccacctggttgtggttacagagcttgcctcctgagacctgaccattgccatgaactggctctggccagtttccagcggttgctcacaacccgcctctgtgtctaaaacttcacctttggacatttagagcctaattttactgcattttaatgttaactctctactgcaaagtgaacatggcatttatgtaacatgtatgtttgctcattacacatatgtgactcccctttcatgaatattcacagctcctcctataagctgttaaatatgtatgtttggccaacttgcttagcatatttaaaacttctgttctcccctttcttcctcaaagtcctgctttagatttcagccagaggctcagcctgcaggttgcaacccttagaaagttctcctttccaaatttatatattttaagttgacaatatttattgcctgggaggtagtaacatttattaaatgctagctattattattattattttatagatgctatttgtcgagtgctgtgccaactgtggagcacacgaagataagaaatagctcctgacatcagaaacgcagttgaccaggatgtgtacagtggcactgtatacagtgtgataaatgctgtttacagaaaaaaccctctctctccatctcaattatccttcttactcagttcagttttcttcagtgcgctcctttgccatctgacacatgatccatttatcatgtctgtccccactacaatatcaactctgtgtaaacagcactttgttgtttattgctatatcccagcacctacagcagtgactgacatgaaggagacattcaatgaaagatattgaatgaatgaatattgaaagtgctctgggaagagaaaacaataaattaatgtggatgagacaagaaaaattacacagaatggtagtttttaagttgggccttacaggatgagtaagagtttgccaggtatctacacggtagagaaggacatttcagccagaagagccaaggtttagagataaagtatgacggtctatggcatgagtgaggggaaccagtcacacatgttgtcacatcagatcatttgagggccagttttcctggatattcatttttccatttgattactttttgtcaatcccgtgttctcatctaagttcttgcttattgcaggaatttttttatatgatagtttatttttctgtgtgaagttaatttgcaaaataccagctattcctgagtgatataatcacgcacaaataggactaaataatgatgataaagataagggtgatgacggtgatgatggcatttgcaaagtccttcacaggccttcacccaagcattttcacctgttacttcattttagcatcctagtaacactatgaggtatgcaggattgattggcatttcaagtttatatatatatatatatatatatatattttatttttctagagcctcaaaatataatgtttacaaagatacaccaggcaagaatccttttaatactaccaagggccttagctcccgtctggtgtctttgttgttgacttgtgttaggcagtaaagcagtctggaccagagggcacagagcagcatgccagagactccatttgggttcccagtcagctttctgagagtggccgtatgcccagtcatgaggcactcctggactcatcctcttcatgtggtctaatggtttgagaagcgaagtagaagaggtcagtgagacagggggtgatgaggtgagtctctttccagtacatttctaatcacttatttttctctttaaaggtatcatttttttctctagaatggaagctctatgaaggaagggtttttgtattactcacttttgattccagatagtcaaaacagtacttgacatgtagaaaatagcaaacattttggatgaatggatgctaaataggtggtagctcagtttgtctacaagtagtagtacgttttgccctagggctcatctgagctccagttcttggataaaggggagatgagggaaatttacacacagcccagagattagaggtttgctagtaggaaaaacagatgctatcttcattttctaagtgaaaagactgagacttagagaggttaaataacttgcccagggttatatgacaggttaagtggaagaactattttcaatcccaggtgtctgatatccagttgaatggcttcctcagcttcattagaaaggattactaatatttgtttatatggaatctatgcatatttagatatgtatgtcttgtgttttgtctcccagatgttttcagcatattaacacagtttgaataatattccttggtgttgtgtacattcattaaaaattgacatgcttaattgtgacagaaattgatgtggagaaatattgttatcagataagatcaaacatgaagcatactgcacacaaatacttattttaaaacaatatatctgatgaaagatacgtgtttaaaagacccttgtcttttattttcttaaagaggatggtttgagctaatgtttggacaaaattatttttctctcctatcaggtattttgaccataaacctttagacctatttaaaacaaattttcttcctttattctttcctttatatttctttaatttttctcagcattctatatcttttaaatgtcatatattcattgtctaagtatatttgttatttgacaccatttgtatttaacattacatgtaacacacgcttcttatgtttgctaggctgtagtatttgtcacaaaaagaaagatattttaacagctcaataaatgaaagaaacgtggttcctcctgcaacctatcatgtatacctggtaaagctacttatttagtaagtagcttagaggtgctgctggttcccaggagggccattcttgtgtctctttctgctcattgttggtttcctagcacatggtgggctttaaatgtctgtgaaataagtgaatttattaaatacctactatagcagatactgaactctgggctagatagaggagaggaggggaataaagatgatattctgctttcaagatgtacatagacatgaaaaatacattaagagaataaggtgttaccatggtgatcctatcatggtggaagcgtgccccaagcatggggagagcccttggagaacacaagtcatggatatgtttggagggagttttcacaggaatggtacatttgagattgtgttgaaagtgtaaatgggatggaaggagaaaagggagacaggataatagcacatacaaagtcctggagcctcgatagtccatggtggatttcacaatggtgaagagttatgggtggatggctgctgtaaggaagggagagaggatgagcgagaacgttcaatgtgactaattccacctgggtatctgtactgattaatggaatgtggacattgctctaaaagcaagcagagtaatctttgtaactctgttggatttaagggattgttcataagatgattagatcttgttacacagaagtgcttcaaaaattatatcaaatcattgttaaaaattttaattttaatgtgttttattgttttcacaaattggtgctgtgtgtgcatgtgcataggtgcatatgtctatatacatgtgtatgtataagtgtgtatgtgggacatcagtattcagaaaacatctctatatagtatacaagtatgtttatatgtaaaattgcatatatagttatatgtaaaattacgtattttatatagttagatcgatttgattttaactggtacatgtgctgatactgatcatgctttgcttaaaggaagattactaccgtattgatttcagaaacagaactaagcggggaatgaattttttaggtctttgggttgttactgccaaattattgaataagtagcattgtcaggtatacgtgataagttgcaggaggaaccatatttatttcatttactgggatgttaaaataactgtcttattgtgaatagatactgcagcctggagagacaaaaagtttgcagaccgacttcagattcagcttattaggagaaacacttaaaaaaaaatttatgctcttatgcgtactggtgtttggattcagcatctagagattagagaaagttaaggataacaattctcagtggagttccaggcatccttttgaaaaattatgtcatccttaacaacagggtgggttgagaaatagaccaatatgaggaagcaagcctactgatattcatagtatagacttcatatttgatcaggagtctggctgttaccagaagcatagaaagagtagatgtacaatttgcagctactaaacagcatccatgatttgaatacagtatggcatcgtaacttaaggaaaaggggcttgatacttactgtagtcagcatcaaggtagttcctgccttgcttaataagtgatgcttatgcttaataaacattttctgaatggctgttaaatgtttgttcccagctaagcctgagttcttaacccagcactgctaattattagttgtgcaatgttggttacttttttaagccttctgtatttttctgaaaaataaaggaactattgtgtgtaaaagcccagtaatgtacctgcttttagtgaatgaccatccagtaaatggcagcagctgttagtgtgattaatatttttaaattattgtcaaattttagctagtaatatatttagagaatttcttttttcttttttggtaattctgtccaatgccttccccaactcctttcaaagtttgccttactagctagactctaaaccccaagaggacagtgcctgtttttttgtttggttttgttctaaatttaccaccgtatctgtcatggtgctggacagataatgtgtgtgtggtaagataatgtgtgtctggcctagacttaatatgtgtgtatttgtactagtttttaacaaaaatagtttaaaaagtaaagctattggccaggcacggtggctcacgcctgtaatcccagcactttgggaggccgaggtgggtggatcacgaggtcaagagatcgagaccttcctggccaatatagtgaaaccctgtctctactaaaaatacaaaaattagctggaagtggtggcacacagctgtagtcccagctactcaggaggctgaggcaggagaatcgcttgaactcaaaaggtagaggttgcagtgacccgagattgcgccactgcactctatctggcctggcgacagagcgagactccatctcaaaacaacaacaacaaaaagtaaaactagagtcaaaaagttaaaaaacaaaagtttataaagtaaaaaagttatagtaaggtaatatgaattatttattgaagaaaaaatatttcttaataattcagtgtagcctaagtatacagtgtttgataaagtctacagtagtgtgcagtgatgtcctaggccttcacactcactcactcttcagagcaacttccgctcctacaagctccattcatggtaagtgccttatacaggtgttctgttttttatcttttatagcatatttttactgttccttttcctttttggctagatttagatacacaaataccattgtgttacagttgtctagagcattcggtacagtaacatgccacatgccatacaggtttgtagtttaggaataaaagcctacaccatgtagcctaggtgtgtagtggactgtacccctaggtgtgtgtaagtgcactccatgatgttcccacagaaacaaaattgcctaatgatgcatttctcaggacagatccccatcatgaagtgacacctgactgtttatgttaccagtgtggatcttcccttgcctccccttcctctctagtggcttttagaattgcttgcttttcacaatactctagtgatgagaagtgattgatccctagttcctggtcatcagcctaagaacacatccccttttttctcctgtctccctacctcttacctggcagggagaagctcctgccattcccatcttaatagtgtcaaagtcacttttttaggtttataggctgcctgtacatattgaaggttagagccagtttttgtcctcaagtttaaaactcagtagggactaaagtgtggacagttggttatcaatattaatacctgtatcttcagagttaatataccttttcagataatagtaataaatgaaaataatatgacttattaaaaatcaaatgggaagtttctctttttgttttaaccaaagttgtgtttgtttctgaagcccccatctgtaggtagtgtagaatatgaatcacaagaccaatttctgattttttatgattaaagggataagacaaagcttagataatacagaagagaggataatagcttgaatgtggagtcagtgggcagcatgctgataaagtgttcctggccaaatgaacctgctctgtggaaagaatttgtactctgtattgtgtgctccatttaaaaattggtaatacatgtaattcagaaatcaggaatttttatgttggcattattaaacattacttgtcagagatatgggtgtttctttgcgtttctttggtagtcacagacttaggtatctgtttcattctgttgctgaaaatgtgacttcagccttaatttatgtatatttttctcctttaattttaagaatgctttttctgcattgatgctttcttattttgtactgatggtattgctctcctctgcctcatttctccaaataattgtgaactttggagttgggtttttttgtatgtgtttctatgcctgtctgtatctctttcacctttcttgagaggaagatgaatagaaagatagaatatcttcagttacttttcatgtccctagataattgtgaggtatctatttttgtgtatgtggcactttacttctccaaccactgttaggtacctaaggagggaaattctttaggttttaggaacaaccaaaacagcccccacaccaaaaaaaaggaaagaaaaaaaaaatgaactggaactcatgcattcagttagctttattccatttaggtaaatacttagggcgggataaaggtaaacaattctactgtgtgtatgtatgtgtgtatacatttaattttaaactacatgcaagaaaactgccctggtttacaaagctaaggaccagagagccccaggagagaagaaggggcagtggttttcttggttggagaagagagttgacattcatattcatagattagcgcagtggttctcagtgtgtcattcaggaagccctggaggttcctgagactctcacagggggtcttcaaggtccaaatgatgttttataataagacaacgttgttttagcctttttttactatgttaacatttttacttataattcagaagcaatggtaggtaaaacctaagcctcttagcagaaattaaggcagtgacaaattaaggcagtggcaccaaacagtactggtagtaattttctttttcactgcctggtgccaacttctttttttttttttttaagccaattttacttaagaatgttccttgatggagcaatagaaatgattaatgttatttaatgttgttctttgagtacctttttaaagaaaaatatttgtttgtgacaaaaagagaagtccatatgtattacttcttgtggataccatagtactagatagttgtctcaaggaaggtatcaaatagaatgctgataattgtttggcaaaattcagggatccctatgatccagtaatatgagataatggatatgaaagtactttaggtagtagattattaggattattagcactagatacgtggattgtagtacttagctttgctttgtatttttttagctgaactttgtgtatcttaaaatgcatttcacatttacttgatgacagtaattcaaatacttgtatatctgtggaactaatcaagatagagacagctttatgtctggagaaagatgtaagatatattaaagaaattgggaagcaaaaaaggaatattgagatatatgttctacttccaaattaatctgcatatggtgaggatcaaaattcattagtttacatatatatatacatatatatatatatatatttcctctaaaaccatttgttaaatgaatgtattttctccactgaatgcctctctgtcaaaaattgattgaccatatgtgtgtggatctgattctgaacaccattccgttctgttcctctgtttgtttttccttaagccagtaccaagttatattgattattagagcatcttagtaagttcttgaaatcaagtagtgcaagttcttcaactttgtttttgtttttcataattttcctccctgtttatataaggaccttgtatgcaagatccttttgcacatgtatatgtgttttaggatcagcttactgatttctgcaaaaacagtctactgtgcttttgatagggattgcattaaatttataaatcagttttggaagaaatgatatcttaacaatattgagtcttctgatccatggacatggtatatgtctttattatttacatctttttaaatttctaccagcaatgttttgtggttttcaatgtataggtcttacacacattttattaaatttatccctatttcatattttttgatgttactggaatttttttttttttgagatggagtctcactctgtcccccaggctggagtgcagtggcacgatctcggctcactgcaagctccgcctcccgggttcacaccattctcctgcctcagcctcctgagtagctgggacagtgggtttgttgtagactccttcggattttctggatagtttttttttctcccaaatctgaatttcttttatatttctctttcttctcttatcatactggctaggaccccactacagtgtagcatagatatggtaaaagaggacattctttctttttttctgatcatagggaaaaatcatccaatctttcatcattaattgtgatatgtgtaggtttttcatagatgttctttattaggttgaagaagtttctttttattcctgttttgctgcaagtttttattatagtagttgtttaatattttaaaatacttttctgcatctcttcagttgatgatatagttttattggtctgttaatgtagtgaattacattgaatattttccagtgttaagccagtcatctacttggggtgagccacactaggtgatcatgtattatcctgtttaaatattgctagatttcaatttgttaaaaacttagtaataactttttcatctttctttatgaggaatgttggtatgtagttttctttttcttgtaaaacttttgtgattttggtattaggctaataaaatgagttgggaagtattcactctttattctggaagagtttgtgtacaattgttatcattctatcttacatgagttcaccagtgaagccattgggcctagagttttctttgagaaaagcttttaaactatgaatttagtttctcgtatatagaaggcctattcatgctatcttttcctttttgagtgagctttggtagtttaaggaaataatctcatctgaattatcaaatttattggtgcataactgttaataatattctctgattcttatagtgaatgtaggatctgtggtggtgtcagtgttattcctgatactattaattctttactcttttttttcttaatcagtctggccagaggcttatgaattttattgagctttccaaagtatcaacttttggttttattatttttttccaatattttgtacttgtaatttctttggtatcttctcgttattttttcctcttctgtttctcttatttttttttttttttttttttgagacagagtctcactctgtcacccaggctggagtgcagtggcgtgatctcggctcactgcaagctccgcctcccgggttcacgccattctcctgcctcagcctcctgagtagctggggctacaggcgcccgccaccacgcccagctacttttttgcatttttagtagagacggggtttcaccgtgttagccaggatggtctagatctcctgacctcgtgatccacccacctcggcctcctaaagtgctgggattacaggcttgagccaccgcgcccagccctcctccttttgtttcttgagcctgatttactagtttcttcagttgtcagcttagatcattgaactgaaccatttgtatcaatgcaggatcctgagcaagctggttttctgcccttcctccagaggcagataacctttagtgttggtgctgtatgtgtgtgtaggctaaatcttccatagtgggttcaagagaatgtcttctcatcccctccaccatcgccattctctcacccaggtgacctatggctttggttccaaccctttggctggaagctgtggggaacctgtggaggtggaggaaggcattgattgtgagggttactgaccttgccctgggggtagatggtttttgctttgattgagagtctgtgataatgcaagcagagtttgttgttgttgtttatctaatctccacttgtaccacctggaggagctctcttaagtaccctttcttctcccctagtcgtgcttgtgagcatctaagtggaattctgtggaaaatgttggagaatgagtgttttctcccaggtgttttaaactattacaggagcccacatttagcctctgacgatttgataagattttgattgttttcttcctgctttcttttgtagctgccacttctgtgttctgccaaaggtgaagcatttcttgggtctcatctctctttggaggggctttagaattccactcacctgtttttgtgaccgtaactctctgatgagctcaaaaattattttgtcaattatccaactttttgtcattattatggggcaagctatgttctcttgctgttttctaaatcctaagtagaagttgaatctcagcctgccaggcttttaaatgcaagcagttaattacctttaggactcagaggaatagctgaattagaggtaggggaaatatatcatgacaagaattaattatatcaggcagaacatgatatcagtgagaagacgatattttcttcttccagaatttgtgccagtaaacagcacttttactcccacttcaccctagtgtctgttggtcctttgcaacttcttatttcacttatcatattccaccatgatttttttctttacaagtttgttgaagctaccaaaatctgaattcctaaaggttaggggcttattttaatcattgtttccctagctgcagtttagtgccaggtctatgggccatcactggatggataggtagataattggagtgagaagagtggtgaagagtggagaagagttgtgtaggaagagccgatcttggcctctctggaggtaattagagaattgggggaatgaatctctgagatggaagtagttacttgggttttaagtgtagatatgtggcacttttaatattttagaaagtgtagtttaagcaagtaaatattacttttgaaatgcaaatatgtgctacagagatatgtattcccttctagggaagtaaaagtagactctgcagatgagccaagggctgtgtgagatagagcacactgaatccttgagctgaggggtgcatttaactacagctagagagatatatgggcatggatctagtatgagaaagcagaagtaggaaggaaaactgtagagagagggaaaggtcatgcaaaaaaaaaatagcaaaagataatcagtgacgaagaaaactcttcagaagcatttttttttgagacagagtcttgctctgatgcccaggctggagtgcagtggtgtggtctcggctcactgcagcctgtgcctcctgggttcaagcaattcttctgcctcgacctcccaagtagctgggtttacaggcacatgccatgtcacccggctaatttttgtatttttagtagagatgggttttcgccatgttggccaggctggtctcgaactcctgacctcaggtgaccctcccgccttggcctcccaaagtgctgggattacaggtataagccaccatacctggcacaagcattttttaaaacaagtaataggggtttgaaaaaaaaaaagtctgtaaatatccactaggctgaacatgaaggaggctacttaataggcaggtggctgccttggcagtttcttaacttaaatttccatgtcctgatgtatatattttatttattgctatgtgatcaactacctcaaacaaagtggtttaaaacagtgtggtgttaacccaactgggccagacactcagcatggctcatcccatggctgctggtcggctggtggtcagtggctgggaactcagctgggagcttagctggagttcttggccaactagcttgcctgttgcttgcccgtagcttgcccatagccttatcatggcttgggcttcttagaacacagttcacagagggactgttgcaagggtgagcaatcaagaggctaagacaggatcgaaatgcatcttatgacctagacaaggaagccccagaatgctacttctgccacattcttttggttcagtcagtcagtaaagtgagtccagactgaagaggaagtgaattagacacctctgtccttggaaggagtaagagagggaagttgggaccatcgtcgtcatttgaatggtgatgagcacaaacaaggcttcactcttttacaaggcagactagcccttagagcccattggtatcgtccagtttgaatatccccacttcattcctggactgctctgagtgccagttgagtcagaaaatcagctatgctgttaacagtggatatgtcggaaatgctccggcagtcctaaaggcaggtttagaggagtatttccgacgaggagattgtgtcttatgacctcagcagcccctgcttgcatgtcttttctgcctcttcatcgctacattttaatggctgttttcaaggcctttagggtttgtaagtgtttcttttctgcatgaattcagccttattaccttttatcacaagcatcacaagcatctcttgtggtctcttactaataggaagcgacataccagaaaactcttctcttgggcgtgaagggggagtcacaggcacaaattataaggttattaggacaaaaaaagtaatatatcaaaataaattgataatgttttactataaatgcctaaaacagcagacatttattaatgtcttccatatatcaagcactgtgcttaggagttgctctttatgcactgaagttatttaatttttttcagtaaccatggtatgtaaataatattttcctcccttttacaaatgaataaagtgttaaccaagtgagtaagttacctatctgaggtcgtaaaaagctagaaattggacattctgtttgtattattccatttgacttctcaaaaatacattcttattctgttaataattgggccactgttagaggatttacatgtgataataggaagcagtgctgtccttttgcacttaattaccatggcatgatggtgccttccttccttgatgctgccctgtgaacctaggttggtggctggattcttaagctaatgtgttcattaaaggatgatgcatggctctgtatgaaggggatgaatgggttagaagacattctcaacctcagagatgaaaaaaaaaatacagttctatctatattgcactgctccaaggaactgaagctttattacataaaacacactttccttggggattcttttggggatgacaaataagagagctttttagttttaattaaggaatgcctcagcagcagtcttctaagtggttcaactaccgtactgcattacttctcacgaagcaagccatcctccctagggtggccagaatgatcttttatcaaccagacctgatcacataattcttgtgttgaaaacttttcaagagatcttagtttacatgtcctttctttgatctgaagtggactggattgagcccatctgctgatagatttcatagccctgcctacacacctgttcagaacattcattaacctttgctgtaattgtctccctaatggcttccttccctgcctgctttgtttcttgagcatcaaaactttgtttttcttgtttctggaagaattctgcagccagtatatagtctgtaaaatgttagaggcattcaataaatcaatgaatgaaaatggtttcaagtaatggtgaaaagttgttttttcttcttttttttaaaaatatcattacgtatgcatagattaatcattcatttagtcatctaaaatacgttaaatatatactctgaaatacggagggtgcagaattaagaaagcccttgatctggtccccatgcgcacaatcaggtgtggagacagcactaatacctgtggtgagcgtcgtggaagcattgcacaaatgtacctgtcatggacagaactgggtattgttttaaacaaatctgcattactgtacatttgagttagatccattttagagtggttttgcttattttatatactcttagaatttactgacttaatatttctcataccctacaaccacagatcagttttggtgcctattctagtgggcaggcacctgattatacaggtaaaagaggtggaacatggcaaagaacacgagagagtgcagttgtggttgggaagggtaggtattttcagtgtctttttttggtgtcattgtgatgtgcatacgggaaatataatgacaatacatgtaggtaataccagtatcttctatgaggcattgtttgtatttgttttctgttttagctccttaacaacagtcctgcatattaagcatattattatgtatattttgtcaataaagaaacagaatgtcagaaattaattttgctaaagttacgcggctgctaagtggtggagctgtaatttaaatccacttctgcctattcttgagtcagtctttctcctaatccaccttaatgctattaaaactcctgatagacttggctacatgtgtatatgttcttttatctacacaaaatgcaaattgcaacacttttcttatctggaacttggtctttcattttaatttcctctttttggagatataaaatcttagatacgggatatagccagcaagcagcatttttgtatgacacattatctacaaatctcagtttgttctttcattgcattttttaagttattcattttcactctagaagcatcagaatgttttaaaggcgtttatcttatttactttctctttctgagtttttaaccctgccaggagggaggaggttgctctgaattttttttgatcaaagagactttttatatcatgtgacaatgaaaactatttttaagcaattccattttttctttatctggtcattcctgtgctagagttcttacccccttctaaccccacaaaattaaaaataaaatatgaagttgttttgagacatttaaaataaagtttccagttgttagcctataacagttacagtttacagttgcaagtttataggagttaagactatataatggctataattaccttcaggagtttaaaatggaaaatcatgttttcctgtttagtgattttttcatatcattaattgaagaaagtatatcactcatcccagaaaatcactgcagctgctgatagacttagcccccaaaacatggatttcaagaggagatgaaagtttagctcagaggtcagaggtcagtgagagaaaattcagttcattgtgaggtgtcataagccaggatttggtagtttggttcttttttttttttgtaactaaagtggttagaagtaatagagtggagcacgtactgtgcttcatattgtgtctcttaaagttttttgtttccaaagaatagaaactgactttggccaaacaacaaaacaaatttatcagaaggatttgaggaactcctagggctgatggaagacaatggaagtagttttttaaatgcgagaacagaggctactctgaagaggaattatctggaaaggaagcagaagttcaccttactctcttcagggaaggcagttagctcttaactatgggccttggctgggctgggtgggaagaggcagggagctctgaagatacttcctagaagaaatgaaaaataaagctcagaaaacttgtggtttagttaaggtcactcaactagtttatgacaaaaaccaaaagagatctcacatctgctgatggtttaagattcttttatgtattcatttcttcatctggtacttgccacactccaggtgctctgctgagggctggcatttagccacgagtaagacagatctaaacaatttatggtaaatgctacaaagtagtatagggtgaatgcttttgaaagatgagtaaaatgattaactaggaattagtggaaccttatattaagtatatcgtgcttgaattaaatattctcactaaaggatgtggtgaccattgttttagccaaaaaacatggaccttttatcagatacagattcagtacctacttgttctacttaacttgatagggaaaaaaatgaccctcctgcatttgtttccttcctttgaagattaattaagatggtatattgaaaagtgcctcaactgtgtctgctgtttggtaggctctcaataaatgctggttcccatctcctcctgcctttaaaccatagctagaacagtttatggttgaaagatatttaacttataaaacaaacagaagcaaaatagctgaattctgagctctttttctttattctgttatgttttcttagaatttaaggtcttcagacatatccagttggtgacccttcagcgtacataaaggcaggatgctttggcattcagacttttaaaaggctacataaaataccagtcatgatatggatcatgttttagacaaagtttttttcttttagcgtattgtttctatgagttgcaaaaattatttcctgaagaatcaaatgtagctatttgtctgacaaacaagaaacttaaaaggtatcaaagaatgcttaagatatctgaatacatttgaaagaacacgaattaattcaacagatttgagctggaagtaagattagaggaaaagaaacataaagtcatactatattttttacctattgtttagtaagatttataactttttaccagttatccaaaaatgtagcttatcgattttttttttctctagctcgcagaaaagtttgagtgtagggattttttgttcttcttctttcatagatatcatatagtagaattttctttaatgtcttacatttagtctcagagaagtcttgtccttgcaaaatgaccttgtaatcacaagaagacattttcatatgctgttgtatagtaattctcgctttttgcactcttcggtccttggccttataacgtatgaattctttcactgaattcacactgtcacatcttgcactttttgcacgcattattgaagccttttaatttgcttcactctgctaacataggtagttgcaagacctgtagaggattttaaaaccactttaaaaaatacatatatttttattcctgacatcttgttgagatattcttgtttaagttgtttaaccttaataatatttgacactaagtcatcagaacagaacagtcacagggcattgccattaggtgcagttttgtctctttccgagctatgaatcttcctgctactgccctatataaatgtctccctagacttcccagtcctgtcataaaggaacttagcatagcgttaaaagtccttcccaatctgtctaccttttcactttatcaccagatactctccccttgtaccttcatgcctttgtctcactgctgttctttattctttgagaacatggatatatctatgaagttttgccaatgctgttccctatgcataggatacccctccacatatccaagcccatttgtttgggctctgctagaatactactcattctgaagtttcccttgattttttgacctagaagtgtttgtcttctatatatattgtaatattttatttgtactttttataaaagtgcttacaatttaaatttatactttacattgtgagtatccacatgtagtctttattaaatcttatgtttcttgagaatagggtcggcatcatattacacagtaacataactaccgtttattgagctcagcgatgcctgtctccaaagtccgtgtgtgctttttccaacccgtcgagctgctgcttagaattattatgtgttagggaacattgagagcatgttgtaagcactcggtaaattctgttcaatgaaagaataaatgtctcaatttcagtggcatctctttctgctgatcacctcttttccacttcctttttgttttttaggtgtattctagatgtattctgtagtaacctctagccacatgaggcaatttaaattgaaattaatcagaatgaaataaaactaagaattcacatcttcggtcacactagtcacctttcaagtgctcactagccatgcatgtggccagtggctgctatatttgactgcacagacatagagcatttttgtgatcatagaaagttatcttggacagtgctggtcttcatgttttgattgccatcaaggtcatcactgcacatctgtggtatgactgtgtgatgtacttttaggacaggaataacatagtagacaaaagcgtcatacagaaatatacttgtgtataatataataaaacacttttcaatgttaggttattccagaagtacatttttctgtagaccttgggcacatgcacagttctcttaactgctttagggaaactgctttatccagttgctactgtcacggcactatggagggaagccaacatattttttccctgaagctttgagcttaagagagctagccaggctacaaaaggcctaactctgtagccttggtttagttggaaaagttccctgtaatgacccttgttctgtaacttacatctgaggattaaacgtggcctcctgcgttggaattgccttgggacccttgaaatggtcacactgacacaggagtagctctttcatgttctgaaagtttttttgttttttttttttcttcccccatgaactcatttagttccacctcagctagtgaggtagtaggtgatcttcatgttacagatgcgaagctgagtctcggagaggttaagtaactcacccaaataaacccaaagtataagttatgatagtagagttctggaacctccaacttcaggttcaaaattcttgtaattttaccacgtccatacccttgtcaatggtaggactgccacaattgattggttttctgagtcaagagaatttggagttactataaggatactttagtctttttttgtgatcagcatatttaattctagttatattcatatttaaatttgtattacctcttattagctctcataaatatgtagaactgaagggtgcagtaagttagagtttgttatgtgtggtttccagaaatgacacttgaggtctgctgttaatcacaactctagaggtagacctcagcttgcctaagcgattgtcaaggggaccgagagccttctgacttgctttttgcttttttctcagtgtcatactgtaagtaagtgctggcctgtgatttgaatgtatgtttttattagtttttattacttcatgtctcactaaattaagctcctctttccatatcattattaattttgactctcttactgcaggtgtcaaaaagctagacagttgtgcttgtctggaggctgtaggttaatatgctgttctgggagtgccaaagcaaaaacaggtgacaaaatagctcgtttaaacggtcacttagggctatttttgcattttcctctaaggaacttaattttacgttcattttatgcctcctgttttggcttcatttgttcccaagcttgaaatcatggaatttaacttggctggttgtagcatttgtatgtaatacctgtaatacagtttctttgtcagaggcataattaacaatatgatttgtacatctactgccttctggtattcacaacagagtttgtaaacttaattagttcttggaatagcaaatgttttgaagatgataaacactttccctctgaataatgtgttgaatggttatatattcatagaaatttactctatgctactcaaattagaatgctgataggtatgcttctcaaggtaaacatcacctgcagttgcatattcccagattatattgtcttcctgtgcatttcacaggggaaatcagacatttagctcagataatttagcctccaggaatattcattgtggcttcattgtagagagaacatctatgctaatgtcattacatagatgccattttctcaaactttgatggtgatcatgatgatatatagtaggggaggagtgggtaataaccaggcacaccactatagcagtacttcacttattctctgctctcagctcttcaagatgtagtcgagaccaaagaagtagcaagaaagcactctcagcagctcaaagagatgctgcaaaaaaatatgctgatgcccaggaaagcttgtctcgccttttctttagggccttattaaccatcagtacatcacagttcttaaaaagtttagctatttggttttccaaaaagcaatattgaagtagagggaacaaattagaaagacctcaatgccattagattagtgtttttcaaccctaagagttggagatgggtcatacatgcctgcgttttcccccatttttatgcatggagaaactagagctcagtgaggccaagtgatttgccagaggttctctagtgctgaggcttggtctgtcctccaaaaccttggcctgtctaccacttccctgccctgcttgtggtcccttgggacccttgagagctctccttcagggctagcgtagtctctggcacattgtacttaagacctcccgcctgctgattcccaggtactttccactatacttcaggaatttaccaagagggtgtatcaatcaggtaaacagaaatcatgccagatattttagcagagaggattgaatagcaggaattggttagacaggtgctggttgacccaaaaagcgaatggggagtactgaagtgatacagaaatagtaacaaaaggttagcagcaagccatcaccctcaaggctggaggagcaaaagaagtaatttggaggaagtaggaccaagaccctgttagtattgttacctcaggagcttgaagagggtcctcacagggctgggactcagacctccgagaaatgggtcctggcttgctgaggaggtatggtgagcgtgcttctgggaatgtagggtaaaaaaatcactgtaactgctagagtttagaaccatcactctgatctgctgccaggaactggaaacacagtgggaaggaacaagtcccctacctcacattcccgattcgcagaacctcatagggagccactggcagaggagaaatgaggttttccaaatctctacccagcattccaggacagcgtataggcgggtaggtgtggagctaagagaccatagcttaataactggcatagatggcttgtttgtggaaatgaaagatgacttccacttttgttaattcaaaccttgagtattcttaaacgttcatcaagtctcaccatgctttttcatgaagaatatcatcatttattcacttgtattcactcaacaaaaatttcagaatgtgtgttctattcaaggtgcaaaactagtgactggggataagatgatgaataacacagttttacctgtcaagctagtcagcaggacagatgataaaaatgtgtgtaactctcagggttgaaaggaacctccaagtccaaccttccatcagatgattggatccttccttctgtaacattcctctttttttttttttttttgagatggagtcttgctctgttgcccaggctggagtgtagtggcgctgtctcggctcactgcaaaccctgccttccaggttcaagcaattctcctgcctcagccgcccaagtaggtgggactacaggtgcccgccaccacacctggctaatttttgtatttttagtagagacggggtgtcaccatactggccaggctggtctcgaactcctgaccttgtgatcctcccgcctcagcctcccaaagtgcttggattacaggcgtgagccactgcacctggctgaacttaaaaatattttaaagacagttagttccatccttggtcaaatttattgttagaatcttcaactcagtaatttgtactggacctcttttctctataatttctatctttggtcctaattgtaccattgtttttttttactgacaaatctaaccctttttttacataatatacaaaactacttttgttataagtttgatttctctcctgaatcatttatcctgtaggataaacattttcgtttatttcagctggctttcctaggcagtgctcttcaacttttttctattattgcctcttttatggagccttttagacatcttttttcctaattatctgcccgccccaaataaatagactgcagatatattctatatttgtttatgtatcatggacctttggtgagctggcaaccgtagttcctataattattggcaaattcttcaaacggatctagtggaatgcttttctagattcctgaccctgttattagtcttagtgttagtatcttagctagtcatgtgtaataaagatcaacgaattattccacctcctgtttttaagatgagaatagaagacagtcagatatccatctaaggtacttattgttagttttagtcaaagtaaaggtctgtatttattctttgattctgtctcatttgcccagacaggcaatgtgaaatgactaggaatctgtatattcagccctaaagtagatcagtctgttttcagtagatttggcaagtggaaccctctagaatgcgtaattttttaactaaacactttatggtcgaaggacaaaatgaaaacaaatgccattgactggccatggtgtacttattttttttttaacgaaatccctacgtttttaacgtgtaacttgcttcagcatgtgaatgtctgcatttaacttgacaacctcccttaaaggaaacccccagtgggaatgtcctctgtgaagagatagcatctgactctaggcggagcaatatgtaaaatgtgactggagagtgacctagtatgcataacactccctgtctttaaattgatatgagaagacaggtctcattttcagtaattctgtagctctatgctgagatatttcatttccacagaggctgtgactattaaagtctgtgcaaactgatttttcatcagtgtcttaattttctatcatgagtaaatctaagtgacaggatgtatatttctgctgtaattgtgttttgcttttaaaaagtgttttatgcctgtttggccgttttcagttggcttagaaaaaaacattgagtatgagtagaattctttatataaaagtgaccccctttaatatcatcatacggaaaatatgatttaatgtcttaagtttcttttcccgccctgaatttactctgagcctttactgtgtaaatagggactggttcagaaactgatgtaaaaatgtatggacatagaatgataaatcctattttgaatttattttaaatagtgtcagtgtgttatggtacatctaaccaacagaaaatattcgttttttgttctattagatatgaaagtaatagagaataaggtgcttgtattatatggttgttatagaatatcattagtacagtcatatttctatctcaaagtgtgataatgccagcgggataaatgagaaagacattgaatcttcacacaaaggaaatgggttttataatgagtgcagtctgaacagaactaatctctttcttggatcattacttcacctaatcataaaaccttttttaattcagatccttgcaggattctaattggtgacctctggagcctgataattgtttaaggtagctggtcttttgcagtatacttaatgatgtttgcaattaaaagtgagaaatgtgatttaacccataggtgtaaataaaaatgtagattttcctttttcagtctttaatagttactcccatcccctccttcccaaagttagtgacttaagtcattactaacttgaattagtccggtgcactggttacctcgtttagtctgtggacttactatttatttgataaatgcattgggttatattaagaataatcctcaattatttagaatagctaagggactggtctgtttgggaagacaggaactcctagcctcttttttcctgttgtttaggtatactttcctgcttgtcatttttgatttaagtaaaaacttagccagtctttctagccagtttccgtaaatatttatttcagaactttcctgactaccagataaaaatgagtcattagaagagaaactcaccagtattcaccattgggaccaataaatctgtaggtgaacctcaatctcagtcatttgttgtcctcaccactgtgcataatagcatgatataatttagtttgtactattgtacatttatgatgtttttatgttcctcttttacatatcttagtaaatgggggtcattaaatgaatacaattgactatcccaatagaattccatatatttgttggaggtgaaacttaatttgtttcattgacttgtttcttggaaggttttattttgttttgaagccagctcttgtaatttggtatctggggaaacaagcaaaacctttgagagtcggacaatgctggaaccgaactttagttctgccatttattaggtgtgggaaaaagggagtggtaatttctgtcccggcactctgagaagttatgaggactgaatgtttataaagcctccagtatagagtctagaatatgataattattcaacttgttagattccttctaccagttttagggaacatcccatcttcaatttctactctttggtccttattgttttaaaattttaacaaacctatgaaatttacgcatgtatttaaaattgttagaatatagtaccaaaatccagtaacctactcatttgtgaagacctttgagtatttcctcttgtttaaggatacatttatctcattgaagcattgaatgactatgtcttatctttgtgtttctctttcctgtcataatgcctttcattttgtgaatgactatgtataattaaggagaaattaatgtgacaaatgctacactggtagcattagttttcttaagaattgtacaaaattttaataattctgagtagtgtttggaatttttaaatgtatctggatttggttctctggaatcattttggtgtcacaaattcttcttgaaatccattctataagataagagctattgagagataaacttaggtacattgaaattttctttcccccccccttttttttttttttttttgcttaaagacctgagtctctctctctgtgcaggctggagcgcagtagtgcaggcataggtcactacagccttgacctcctgggctcaagcgattctcctgcctcagcttccagagtagctgggactacaggcatgcactaccatgcctaattatttttattttttgtagagacattgttcaggctgtcttgaactcctgggatcaagtgaccctctttccttagcctctcaaagtactgtaattacaggtgttagccacagtgcctggctaggcacactgaaattgtaatgcctttatttgagcagacatgaattgggcagcatcagagctcaagtggttcagcgaaggagagtgagggcagaacttttataaaatgtttgtagaaacaagatgaagaaaatatttgattggttaaagtggaaagtccctagttagaggatagttgatggtgctttttctgagacggagtctcactctgtcgcccaggctggagtgcagtggcgtaatctcagctcactgcaacctccacctcctgcgttcaagtgattctcctgcctcagcctcctgagtagctgggactataggcacacgccaccatgcccggctaatttttatatttttagtagagacggggtttcaccgtgttggccaagatggtctcaatctcctgacgtaatgacccacccgccttggcctcccaaagttctgggattacaggcttgagccactgcacccggccagttgatggtttttgattggtagtctctagttccaggttagttggtggtttctcattggttaagcttaagtattctcttcctagtctgtggtcattcactctaagttgggtttcagtttgcttccgtatgaacccaaagctctggagccatctcagtgtactggcctcctctcttccccccaccttttttaacagtataaataaatcatcacaaattaggaattgtattttaaataaacctatatttgctttgtgtgttgtagtttcaaagcactttcataggcatttcttttgatacttgtaataacttggtgagtttccccaaaatgtaataatccaaaacattttttctcaccccaaatcaagatctctctgctacagtaatactaagaaagtagaggaagcatggacataggaatcagataacttggggctggaatcctgaatctctgttggatgtgggactctagcttagtcactggatgtctataaatagtcatctcctttctgtaaatgaacattgtatctactttgcagcagtgttgcagagattgactacttggaagatagtcgttaaataaattccagctgctaatatcattgtaatatttttgttaattagccatgatgggtagaattaattaatttctccttctctccatcctcctcattattattcttcctttcttttcctcctgtcttcctttttggaaatttgactgtcattttctcgtgtgtatgttttaatcttatgtgttgtatgtatatttaaggacattttacgtacaaatatttgctctgtttttttgtttgtttgttgttgttgttgttgttgtttttggagacagtgtctagctctgtcacccaggctggagtgcagtggcgcgatctcggctcactgcaagccccgcctcctgggttcacgccattctcctgcctaagcctcccgagtagctgggactacaggtgcctgccaccacgccaggctaatttttttttgtattttgagtagagacggtgtttcaccgtgttagccagaatggtcttgatctcctgacctcgtaatccgcccgtctcggcctcccaaagtgctaggattacaggcgtgagccaccgcacccagccctgctctgtgtttataaaaatcagttttccaagcatttgtaatatttagagtatcgagtgtttctttctccctagatggtatatttatgcgtatttatgatgagcttatttgtccttattagactgatatgtgtctctactctgctttgccatttgttcatggaatattacttgcaagattaggcactgtatgaatcaatctagtttgggtagttatagtgtgttcaactctggtttgaatgtaatgaggattcagttaggtttggattgcttaaataaaataattctttagtgaaaacatttgtcatgttggaggttaaaaaattccttttcagattagcagctacagtaacattttagtaatttgtccaatagaatttacgatggctgtaaatactctttatatttcttttaaaaacaatttaaatactccagctggactgttgtactattttgaaatcgatttctgaatgttgagcatcttatatgagcttctcattttattatagatttgggccaatgcctgtcctttaattaaactttacacaagagttaaggtgtttggaaaagtcgggggggggggtaataactctattgatcttattaatttccacactagtaggtcattgtgcaggctgatttgaattattcagttattttctgacccttttatgaacttctattaatagttcttataaaacaagttacagtttttagaagagcagttttcagcagtgactgctagctaactctttacaaactcactatactcctttaaattattttaaacattcattcattcatttattcaaccatttagtaaccatttgtgcagccattatcctaaatcactatgctaagtgttagaatataacaaaaatgaataaatagatgttcttaaccttccatgagcttaccatcttgttgttgggcacaggaagtgtgaacaatgagtatatgaaaatatattctgttgtggtacaagttttatacagcaaaacaggtcattgtgaaggatattatcaattcatctgtggggtgaaggggaagttgatgttttaattaagagctggaggctaggcgcagtggctcacacctgtaatcccagcactttgggaggccgaggcgggcagatgacacggtcaggagatcgagaccacggtgaaaccccgtctctactaaaaatacaaaaaattagctgggcgcagtggcaggcacctgtagtcccagctactcaggaggctgaggcaggagaatggcatgaacccgggaggcggagcttgcagtgagccgagattgcgccactgcactccagcctgggcaacagagcaagactccgtctcaaaaaaaaaaagaaaaaagctggacacagacttgcaatttctaggttgctcaagagatataaagttaaattagataaaatctcacccctcaagaacttactgtctagtataggcatgtacggtatttggcaaatgcctatatagaacttaactggaccaggtattgttgttctttgcaaatattaaattatttaatcctcataaaaaccctatggggggcaggcgctgttatttctacatttctttgatgaggaaattgtgacttataagttactttctgacagccatataattaagtaccatagcagggattcaaactcaagcagttggagtctggctgcattatttcaaagactcttactctctgaggttttatgtttttgtttttttttactgagaaagttcttcttattacttagccgttaagaattcaacaatcagcagtgttcaaaaggtgtcttggatgcagaaagtggacccttttgccattatttttatctcttcaattttgggggccagagtaccaatttttaccttaacttaaaaccatggaaattgaccggttacattagggtataaccatgcaggaccttggagtattttttgatttaatcatcttaggcttcagtgactaaagagctatagtcatgtctcctctgcccctcttttttttttccttcatctactttatgcaaagattgcttctgtttgactcctttgtactcacttaactctgtaatttgcttattttgatgttagtggaatttatattttcatttggatttggacctagaactgtctcctggtatcacacaaaattccttcagccgttcctttaagtccactttgagagctcactaaagatcaccagtactgaggttctgtaatttcaagctgttctctatacattgaagcagtgcttcccgcagaatgacttggctgtaggagaataaagtgaagggataagcagatgtggctacattaagaacgtccaatgcttgtgatttacagctttagaacattttcacatctcacttcaggaaagaaggaaaaaagagattaaagggtgtagtctttaattatttacaatagctaagaggtggaaacactccaaatatctgtcaaccaatgaatggataaacaaaatgtgttatatagctacagtggaatattattccgccttaaaaagtaaggagatactgccacatgctgccccgtggatgagccttgagggcattatgctaagtgaaataagccaagcatggaaagacaaatactgtatgattcctcttatatgacacagctaagcagtcacatttatataaacaaaatagaatggtagttaccaagggctgaggggaagggaaaatggggagtagtttaacgtgcatagggtttcacttgtgtgagacaaaaaagttctggacatctgttgcacgacagtgtggatggactgaacagcacacttaaaaatggttgactataaattttatggttttttttaataacagtttaaaaaataaaaggtatgggcttgaagtcagatatatctagatttgaattctgactgtgctattagctctctaacctttgcaaacttcttaaccatttcagtcctcaggatctcactgtaaaatgcaggcggcagatcatatatttgttagcataaagagataatttaagtcaaacacacagccctgtacttcatgagtcatcatcaacaaagtaataattataatttaattactgctggtataagtgacccctaaaataattttcattatttttcaatattttgctgtgtaaatttatgtatggtgagctcagatggatatttttgtatgtaaaggaggtattagaaattctttttaaagattccttgtggggctgggcgcggtggctcacgcctgtaatcccagcactttgggaggccgaggcgggcggatcacgaggtcaggagattgagaccatcctggctaacacggtgaaacgccgtctctactaaaaatacaaaaaattagccaggcgtggtggcgggcgcctgtggtcccagctactggggaggctgaggtaggagaatgacgtgaacccgggaggcggagcttgcagtgagccaagatcacgccactgcactccagcctgggcgacagagcgagactccgtcttaaaaaaaaaaaaaaaaaaaaaaaaaaaaaaaaaaaagattccctgtgtttgctaaagaatgaggggttggagttttattgttgtcgttgttgatttttttttgtttttgccttatcaggtcctctttccacccttcctactctgctctgtgcccagaggctgatatgcatggtacaagacctgtatcatagatatatttaccctctggctttgagctgggttaagagctatccactagtggtcaatagcagaagcttggcaggagagagaagtgagctcaaagtgtatatttgctttggcccttgctgctgtgtcaccacaaattaactgctttcctgtgtgcagtctgtagccccatcaggctaccatattagtctgtttttcttttcctttcctggcccctgcatgccattttagatgggtaaaatattcacgtggttaagagatttaaagcagtgcaaaaagagatacagtgaaaagtatttctgtaccctatctactttgtcctctccatgccaaatagataactagtttcttatactgtcttttgttgcttaaccacaggaatgtgtgttctgaggaatgcatccttagatgattttgttgttgtggaccatgatagattgcacttaaacatacctggatggtgcagccggcttgctgtacacataggctaggtgatatagcctgttgctgctaggctacaaacctagacagcatgttgcaaagccagagtacatgttaccatactgagtactgtaggcagttgtaacacaatggtaagtattttgtgtatttaaacatagaaaaagcacaataaaaatacagtgcaaaagacaaaacatggaatacttgcataggacacttaccatgagtggagcctgtggaactggaagttgctctgggtgagtcagtggttgagtggtgagtgaatatgaaggactgggtcattactgcacacttttatacatctgggagcatggaaggtttgtttacactatcattgccacaaacatgtaatgctttgtgctgcaaggttaccacagctaagccattactaggcagtaggaatttttcagcttcattataatcttacaagaccactgtcatatatgttgactgtaatgtcgctacatgatgtaaaactgtatatcaatagggagatgttttctgtgtgtatataagtaaacatttgtttcttacattgtgtgtgtgtgtgtgtgtgtgtgtgtgagtaaacagtgcatttggtaccgatctttgactatcagaacatgaagtttcctcattttgtgcagtagccacatgctattttattccagggtgtgctctagcctacttacccagctcctgttgataagacatttaggtggttcccagtgttttgctattaaagacaatgcagtagtggataattttgtgagtaatattccacatctatctaagtatatatgtaggttaaatttctagaaatgaagttgctagaacaaaggaaaaataatctgtgtgtttgattatatgagagaaatgaagctactttaaaaattttacattactaaaatttttatattggaaacttaacttatttaaatgcaaagattatttagctatttttagaatattagtggactttagtatatctggtaccttaaaaaggaaaagaggccattgcttaggaagttctgtactagaccaaagcaaaacaaatgaacaaacaaaaaacaatacagatattattactgaaaacaagaattctgcagtgagaggtttggtgtacatggtttgaaaacatagcattttaatcccctacattatctaaaaccttaatcacacatttgcttattatttctgagctaggagatggtattggtaccttaagctgtttggtaccaaatgtaatctggggattagtgaaagtcaaatcccctatgcattcgtccttgaaaatctgattgggttttctctattggtggcctcactttgccacagttaactagagggtcacatccatcttggtggatctcaagcatctttcctccctcggggaagatgagagcggtagtagcaggggtttttgaatatgcaactctcagttagggacaggcataaatccttgagacagctgtctcaagatttcgtagataattttgtgcaattctccattttatgtatttctggatttcaaaaaaaaattaagctacttataatgctcattcaagtagaaaataaaaattgttgattgaacagcatctgctaaaaacaagaaaagttttaaccagttttgaattgtatattggaaggcacaagggcctgagaaaagtacagcattcatgatttaaaccaggtctgtttgactcccgcgatggggctcagggctctttgcattgttgtgtggtgctttaggcttgttaaatgcaaacctatatgcttctgatatggcatcaggcttaaaaaatttaaaaaaaatcttaaaatattccaacatcattcaaaatttaagatagaaacagtgcattctagcaacttaagatttgtaggatgctgtgtatatgtagagaggaaattagatattttatatagattttctttcattttcctttttaaaataacagatgatctgaaactgtaatatgtgataaaatacttaattcctaatttttaaaagcttacctatatgattttcttacgacaaaatgttaagtgacactgacacaagggaaaacgtgtggaattctgaattaatggatttaaatattgtacatctggtgtgagttttcaacaattactaaactactttgtttttttttgttgttgttgttgtttttgagacggggtcttgctctgctgcccagggtggaggtgcagtgacacgatctcacctcactgcaagctccgcctcccgtgttcacgccattctcctgcctcagcctccccagtagctggactacaggcgcctgccaccacgtccagctaattttttgtattttttagtagagacgggggtttcaccttgttagccaggatggtctcaatctcctgacctcgtgatccacccgcctcggcctcccaaagtactgggattacaggtgtgagccaccacgcccggcctaaactactttgtcaattgaaaaggaggcagttgaatctattttgacacacatacacataccatacaaaaaaaaattttaggacgtttcagtgtacctgattttgttgaatcgtctaactatgccaaaggtatttctaattattgcataaatagataatgaagggtgggatttattttcttctaattaaagctgaagtcatgaattgttatacccggagcagctgatgtgagacttactgctctttactgaagaaaacaaaaccagtgtagctcattgataccattggtgctacaattttcaaactgtgtgtgtgtgtcaattctattcatggaaaatttctgaaagagtatataaaaacagttgattacaattatttctggagttgaagtgataggagaaaccttaaaaaaattttatatcctgtcatattgttttaaattgttaccatgttcatgtattatttttatagaaaaaatcaataaaattaaaggtactcttctatttctgtgtatatttttcctttacaggttccacttaaaattaatttttcaggatcaaaacatagtgtagtacaagaaagcagacaaaatgacaaattcatttatttggtgacttagtctttatctcttcttggaagctttgattagaagctgcagatataatttgctatttccttctcttagccatcctttcttatcttcagtttctaccctgcttccttccgtctcccccatctcatcgctcttaatccctattgtatagtgttttcagacacttaccaattctttgatgccagctgtgtatccagtgattcaattctgaagctaactgcgggagttagcgtcaggcctcctcccctccccacagatcaagggcttaatcccacaagactgctgacacttcaggtgccagccacaatgtaatgctccggctacccagatttctgcctaactacaaatttggaggctccaggatccttcctcaggtttggtaatttgctataatgactcacagaactcaggaaagcactttgcttactgttagtgaccaaagtttcatcaaggagtgagaggctttgtcagcatttgtaagtcacatgagatcctaaggttttagaaccaaatcgttggatattctagttcccttttctcattttaaacttgaagaacctgcatcctaactgatatactgttttctaattgcaaagacaattattagcagatctgagacgagaatctagaatttttatgtcccatttagtgtcctttaaattgtaataattctttgttgctcattcaaaacctttgtttaatagacaatcatttagttcgaaatgggaggctgcatattaggatggagtgaaagctcctccgtggtattatgaagcccattggctgtttcagtggtgacagaagccccaggcccaaagcctctagcttaaataaatctttcatttatcccaagatactgtaaaaatctttcttacttgtttttctgatatgacataaaaatggtgggagagactgcacaggcaccttgtctttggagccaaacaaatctgagggtaaatcttaacctttgccatttattgtgaagtcacctctttgaacctcctctttgtcatctgtcttgaggattgaattatgtcatgaatgtgagatatgttgttcagggatggcacatattaaattcttaaatgttcctagcttaacaagcaaaatggataaatacgtgtattcctttgtacagctgatgacgtctttgataccttctccaggctgttctttatccttctctgaacctgggtgtctataggttggtgcttggaggtaacagtactcattcattcagcattcatgcaagcacctaattttgtatctcttgtgcaaccaaatactatgggccatagggtggatgaaattttatgctaaaattttctaggatctggaacttgcttagtttaagatatttaagagtgaataaatagatttttacctaagagaaatttatgttccagagggagaggtagcacatttttttttccatctaagggtagcagtagagttgcacgtaaagtgctttgtgagtatcaaggtgagagtgattgattcttccattcttgccaccccattgaggaaagaaacacttgcacagaaaaggagatttaatgtggttgagtctcgaaaggagatgaagatgaaatcatcataacaagtagagcgaagagcattagtaaagacattagcatatagttgatatgtgtcacatgcaaggagggaagatttgattggggaggtgggctactggaaggttgtctagggtgtttaatgccatcgtagaatcagttcttggttgtagaagccttgaaaagccaggcaagattggtaactagggatgtttcagcactttgtatcactgaactgtgaatacttaatggcttttcttctttatttgatcagccttatctagttatccagaagacctgaagtaacttatttttgtgttgtttatctggtctgtttttctcctctgttggtatgagcagttgagatttgactttgtagagccatgatacatgcatttattccatttatgaagaatcattgatgaaaccggaaatgtacttgaaaacatttgcctcaatttaatagtccatacttcagtagtagttgatttcatgccactacagagctaaccagaacacccagcccctgcatttctgagtcatacacttcatggttatctttttgcctccacagaaatagaaaagtttcaaaaaggagaaggcaaggatgaagaaaagtacatcgatgtggtgattaataagaacatgaagctgggacagaaagtgttaattcccgtaaaacagttccctaaggtaagacagtgaggtctacactgcaggtattttaacctgaatcaaaggggagcagatgtttaatttatattctgtttggtgtttttagagatgttttctcttagcatccccctacacacacttttaaagttaattaaaaacttagtaaatttattcattctgtcttttccctttagtgtgagttacagattcctgaaaatatatccttttgagtcaaactagcagtgtgactttgggaagcctcttcaacttctttccacttcagtttcctcatttgtaatatgaggttggatggtttaaaattacatgagataatctgtgttaaatgcttggtacataaaggttcaaaaatatcattgtttatgttttatttaaatgctatttttcttttgtcttctgaatgttcatatacatgattcttgcatactgttgtgtgtattagtagttcatttctttttattgatgaataataatctgttacctgaatatatcattgttgtttatccatttgtctaggcacttttaattttttggttattataaattaaatttctctgaacagttttatacaagttgtttccttttctttttctttttttaacgttgtattttgttttaagttctgggatacatgtgcaggacgtgcaggtttgttacataggtaaatgtgtgccatggtggtttgccccatcacctaggtattaagccccacatgcattagctatttatcctgatgctctccctccccctgcccccatgacaggccccactgtgtgttgttcccctccctgtgtccgtgtgttctcattgttcagctcccacttatcagtgagaacatgcagtgtttgcttttctgttcctgtgttagtctgctgaagataatagcttccagctccttccatgtccctgcaaaggacatgatctcattcctctttagggctgcatagtattccatagtgtatatgtaccacattttctttatccagcctgtcattgatagggatttgggttgattccatgtctttgctatttgtacaagttgtttcataaccagatatgtttgttactctttattaaatacgcagtattgaaaattgttgtgtatttagtattacaagaaattgtcatacttttttccaaagcacttataccttgtaccatttccacaaacaatgtgtgcaggctgtagctgcctcataccctcatcagtatttggtgctgtcagccttttttattttagcttttgatggtatattggtatcttcctgtggtatgaagttgcatttaccttatgattgatcattttgtgcaatttttcatatccttattggctattcatgtatttgaatcttgaaatctttgccaacctcaaggaaatgttagagctctttataagttatactcttctgtattttctctaaaagtgttattgtagcttttacttttaggtctatgatagatctcaaatgaatttttgtatatggtatgagatagaggctcaagttcatcttttttcccatatggttatctagtttttcttgcactatttgttgaaagatgtttccctccactgattgttttggtgcctttgatgagacaatcaggtgagcatgtaagtgggggtatatttctaagcttttagttcacttcttttaatctatttatgaatccttatgccagtaccacactgtcttgattactataggcttttacatagtgagacatgagtttaggtaatgtagttcctccacctttgtccttctttttcaggattacttagatactttagatcctttacaattacatataaatttaagaatttctttgttaattactacaaaaccatctgctgggattagaattgcaatcgcattgcatctgttgagcaatttgtgggagatttgacatcttaacaatattgagtcttccctttaatttctatcaacagcgctttgtactttttaagataggagttttgtatgtcttttgttaaacttattcttaaatattttgtgtttttgacactatcgtaaattgaatatttttaaatttctattttccagttttttttctaatataaaattttgtatgttaaccatgtctcctgctaccttgctaaatttaaattcacttattctagtaagttgttttgtagacttcttaggatttgtcatgcacatcattataccatttgcttaaatagtttacttctccctttccagtttctatgcatcttattattttacttgcattattttggctaatatctccagtgtaatgctgaagacaaatgaggagagtaggaattattcctgtttctaatcaaggaggaaagcatgcagttattttaacattaagaacaatattagttacaggtttttttggtagatttcatttgctaggtagaggaagttcccttctgcttcagttttactgagagttctgatcctcggtggtaaatttttttgaatgctttttctacatctattgaaataaacacaatgtatttctctacactgtttatatggtagattttaatgattgatttttaaaactaaaacctttgtattcttgggttaaaccctacttaatagtgatatattatctgttttatatagtgctggattcggttgcatcttattttaatgagtgatactgacttatactattttttttttgagacagagtctcactctgttgcccaggctgtagtgcagtcacgcgaccttgactcactgcaacctccatctcctggattcaagtgattctcatgccccagtctcccgagtagctgggattacagacatgcaccaccatgcctggctaacatttgtatttttggtagagatgagccttctccatgttgaccaggctggcctaatgtgatttgcccacctctgcctcccaaagtgctgggattacaggcagaagccaccactcccagcctgacctgtacattttttaaaataatatttttgtcagattttaatgttagtgttatgctagtttcataaaatgacttgggaagtgtttctttccattttctcagagaacatatatcagattggtgttacttattcctaaatatttgatagattcaccagtgaagcaatctgggcctggagtttgataatgaattcagtatctttggtatgacactagacagatttcctatgacatctttcgtgaaaatttgtttttaaaaggatttgtacattttatcataatatttcagttactacttcaattctttttctgatcgtttctcctctcattcttttgagatttcagttacacatatttcagccttttgtcactctcacaaaagtttctgtggctctgtttttttttttcctgtccttcagattttataacttttactgctgtatcttaaactcattgattcctttctgttctcattttgctattaacccaccaagtaatttttttatatcaggaatcgtaattatctgtttcagaatttacatttgaatcatatatacatgtatgtatgtaaaaatatttttttctctcttgggattttctattttttaattcattgcaagtgttattttcctctctgtcactgagtacggttaaataggtccttgaacatctctgtctactaatttctaagtcttctaagtcttggccatcttagatttattttgcactgggagtcttttatcttgatgaagagccatattgcttcagccctttgcattttgagtaattttggatcgtatgctggctattgtgaatgtacattgtagaaaccttggattctgttactttcgcggaagaattttgatatttttgttttagcagctaattaacttggttggattcagggtataaactgtgtctattgggtaagagttcaagtctcagttcatttctttccttagtttggctttttgtgtctaatttttgtcacgtgattcagaggccagccagagatttcagaagattttatacataatatttggttatctgcaactctgaccgtcttttctagtattcccccctcacatttcagcactatggttttctcagtctctgccactaaagccaaaagctctaaaatgagtaaattcaccccagggtatttcctttgctgaagtcataactttctttcagaatctgcctgttttcgatcagtcttcagtgcttcagacagttaacttttatattttgctgtgagtttaggagtttacagttgatatttataggtgggcagcctgttaggaatgttctcagccatacctgcagaactcaggggaatatatgtgtcttgtaaacagaaaattacgttacaaacatttcatagacagactcattactcaaacaaaacatgactggtggaaacctttgtatattgattctttgtgctcaatatgctctgtatacttaatatgcaatagatagaaagatgaccagattatagaccctgtctttaagtagttcatagtctagttgatgatgattaacctgaaactaatactttgttgtctccaagtttgtaaatgaaataaaataaagtgcagtcatgtgctgcatagtgatttcagtcagtgatggactgcatatatgatggtgatcccataagattataatactgtatttttgctgtatcttttctatgtttagaaatataaatatttaccattgtgtgacaattgcttatagtacttagtacagtagcatgaggtacaggtttgtagcctaggaacaataggctataccatatagcctaggtatacagtaggatatgccatctaggtttgtgtaagtgtactctttgatgtttgcacaatgaggaaatcacctgacaatgcatttctcggaatgtgttcacatcattattgactcataacatcaataaagtgtacgaaataaaatctcaaatattgtttttcattgtcagctttgaggtaagggaagaaaaattataatatttaaattataatttaaaatttaatttaagatttaaattataatttaaaaattataatttctgtgtttgagattagagtccatttcaagtacttacaatgtctgaagtagaccatttagaagttactgctttcaggatactgaaaaacaatatttctgcttagcataatggagcatacaggtttcaagccagccctgtttcaagctaatatagcactgcaatcagtcctaagaagaagctttcatgcttgtgtcagttaatagaatgaactggaggaaacgaaatagctggaatagctgtgagtagagaatagtgtagtgtggaattaatgctgatggtacacttccagcttctggggcaagagagaactactgtttgtgaaactccatctgataaagtgatttccattaattgaataatttctcttctgttaatgaaccattttcaacactctttcaatggcacagcattggacacaggaatcatttagtgttcagaccttaatgtatattcactctcttgagttatgtatctgagcttataaagggtgaaattctaaatgctgttttatgatttttttagaagttttttttagaagctatggaaattgttctccatgggttttttttttttgcagataaaccttaacctctggtgctgatcagcgccagcttggaacatggtcaatataaaccccaaatcaacattggaacaaggtaccctgtctttgaggacctacagatacattatggtttagggtttacatttatttttttattcattggttcatccgtcagtggatccggctctgtctatacctagcatttataaagagtcttctctgagccagacattgttctgggaaaatcgaagtggttaagtcatggtctttgggctaaaaaactgccagttttttttggtgaatgcagatgaataagttaatattaataatacaggttgccctgaaagaacaaagaagaggatcctggtgataggctcagagaaggctgctctaaggaggttgtctctaaagagtctggctggctggggtcagaagtgagatagtgaaattgaagggtggtgacagaggagcactatattgaagcacagaaggcatttggggaattacaagccatttaatttgactagacagatttttatagaagacataaatgaagttgtaagggagcagaatgtgggtggcattggccaaaggtcctgcaaagttaaagtagagaatgacatttgaactgttttagacgatgaggcttctccaggtgcttaatgatggcaaactatttcaggagagggaatgccacatgcatagtcatgctggagtgaaagaatgcttagggaccattttaaaaagtgagttgtaatatgacattaaatacgttatatctctatgtataatgctctgttttaagtgtctgtgctataatattaagtgaaaaaagaaaagtcaagatacagaaaatccagaatccaagttggggaattatttgaaaaagcgaaccagaatcttaatagcagttgttttctggagtataggttttcgtgatatttttctactttacacgtttctgtacatgaatgttttaataacttagtgtaacctttattaatataaaaacattttccattttttgggcaaaatgtgcctgaggtttttactcaggaggtatttttgtactgtgattgtgattctcaaggtttagtgtgctatgttaagtctataagtttaaattaggtttattaaatttattaatttgataattgtccttttagcctctaagcattctcatctgtgtacatactatctgcagtaactttgtcttaaccagcaaaagtttcttctgttaaaagtttttctagaatctgaatgttgggaatgtgatatatttgttctcttcatataaatggttaggtcaaggatctttgagagataaaacatgtctgttcctggtgtttcagggaaactttcttttttgaagtgggcttgcattttttccttgtagtatgtcatagacaatttaaaaccctttaaattactacttggtagaagcctattccatggaaatcatcgtggatttacagatttcctaggatagggaatattttacagtcatagagatatgttaaatgttgccatttttgttgctcctgtttgattttcagagacataatattttttcagataatttatgtgaaaatgatttttgatgttcacgtggtaatttacctctagaaataaagtgataatgtacatgtaggctagttttttgtatccacagtgccaaaattaatttggttgtcttagacctttgtggtgctatagcaaaacactgagactgggtcatttgtaaagaacagaaatttatttcttacatttctggaggctgggaaatctaagatcaagccacctgcatttggtgtgtggtgggggccctcttgctgcctcctcgcatagtagtatgcggaagagcaaaaagagcctcagctaattaattaccttagcccttttaaaaggcttgaatccattcataggggcagagtcctcatgacttcagcacttcccaaaaggccccacctcttaattacccccacagtggccattttcaacatgaattggaggggaaacattgaaaccatagcagctggctagttgggattttgaatcttgttgacatcaaggcagcctgatattaaaaataatcacttaaggatacatttagttactatgagtcactcctagtattcattaaatcttgggcctatgataaagtagaaaggccactatggattatataaatttagagaaactggttggcgcataatggccattgttttatgatggacggttctcttctactttctcattttgtcaacctacatcttgtagtgggaactggaaagaagagaaccggtaagcggcagcaggaggagtaaatcttcagaagctacatttgtcctgttctcagaggctctggacttgggtcttgtgacacagcccctgtctgtgagaattgggaagttatttaggttggtatttacaaatatgacagcatttcagatgtattgtggagggaattaaaatcttaacgtttgctctccttacagtgcttgattattgaggcagaaagcaacacttgaacttaaatttgaaacttaaagtgaaaataaaattgaaatttgaaaataaaattttcagtaaaattgaaacttaaagtgaaatccaaaaacagccaggcatatattgaggggttcctgaaataatctagtgatattgtttgggggcatattattatcattggtgttattttcctgagccaatgaataattaaaaatttgattataatccttatatataggcctcctaaaatttttattacatttaaaagactagaaacagtctattacatgtatgtttgtcacaaagcagtaaatttagaaattaaagtgtgtgggctgggtgcggtggctcatgcctgtaatcccagcactttgggaggctgaggcgggcagatcacgaggtcaggagattgagaccacagtgaaaccctgtctctactaaaaatacaaaaaaaaattagccaggcgtggtggcgggtgcctgtagtcccagctacttgggaggctgaggtaggagaatggtgtgaaacccgggaggtggagcttgcagtgagccgagatcgtgccactgcactccagcctgagcctgggggcacaaagtgagactcccatctcaaaaaaaaaaaaagaaattaaagtctgtgatgaattttgttatatttaactctttaattacatctctgcttactttgagggtacatcatagaggatatatctctatgtctattgctgaaccaaaaagcaaaaatatttttagtggtttagcaatatactgctgggcttatatatcttggatattactatactgattattttggctctgggctccataaggatcaccaaattggaccaactgaaaattgcgtgactatactggtattggagataggaaatgtgaacagaacataatccctcttttctaggatgcagtcttttggaggaaaatggcaaaaattcatgccgtagattgaactataaatttccattaaaagaaataatcaatatgtaattacatgaaaaatggacacataatacaaaggcagactgataatcatggttacagagaaagaagtcaggcttatgagccagcctgacctgtgctttctggcactgggtgcatcacctgtgtctgttctgactgttagaccaaatggccactgaacgcttccacttggataccccacaaacatcttagagatttgccatgtccgtatctgaacttcatacctcctcttcttggccaaccttgactttttcctgcgttttttacttgagtaaatgacagacaacagtgtatttgagtactcatgccagataccaggacataatttttgtctacgcacttctctctcattgacctgcttgcctccatccttcagataccattcatttactttctaaattatcatctatctctctttacatttcatttcactccttaatttagaacactatcaccccttaccctatcgattgcaatagattctttgctgtatcagtttcttgcctttgattttaaatctttcatatcattcaccccacttgtagcctgacttttgtagtctgggattttctgaattaacggtttcatgtttatgggcttcatagcttgtcctccacacacttcctcctggaatatccaaccttaagcaaatgcagatagcaagtatgtaagttagcttatttcagattgtatattacttgcgtgtgcctgtgtgtgtgcatgtctatgttttttttgctcatattatattctggaaaagttacttgtacacttcattgatctttagaattattaacgtctaaataagttgggctgtttatcatttagaaatggatattaggttaaaattacagtcaatggagtaacaccaaataatctcaaccactactaataatacctagtgatctgtagttggaaaattaatatatttaaataatagtatttatagctttaatatagtaatctctgcaacaacaaaaaaaatcaataaaaaccttattgaatagtgctattcaatttggagaaaaataagctttaactccataagtatttattgagaaacgattatatacgaaaaatgcttaattaaatgtgggtcctacttgctctcaaataattcataatctaataggggaaaggataaattttactaaataatataggataaagattgaattaatattacaaaggtagaggcacagcatagaatttaaggacatgatggagagttatttctagagaaataattatggatgaaattaaatttagtctttaagaataaattcaggacattaacagacatgagggagaaaggtagaataactgttgggctagaatgacttcattatggggaatagtggatcataacattcgtgtaaatcataaggaatatattctggaatgccttcagtgctttacttgggcatggaattgtatatatctcgaagagaatcctgaaatatttgtgatattgaaataaacacctaaacacaagtttggaatgacttattcttaggacattaaaatgcccacgtacaaagtgattgttattttcaggggtgattatcaggatcttgaaaatgattatcagtaatgcaaagcttgactcagttagcaactatgctaagaaacaagtgttttgtttctgaggaggctactccatttcatgtgaatgccatggtcccaagtccattgttaggtttactgttgtttagagtttggcatttactacactgatataattcaaatgagatcagaatcctgaatactaagaatggggatttatttaagtaatcattgtgttagtggtcaaattattaaacttaaaatgtcccattgagctaataaaagtatcgatcggttctttcaagaggataaagggaaaataaaccttgtttgttctccctttgtatttttgtccttgggcaggaaataggtaagtgtagattataaactaaagatgttctttgaaagcttttgttctccccagtaaagtacagaaagcaagtgcttgagtggtgttctccaaagaggagtgcgtgctaatacatttgggtgctgggaaaatacagtagaacttctatttatgtgtagacttctgttatgtgtgtgtacacacacggagtggttttttgtgtgcgaggcattattctaagcactttactattaactcatttaatctttataacataagatagacattattatttcctgttgacgtgaaaaaaaatggaagaacagagaagttgagtaacttgctaaaagttactaagtatcgggcacttgaatcctagaagtctgactccagggcctatgcttttaagaaattaaactttattaatatttagtgcatggattagtacagtacccttacatgattcatctaagtccagttatatgcactttgagacagtatcctgaagtgaaaggggctattccacagtgcaggtctcacaaaggtattagtttagataaacaatgtaaatttattttgctagatgtgggtctgaagtagaatgtaaaacggaggatataaagaatttttttttgaatgtttagatacagtgcaaggtacagttctcgatttacattggttgaactcaagatttttttactttatgatggcgtgaaagcaaaacaccatttattaattcatttgctttcagtgtactggggcatacagctatttatatgtgcctggttgcagatttatggattatgttagctagttttaattaaacatgtcctccagtgggcaaatattactgcaaaagacactgttaattaagggttgtagataaatacaatttaaattagtgacaaaaccagagagctgatccttcttttgtgcctagtacaactcagccttataaaaagattaaaaacaactatgatccagttggatatgacaagaacagtcttctcagttggagctatttctctacgtatggtagtgttaatgatgaatcttggcctagataagtattgcagtattaaccagtgatagaacaggcttatgatttttagatagataaatgtgtgtgtgtatacacacacagtacccattgaaggagcaaaggtgtaaatatgggtggggataattcttacattgcctaacttaagactgtggaatatttgaggtaataacctataggtagtatttacatttgctgtcaccatggaatgtactgatggacctgctttattgccttcctcctttctcacagtttcttagctgttaaactgatttgagatatatactgatcctcgcttacaatggggttttgtcccaataagccacttgtaggttaaaaatattgtaagtcaaaaatgtatttgacacacctaagctactgaacatcaaagcttagcctagcctaccttaaatatgttcggaacactcaacattagcctatagttgggcaaaatcatttaacacaaagcctgttttataatgaagtcttggatatctcatgtaatttatcaaatattgaactgaaattgaaaaaccagaatggtcgtatggatactggaaataaagtttcctactgcacgtgttttgctttcacaccatcataaagtcaaaaaatcctaagttgaaccattgtaagtcgagaactgtctatatcttgtactgtatccaaacattttttaaaaaaattctttatatcctcctttttactttctactttagacccacctctagagaaataaatttacattgtttatctaatactaatatcctttattttacaattcttctcaggtgttttttttttaacatttttagttaaacacttagaacttaagctcaattacaagtccttgttggccagttagaccccatataccaaaaatgtgcttcctttcatctccctgtgtggtatattctaggttttgttttaattaacatcttgggtagtgattaatactttcggggcattaatttcagttggtatttgtcattcacttttgtatgcatgaaatattccttgcctgtcataagttacatgctgttctagacagtcattgaggtacaaagatgagtaagacagggtttccgcgctcagagaaatcaccaccttgcttctcaacttaggaaaaagaaggcgacaggcaggtagctagccaggccttagaaaagaccataatgtttgagggtattaaaatttgactttttgatcagtgactgctttgtcatttttatcagtggtgtagtgtatatattgtgctctgcccccatgaccatacatgcaagccttcaggccctgcgtggtgcccttcccggagtttgtctgactctgcatctcgcttacctgattgcatgcagcagaattgacacaatgccagctccaagcctgagctttaagaaagacttctagcttctgcttttctcatcttggaaatcagacaccatgcacaagcctattcacgctgaggctgccatggtaagtggaagcttaagatactcaggtgaagaagagtcaggcaaaccagcaggaactgaggtccccgctgacagccaccactaactcatgagcctgtctgcccccaacagtgccgaagttgctgaattgtgagcaaataaataagatggttatttttcaagaccattcaatttggcagtagtttgttatgtagtagtggataaccaagatagccttaaagtggaacttttctgtccctaattttctaatttgtgtgaaaatcagttaaggttgtgtgaaaatcatatagtttatacctgttaatatacctgtttattatattaactataataaactattatatatagttaaactatatataaactattatatatagttaaactatatataaactattatatatagttaaactatatataaactattatatatagttaaactatatataaactattatatatagttaaactatatataaactattatatatagttaaactatatataaactattatatatagttaaactatatataaactattatatatagttaaactatatataaactattatatatagttaaactatatataaactattatatatagttaaactatatataaactattatatatagtttatacctgttacttgcaaatagggactcataatttctgtagaatatagtttgttctgaaaaaagttttgatgtctttaattgaatataacattatggtctttatgggatagaacagttattatatatttatatgtgtgttgggtcaagaagtttaactcaattgcaaaatgctgtataagaaattttctttttttatcctatgggtcacttaactttgtagaatgtgacttttctttttaaataccagaaggtatcccagtccatttgtgctgccgccatgaaatatttgagactgaggaatgtataaagcacagaaatttatattctcacagttctggaggctgggaagtccaaggtcaaggcaccggcaggtttactgtgtggcgagggcatggtccctgcttctaagatggtgccttaaacaccgattcctcctgaagattaggctttggttcaggagaaggacataggataggtggctctgggcagatttcagcaatcccttatcccccactatctccccaggggaagtggtttctttattttctttaattttctctgtgagtgcctgggggtaggagggatttttttgcagataaagcttttaagaaggtttcaacttttctaattgggtggtttccagggctccatactctcatgctagcccaccccagatgagcaaatgcttgagttttatttctccctgtagattcctggacagagatacctacagggagaaataatttttgcccatagacttcagtgttaatttgctttctgtccagttttttttttttttttttttttttttattattgtttaaaaggtggatgtgacgttccttccaactctgtacttctgaactgaatgtgcagttcttggagcacagcagttttgagaagctgaaagaaatccagaatggctaaaattaaaagcagaaatgtggtgaggctagagaggtgagccagagctagcatgtttgggaagggcttttcacagcagtagcaaaacactagcactcaggttcgcaggacagtcacatcgttgtattttaagcagaggtgtaatatgggcaacttgtgttttaaaaagacctttctgttgattgaaggagatggaagtggatacagagaaaggactctacagtggtccagggagagcagatgagggcctagactagggtggttgtgggaggactgaagaaaatggacagatttaagagatgttggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgaaactccatctcaaaaaaaaaaaaaaaaaaaaagaaaaagatgtttaggaggtaaaatcattaacatataactaattagatcattaacatgtattaaacgccctctctattcatgttggagagataaagcagtgaacacacaggcctagtcagtgccctcgtgcagtaggtggcaggcttcaggcttgagttactgcgaagacagtggcaccatttgctgggctaagggactctggaagaagagcatgtttgaagctatggtggcggagtttccaagttcagtgttgagtgttgtgttagaggtcagtaagatatccctttattatactaatcagctttttggtgagcactcagttatgggaaaccttttaatggagaccgtgacaggttcttgagatttagttgtttatgaaatgacagcttaactgtaattgctccccaaggaacagtgtcatgtcacaattatagtttagatcaattaaagctagttcagaaaggcgcttggtctttaccagtgaataatataattattgtagcttatacatcatgcagtgaaactcagatatacttactatatgttgttataccatcttcataatcacttgaaaaccaactcagggtatgtgacttttcctgattagtggaaacaagcagttcagctaatctttaatggagaaaataatgggactttggatggtttgtgtttaaaaatgtaacatttgtgtgtctgtgagagatacaataattgacatctggagaaaaattattagtcttaggaatgataatttgtaaatttgtaaaatgataatttccatgtaagtgaacaaataaaattattaatgaatattaatattaatgaatatgtattaatggacaaatgaggttatttatacaaatgaatattaaaatgtatttgcttatttcttactgtcttgcagatatagtttttaaaataaaaaatcaggacatggataaggggagattttatttgaaaaggtgactgcaagaccacagaaagggactattggcaatagggagaggggatattaaaaagggagaaagcactgaccatgagaactgtaagttatatctcagaagtcaggcagaaaaaggctttcctttcatgagtgaagtgattgaggccagaacggtgtggggcagtgcgatgaatgggtggtagtggcaggatgggacagtgatcagagaacactaccctgagcttggcctgttttccaaaggggcttttgggtggagcttgtctgctggttcagattgaagatgggtcaaagttcaggggtctggacaaaggagagaagtggaaccaaagtttaactaactcaggacatatgtctttttctgattgaccagtggaaacaaacagttcagctactttttaaggggcaaaataatgggaattttgagggtttgtgtctgtccttgctgtaggtaaataaaggatcctctgtgagtcttatctaagttatgtgggtaagagtgggcctttgcaacaagcactttccagaaacacaaaagggtggggagattttgtaatcatcactgtttttaggtgcacagggctgctcaggtaaaattcaacattgtcaccgtgcttaacactttatctgatattttattcttcataatgaccctgaaatgtaatgacttttataagccacacctggtaaatgtgaaactgaaaactagaaatgctgagaaacctctgtgttcacattgctgataagatgagggcactgtatgatgacaccccttcagaacccatagcaagtgggacatcaggaggtgttatgggactaatggcaaagaagacaactatgccgctttcgttgtttattatttatatcatccagaaagtccaaaatacatactcagtccatctattagttaggccttttcttgttgcgaataccgactatgactagcttgaaggattttttctttaaaaaaaggaaaacaacaaaaaacaacaacaaaaaaaacctaccttagggtgtcctatagaatgcatggaggaattgaacttgcaaactgaaaagacagtaataagagctttaagcctaagaaattgtctctggcttttccctctagcagtattttttacctgggccacaattgacattttaaacaggacactttggtgaagggcaggaccatctgtttctgatgcctgacataggcctttgcccctgagtcccagtagtgaccctagtcattgtgacaaccaaataaacatgctaaatatttccaagtgtcccacagggaggtgatgcaacatctgcagtttgagaacctgccggagcagccaagcacattaccattattgtgactcagctctcaggacattcagtatccacataatcagttctaaatttcagaatctcttgatttccagtcaaaggccaattcctcggccgatctgggtggcctgggccaggtcatgccattttcagtgtggtggctcccttggtagccttctcccacttgccataggttctgaaggggatgcagttccacagtaggtgggtcttgttcagataaaattgtatatatccacaacagttaaattcatctatttattacttactaatttggcatcaagtatacgcaatctgctggctgctctcttaggtgattttcgtatactttcttacttaattcatgcgacctgcacccacagtaggtaatatggtctgtgttttgtggatgaaaagtctgagactcaggagggttaatttgactcaggagatagaagtaacttgactagggagatacatggttgaacagagttgagaggaaaaagaagggaaaataaaagtgtttctggttgtcacagtattcatttatgtactttttgtgaacaaaacactaacagaagttaagtggaaaaaagaaacccctaaaggtatataaaagtcaataaaatgctttttctttttacctggaatgctgtcaagtgacctttaatcaatcatgtctttctatggacttcagattcttctgtataaaattagatgtttggattggatgatttctaaagcctcttaatttttatcacttgggaactatttgacctaacttaagatgcaagataaatatgactatttgactatcaaaatttatttttgctccatttttgaaacctattaaaataaatataaatgaaataaaaaggcataaatttatgaagatcacaagaatgggagagtgggacaacaataggcaaatgatgtctgtaaaattttggtgcttgcaaaataaatagataaatggtaacggagaccagagaaagcagaaccctgagctggcaggcagggaagaattcaaccagaaacatgttcattactgtgggaaaactcgagagcgctcaggaattgtaggtagcaattactgtaaaggtggatttatggattagaactgacaagagtagacttggttgaaaggtataaggagtagttagatcacaagatgttctcatcttataaaaccaggcatctgcccctccacactctagcaaaagaccagaggtttcctgaagaggttgaattggacaactgtgaggctccaagatacagacagatacaactgaggatgagggtgagatatcacactgaaaatgagggaattgtttcctttaaataaaagtgtgcgtgcttagtgatgggattcccagtattctggcagctgggcttacacctcctcttaagagattgaggagtttctcttcagggaagtgcctcgcccaagtgaaacgaaatacagatactgatatttcagtagctcttgataaaataactcagctgccatatttgcaatgaagactgctgttgccaagtcccatgtatgaaaacagaacttccagtcagcaatccggaatttttaagaacagatagtagaggattaccagacatctgaggaaatcccataaaagagaaagagaccagctcacaaaatggggaaggggagactcttggaagaagcagatactttaaactccaaggcggggacaggctgctgtcatcaatatcttcagaaaggatgagaaatttaattgtttccacaaagtataacaaaacaccataaagaagaaacagctgtaagacagtcgtattcataaatatttgatagcaaaaatgaaggaatcagtaggtatataggaaatgtatttaaattctccagaaagtaaaacagagagacacaaacaataaaagagaaatttagagatagcagtccatctcaggatgtccaatgtccaaataataggattttcagaaagataataaaagtaaatggggagctagaatcaggtgggattgtatgggtcagtacccagtcccattcttgctccccatttactccactttttcactctgtagtagtattagactttgtaaactctgcaagtataacttttatgtttaaaaatattttactgaaaatggcattttaacaagcaaaaaataattacatgcaaagattaaaaatatatatttgagttttggttgaagaccaataaaattaaaagttggaaggaaaaaataccacttagattttttaaagtgctaagtacttatttcaggaaaattacttcaattgccatagttaggtaaattgaggaacaattttctctcagaaacagcagcacagcagtggcatggatcacggaagaagtggctgctatgtgagtttgtaatcaagcatcttgccaaggcgaacagcttcctccctgctgattttctatttggtagcaagaagtagtcatgatttaccttaattatagcaaggcttttaaaaattgtgtgaaattcctgatttttttttgtattcaagatgtatgtattgagtgtctgttatctggcaagcattgttttaaacagtttatttatattgacttatttaatccttagaacagccctatgaaggtaggtcttgttgtcattcctattttacagatgaagaaactgaggtatagacaggttaggtaacttgcccaggtttactcagctggcaaacagaaaaggctaggttttaaatcatggtagtctggttacagaaggcatacccttaattaattcattactattctgcttgttaaggaaccacagacatctaagtttaaataaattgcccacattcccatagctagttattttagaagcaatgaattttattgtaaagcttccatcagccaccgaatgcttaagaactcatctaagccagtcctctcattgattgaataactagatccaagggctgaccgggtagaagaaccaggtattccacagtgaccagtctagtgcatgttagagacacctggtgtcattttttctcacctacattctcatcctagaagtgttcattcatggtgatatttaacgtgtgctgaaactgttaggatagcaaccgaggaattctgggaaattagcttcattcacagttgtggaatatagccatcactgaaataaatataaagaaatatatcagggttttttattttacgtttagccccgttttatgtggtgtgtgggaaacatcatattttaatgcatgtagcaggagcttaaatatttgccattaatcaatgatgtgtagcacactacagtgtttcttaacattcaagattaagaaattgctttcacatataaatgctacaaatttggttgtttatttttcctagttcaactttgtggggaaacttttgggtccacgtggcaattctctgaagcgtttacaagaagaaaccttgacaaaaatgtccatccttgggaaaggttccatgagagacaaggccaaggtaatattaattatagaaaacggctaagttgtgtatcatgttatattatgtgctcttatattatccactgtattcatacatagttacataaggggatgtatttgtgatactgtttagaaaattgagtcactctggtcagcttcagaatatgtagtaacttaaacctgcatctgtaacctttatagtcatacattaaataaaaacataatacttaaagttttgattgcagttgtaatatgtcaccttgtaggaagtaaagtaatattaaaattatcatgaaaagaaataaaagctatctatagtctcatcattactgtttgcattttagattagtgtttttggagtctttttttctgtgcagaccttacatatagttgagtttataatgtatatgcttttatttcttctttttgtcttttatttgatattgtgtgcattttagaatgttattaaaattgattttaagtgtagtaactgcttattgttctaacacataattgttctacttagatgtattcacattaatagtcatggtttttaaccagctaaaaatagtgttatttttattgatcattttcttaaatatgccaattctgaaaattttctcatatcataatgtgtgtcacattgttttctaaagacacgtgttgttttctcattattaaaagatttatattactgagaaccaaatccacattgagtgatcacataccgtgaaatgttgaacaatgatgttttaaacacaggtgatttaaacacaatccaacatcctcacaaaaaagctatctaaacaatagcttttataatacaaatggccagtatttgtttattcagctgctactgtgagtcaggcgctgtgtgaaacatgttacatgcattccttcatgttatccttggaaaaatgatgggagataatattttcttcattttacatgtaaggaaactgagattcagagaacttgagtatattatctgggttaatttgagaattttttgtttttgattaacacagttaataaaaccatggttttctgacaacagcacccgtatattttcgacagcattggaaaacatgacatgtttcagatttgtgtgggatactgtttaaaagtagattcccatacctctacttgtttagggtagaaactcaaaatgaatttcagtaggtgtttgaaatgattccagtgcatggcctggtttttttaattactcactaaacattgctctcttaaattatgacttcaattctctgactcatctattctggcagtaggagaaaatgaaaacatatatttggccagttggtcagaaattatgtgtattttgcaggaaagtactctacccttgctgatatcttagttcacgctctaataaggccatctggtaatgggctgcacgatatgagcagtgaaacccacaagcaggattccactgtcccacttatttagtttgttgttaagggggttggtcagaaccactgcttggtcagaagcagtgttttgtagcatacagtggtagttatcagggcatccacaagaattttacaggtagaagggaaacaaggaaggcaaagctttatctggattgtatgcccgagttaacagcaagtgcctgactacccatataatgaaagggatcctaaatattatcagcttggtgtcagggcttggtgggccttccagatgatattgtcatatcaaggctgtctgctgttggcatattggacacacagcatgtcaatagccagtgatcctttttgaggggagtcggtgttatgaagtaatgcatgacttccctcctggccaccgtggccattttgctgatgagcaccttgagttgcatggagactgctggggattaaggtgctctagcatctgctgcaatgagtcctcttgactacctggctgaatgccagctctgcatttgcatgggacaccctgattttacatgattgaccctcttttccagatcacccattcactggttctttcatttctatgtctttggaaatcagtatggtgattctgcaagtggctgattgtgtatatttcatcaaggcactcaggaaccagggaggggagtagcatacattgtggatttacaatccactgaacccactgtcagtggactgagaccagaagtctccttaccttctaatcccataagccccactctgcttggtggccctcagtggagtggcattaggtcagaatcagttctgttaattctcaaactgtctaagtgtttcctctgctcggtgtaaagtcactctagtaaaatgtccgagatccttgctgggatctgagattcagagaatttgaatatattatctgggtttattagagagattcattgttttgggaggactaggaggaagctcacacactaggaaatatcatagttactgtacgcaagcagcctttcccctgggtttaacatagctctcttattctctgcatgtttggttaagcagagattgatcgtaggccaggagatgataaggaggaggagtagtgaagcatgagaattgtcatctcccttcaaggaactacctcggctgtgtaagcaacatgggaaaaacatcaccaggcaggcttttgccgtgtggaaggctctgtggcatttcagtatttgagtactcaaagttatttgaatcctcccagacgtcaatgtgttctcaggtttaatttattcttaggttttcactgttatccagacactgtcctgagtctcacataagagacggctgagcatctgtattgttattcagccgcacacagacttgaactctgcacctgtttgttggccctgtcaacctgtggctgcaagcggtgcaccctagcttacttctggctctttgggcttgaactgataatgtaaagccccagtctgtcattttctctctaaactcttttccaccagttttgtctatctcttgtccacctgtactcctctccccatttttgtcccatactgcgctgtagcctctgtcacatgatccatcagtcattctttcaaaagcattttactgagggtgaccacagatgatcatttaagtaacaggtttgcaacttaaatggatactggccagtcatggtggctcatgcctgtaatcccagcactttgggaggccaaggcggggtgatcacctgaggtcaggagttcgagaccagcctggccaacatggtgaaaccccatctatactaaaaatataaaaattagccgggcatggtggtgcacgtctgtaatcctggctactcagatgctgagacacgagaattgcttgaacccgggaggcagaggttgcagtgagctgagattgagccactgcactctaacctgggtgaaagagcaagactctgtctcccaaaaaaataaataaattaaaaaaaaaaaagatactactagtatcccatctgctgtattataatcagatagtcactgcctgaattcttgaatattgatttcagttgatcctttttactagttttagttttcagaagttatcagttaatatgtttatttctaaagagattcccattacttattattttaatctcatccatttagattttcaaagtgttcactattaaaatctaatgtgaatataatttttctgcatttatttgctacatttatgaaattatgggagtcattattgatgtatattagttggttacatagcataataatcatgacagtgctccggtctgttgagctttcagcttgtgccaaacttcatgctggatgttttgcctgcatcatttatactatacaataatagaataaatgatagtgatataataattatcattactatatttatcatttactgagcgcttattatgtgcaaggcttcatcctaaagacgttttgtttgttaactcctttattactataacagccttatgagataagtactgtactattattttccccacttaaaaatcacccctttaagatgagggtaatgtaatctgcccaagtcatacagttaatgttgaattaggggtttaatgcagaatttcaacatctgtgtttttctccaaataacacattgcctgtcatcattaatctgtagagtagtttggtaataactcccctctctgtgggattgtaccctggctacagctatgataagaaatcctctctgtccagcttaagtttgtgatagaaataataatgcttgaataataatgaacaattataatctttcattaacatcattattttgatactctattagaaaaggataagtgtttgtttcaataatttgtgctttcagggatgaattgctgtacatagaatgcaatttttaaaacttgagcaatgagagagattcagatcagatggttgaaatgttctgattagaacaatgaagagttggcgtaagataatgttttgtatagtcaaaacaaatttcaaaggaaatttatagaatattatggcagcttatatttacatatattcccttatattttttcctttcattcagtttctggcctacttctattaatgtgatggaagctagcatgtattggtgcctattatatgttaggcagtgtactaggtagtatatacactgtctcctttcgccagcatttatataaagctgtgccttgtattctcagtagttctgcattaatatacatgtgctaccaataaacagattttgcaaattaagtattggattacatacagtctgtctaaactcacatggctagtgactggcatagctgagatgaaattataggtgactaaatcccatgcccatttcccgctctgtgtattagtctttcttttctttgtaagagttcaaattagtcaagtaacagaagttgaatccttcaagggtgaagtcaagggctatgtgcctctagcatttattttattattggcctcttgcttaattgtgaaattaaaaggtggtattgccaggaattcctggggttctcttggttatgggatagcctttttgagagactagaaagatttcttatcttttggaaattagcctcagattcctgttaatcttaatctgtctgatactaacattggaaacagagactaatggaagacccagattctgaaatcaggacctaaaattgaaggttagttaggaaaaggcagtggagcaaaatcagtagttccttaacgatctgtttttttctcctcctagttttcgtcctgcatttccttatggaaacaaacaaagattaaaaactttgtcataattatgtaaaataacgtaataaagtctttcattttgttttattcactgttttattctcagatagaatatagtgcttggtatgtagaaatgttttttgaatgaatatgcgaacgagcaaattgacatagcaatgaatgaatgtttaatcattcattcaacgaatctttgttgaacatctgtataccaagcacttctctagacatggaaaatgcatcactaagcaaagcagtcacagtgtctgctccatggtaatcactttttactaagagaagatagaaaatagacatgtttttaaaaataagttatttcagatagtgataagtgccttgtaccagcatcacagagacgcacacagccagtgtagaagtgagcacgtgagctcagccaggttgagaagcacaaaagaagtgtgggcagtggctgcggagggttgagcaaaggagactggagaaggtgaagacaccctagcagcggaagtgagcagatgatggggctcctacaagtcagcgtctggagtgggacattattccagcagcagtaggaagcctttgagtgtgtgtaaaagcctgggaatatcaggatcacatttatagcttaaaccttcttttttagagtagtgtctactgtgacaaccgcttgccagatggattgtttttattttgggggttagtttttatttatttatttatttatctttcatttcttgtaatgacacgtttttaaatgtgatttcttttttcctttttccaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgttagtaccgtttttcttgatagttaacttgtactttaaagtctttgctttaatccttgatacttcttgtctgtaactgttatttgcatagctccttttctgctgtaaagctgtatggacatcacctcaagtagaccttacattgtccttgtaaattactgggcattattccttatgtatatatgaggtgttagaatttcaggaagatttaataatatggccaaggttacatggctaaaaaacttgcatagcacaatcactagttcaggttttgaaacgcttttcctacgattttatgtgacactgtacaacttttttgttctccaacacaaaaccattagtgcctctgtgtgccatgcacagtgcttggtgttggcatgcagacttgaataaaagcagtccctgccctcatttagtataatataatacgtaatttagaggaaaagagaaacatcaacagatgatttcagtacaacatgataaatataacagacataaccataatgagcccagaggggatgggctatttagctagcttctgccaagtattttggatgttttgttaaaaattgactgtctgttttaaccctttcagacaccttcacattgctaaggatgtgacaatttaaagggaatacatctctacctctgttacgaaagttgatttaagtcttttgtgtgatttgtatgctcttgataaaaggacttattatgtcatttgcatgctcttgataaaaagaatcgtaaagcatcaacactttggctctgcagacaatttattttagagaagctgacacatctgccaagtagttctctggataagactgtctttggttatcccaggttagtttggtggattgacttacatactacagcacatgtactgtgattatattatctgtgaggaaaacaattattatatttatagggaaaggatatttaaatcacttttgcctttaaaaagccaggacatagaattgcattaagtatgtaataacctgggaactgaaatggctagtattttctttagttcccatgagcaaatatgacaatctatttcttcttttagtttaaaaacaaaatttctaagggcttactatgtggtaggcagatgtgaactaataaaatacatgatccctcatggagtttaatggcaaagagtcagatatgagtcagtttttcatataaatgactacaaaattgaaactatggcgagaccacagctaaggagaggagtaagttttggtgatcatgcagtgtggaccaggcagtgcagatctagccaggtgaaacagattctcttttccaaagatggctgcagtagcaccatttatcccatgacccttacgatccttccccagaggtagactctaatttacctcacacagaatctggactggccaaaaaagtctttgcctaatgaaggtcaccaggattttctactgttttattttaaaaatttttcagtattctttcacttaaaatacattttgagttaatttgtatatttgaggttagtctctaaatttatttttttctagatggatatcagttgtcctagcaccatatgttgaaaagacaatcatttcctcattcagtaccttagtaccattgttgaaaattgactaaacataaatgtaaaggtttatttctgcattctcaaattctttttcattgatttgtatgcctactcttaatgccagtagcatgctcttaattactttagccttaagtaaatctggaaatctaggttgtgtaaattgtccacctttgttctttttcaaacattttttggcttttctggcttcttagcattttcatatgtgttttaggatcagcttcttaatttctattaaaaaaaagctggctaggatttgatagatattatattgaatctatagatcagtttggggataattttcatcttaacaattttgagttttccaatccaggaacatgaaatgtttcttcacttttaaaaaagatattttaaaatttttctcaacagtgttttatagtgttcagggtgtcagccttttcctttccttttgcaaaattgatttgtaaatattgtatactttttgatactactgtgagtgcaatttttaaaatttcattttcagatgattactagtgtatagaaatgcaattgagttttgtatattgattttgtatcttgtgatcttgccaaacgtgtttattagttccagtgtggtgtttttttaatagaatcactacaatgattaagtggaatcctaattagtggaatacaggagcatgtcatctgtgaataaagacaacttaactagttcttttccaatatggatgcctttaatttttttaatgtaatgttgttattctattctattccattccactccattccgtgccttatgacactgactagaaccgtgaatgcagtgttgtttctaaaattggaggggaaagcattcagtctttcaccattggctataggttttttttattgctaccctttgtcatgttgaagaagttctcttatatttctaaaggatgagagtttttatcatgaataaatgtataaacatgggtattgaattttgcaaatctttttcctcctgagatgattgtgtggttttattctcctttattttgtgaataatagtgtattacattagttgatttcagatgtgaagccacatttgcattccgaggataattcccacttggtcatggcatgtagtcttctttatgtgttgctagatatggtttactaatagtttgttaaggatttttacatctgtaattatgaaggatattggtttgtcgcacagtatttttctggagtcttttatattaacttatactattttgggtgcccttcatttcttcctgtggatagagctgccatatggtattatttcttttcagcctgaaggtttttctttagactttcctgtaacctaggtctgctagcaaaaagtcttttgtttttctgggaatgtctttattttacctacatcctaaaaaacaggttatataattattgattgatcgtttttgttttttgtttctccagcactttgaatatgctactctgctaccttctgacctctgttatttttgatgagaagagtcattaatcattttgctgttctcctgtgtataatctgttgtttttctcttgctgctgtcaagattttttctgcctctggttgtcagcaatttgggtgtgatgtatgtttatcctatttgttggctaagctttgtgcatctgtaggtttatgtttttcattaaatgtggaaagttttcagctatttaaactttttctgtctttctaccccccaccacaccccctaattccagttacgtgtatgttgatacacatgctggtgtctcatggatttcttacattcagggtttttcatccgtttttctccatgtacctcagactggataattttaatggactagtcttcaagttaactacttctgccagctcatagctgttattgaactcctctagtgaatttttcattgttggcaatacgctttttaaattttcttttgttgcaattccaacatctgggccctctccaagacagcctctttgtactgcttttctccccctgagtataggtcacgttttcctgtttctttgcatgtttcttaattttttgttgaaaagtctgtattttcgataacatagcaaacctgtaatctgatgtattttcttcccagaggagtttttgttgctgaggtgttttttaattttttttatttttttgtcttctatttctttaataatttagttggaataaatttgcagcctgtcttcctcatagttacagctaataatatctctgttaatgtgtttttttcttgcgtttatttttaaacctggcctgctagggatgttgtctgtgtcagcactgcttagtggacagccaaggggagctcgtgttcagacagctgtgtaagtgaggtttccatcctccgatgatggagctgtgtgtgtacataggggagtggatccaagaagactctcgccatgtccaccctggcttttctgttgctctgggatgcctcctgtctccgctgcatatatgtgcactcaccttcaggaaaggttgtatggagagctttgcctcactctcttcttgctgtccatgcatatagccttccatccagccagaggtgtgtggcgagcttttcaagactgtctcattttctgaattatctgtccaatttctggctagcctggtggtcagtttcttgacgcaacccaagatggcaatactaggtgcatccttaggcaagcaggccagactctcatatttcttacctgaaatgtagcactttttaatgaataaatatattatattttcagtttattgtgtaccattagtcagttttcagactcctaaaatggttactttgaaccatttcgtcagtttttattttgctttttatgggggaggctttgctgagctcctcccttagctgtaccagaagtcgcatgtcctattagtaccttttgtttttaacttacgtgattttggaccttgttcctatgagcatatgcagttttatttcattctttttaatgtctgcataatattttattatatgcatgttccagagtttatttaattggccctcaaataatgaacattgaggttacttcttatagatcacaatacaaacagtgatcctaggattaaccttggacataactattggcctattttggcaaatatagctgaagagtaaattcctaacagagagcccactgaatttttatgagttacttttaatgatttcatttaaaaactttttctccattcttcaggctaacatacatttgaatagattgtaagctcactgggtagtcaagtcctgcttacacatatttactcaaaattttaatggcttttctgctctttacaattcatgatggtgttaatgttgtaatagtttcacttttcagacggggagttaaaatgataatttaaaatgcaaaattacagaaataagttagtctgtaagctactatgaatgatttgcattctctactaatttaaaagcatttttcaaagaccaagaaaatactaactataatggttatatcaacagtgtccatttgacaccaggagaaacagtcacctagaattttaaaaaattgtctacaatcacatagctgttaagttcaggtggttaaatttagtcttagcctcagaagtgattgactcaaattccatatttctttccctactacactattgttaaatgtagtttttcaaagatgatatcttaaatggacgttatagtttttgtgatactgttataatcacctaaccttacttagaacaatactttttaatttttaatttgtttttgaatagggccttgactgtgttctttttgcatgaatctatttttaacttcatacaatttagtattacacctcctaacacttttcagcgggtcaaatatttaccatttatatagcacattatatttagagctttacaaatcacttatttagaatgtgttttacaaattatgtattaatcttcacacattttcagtaaaatggctgggaacatactaataggattattttagagaggttgaaataatgatggaaagaatcagatgtttcccctgaggtcacaatacctgaaataagtcagggaaataatttatatttacaataaaatattgactccattcttaatttttcctgtcaatcacagttacttgtattggtcattatttgccttctcttcttcctgctttgcaagtgttagctgattatgattttaactttctttttgattggtgttcatatatttttaattccagaatgccttctactacaagtttcaagtcattttttgcattctgcttttgaaaaattttttaaaataaatatcctgaatttctttcaggtttttaattctaaataataaataattcaggaatctgtctcctctaaatgttctatttacactcgaatatgctcatgtttcttctgtcttaaaatcctctgttcctccctgcaaactatgatcctttctgtctcgttttcattgtggccatacagctggaagtagctgcctgccgttaatttctgtggcttactgctatttattatttattccactgaaatggattccatctccacctttcacccaaactatttctgatagtagtggctttactgttaatgaatcccatagaattaggacttgctgttttggcagaatgtaaatacaacactgacttcctgtggcttttataatgtaatatcttcttatcctcctcagtttcttgccacaccttttcagtatactctgtgaagattcactccttatgttttcatcaaagacaagcttgtccaacccacgtgccacatgtggcccaggaaggctttgaatgtggcccagcacaaatccgtaaactctcttaaaatattgaaacattgagatttttttttttttttggtagttcaccaggtatcattagtgttagtgtattttgtgtgtggcccaagacaattcttccagtgtggaccagtgaagccaaaaaaattgaccccccagaactaagagttgtatagttttagttatttacagttaggtctcttgattcattttgttctaatttctgtgtataacatgaagtatgtggggctctcactttattttttatttgtttatttgtttatatttatatggctttctagttattgcagtaccagctgcagaagagactacttaaaaaagcagttgactgtaacttatatctgagctctcacttctatttcattgatcttttttaaagatcttttttaaaatttgttttttattatactttaagttctgggttacatgtgcagaacgtgcagttttgttacataggtatacacgtgccctggtggtttgctgcacccgtcaacccgtcacctacgttaattctccaaatgttatccctcccctagccccccatccctcgacaggagctggtatgtgatgttcccctcactgtgtccatgtgttctcattgtccacctcccacttatgagtgagaacgtgcggtatttggttttctgatcttgtgatagtttgctgagaatgatggttttcagcttcatccctgtccctacaaaggacatgaacccatccttttttatggctgcatagcattccatggtgtatatgtgccacattttcttaatccagtctatcattgatggacatttgggttggttccaagtctttgctgttgtgaatagtgctgcagtaaacatacatgtgcatgtgtctttatcctagaatgatttataatcctctgggtatatgcccagtaatgggattgctgggtcaaatggtatttctagttctagatccttgaggaaacgccacactgtcttccatgtagttgaactaatttaaactcccaccaacaatgtaaaagcattcctatttttccacatcctctccagcatctgttgtttcctgactttttaatgattgccattctaactggtgtgagatggtatctcattgtggttttgattgcatttctctaatggccagtatgatgagcattttttcatataactgttggctgcataaatgtcttcttttgagaagtgtctgttcatatcctttgcccattttttgatggggttgtttgctttcttcttgtaaatttgtttaagttctttgtagattctggttattacccctttaattctcatcctgaggcaggacttcttgtaacaaacttactatttcctttttgatcctttagacctgaactttcccttttttgtaaaatagattacatttaaatttacccatgtcttagctgatgattgttgaatggagttcagggtgctaaggaagcaggagaaatcaaggaccactcctagagtttcgtagttgaatattttgataataatttaagatgaaagagcaaattttcaggaataagattatgtgttcaattctgaaaatgttgaatttcacaacttgtataattttctactggaaatgtacaaaaagcctgtgtccctgtggttcttaactacatgaaggctatgctgttgtgtatgtatatatatccttcctctttgctagagtgaagtccttgggtgctgggctatggcttaattcctctttgtttctctgttacttggttcattatagataatcaatacctgctagttgaattgagttgtaaataacaacacccatatatcagttttatggtattttaattttattataaatgtctcacttgcaaagtatgcccagagaaaggttagtggctgattatagaaaattttagcttgaggaaaaaatgctgtagtttttttcttccttttttacaagaatttattatcacatttttattttagcaaatttgtattttgttttgtaaattcaactattttcctaacccttttttctattaagaattacttgctttttgttctaaatatttttgcatttctaatatgaagtgaattttgctatcttctgtcttttgtgtaggattataatgatgagatcaggcaagcacagctccaggagttaacatatttgaatggtggttcagaaaatgcagatgttccagtggttcgagggaaacccaccttgcgtacaagaggtgtaccagccccagcaataaccaggtaggtgtaaatttttttttaggttaacataccgtggcagcagttttaatatttcctttattagtagccaaaaccagttctatctgaacaaaacttgtattcatgtgggcatggtggcacatgcctgtagtcccagctactcgggaatctgaggccaggagttcgaggccatggtatgctacgatagtgcctgtgaatagctgctgcactccaatgtgggcaacgtagtgagaccctatcactttaaaaatcataatcataacttttttaagcctatggtcaaacaatgtgatgtcatattaaggggatttactttggagtgagatattcctgggcttaaatataacctgtgacacttattagctgatgattctaggtgaatattattattcactgtaatattacttcttaaatttttttaaatgagacttgttttttatgtaagtaatcgcattgatatgaagattgggctagcagtcacttgtgttttgccattgagtaaaccatcaggctagttcattgcaacatcaccaatcctaagcacagtgtgagacaccaagtcagtgcccacatgcttgttgtaattttattcactgtaaaagctctgtggcatctgtaaattcctgagctggtctaggcacacacattttttatttctctccttggattggtgattaatgttaatgggaaaatgttttgaagaagtcataaatctgatatgactatctcaaatttatttgagaattatttttaatttttcaatctttgaagtcagtggaaagaataatgcaaatttttcaattaaactaatgactatggataaatttttattttagatagaattttgcatgaagtaatttaaaatagcattcttgtatatctctaagtttatttgggagaataaaaagtcacttcctcaattatgcattgctgattagagcaatgtcagagcagttatgcaagaaacatagatatgggtatgatacctatggatttttctctattaataaaaagagctaatagtaatagggttgctattgatgattttatgagataatttatgtaggtactcagtaaatggtaaatctctttcatttctattttttctaccattaaatttacttgaaatcttaggaacttacttacctgcttcattattttcatgtggctgctgtgacaaattaccacagatttttttttttggctgaaaatgatagaaatgtattctctgatcgttatggaggccagatgccaaaatcactatcactaggccaaagtcaaggtgttggcaaggtcgttctctccctggaggctctaggggagattcctttccgtgtctcttccagtttctgatggctacaacattccttgatttgtaggcacgtcactttaacctctccgtcctcacactgccttctcttgtatctataatcttctgcctcccttttacaaggagacatgtgattatatttagggcacaccagggtaatccagagtaatctttccatctcaagatctaaatcacatctgtaaaatttcttcttctagataaggtaatgtaactagataaggtaaccttgtctagaaatttctttttctagataaggtaaccttgtctagaaatttctttttctagataaggttcctgggattaggacagcataattttgagtgacctactagtctagttagttttatctttgctgtgataggagcttgtacatttacaagccaaatacaacaaaatatattttattttattttgtttatttatttattttttgagatggagtgttgccctgtcacccgggctggagtgcagtagcacgatcttggctcactgcaacctccacctcccgggttcaaataattctcctgcctcagcctcccgagtagctgggattacaggcacctgccaccacacctggttaatttttttttgtgtatgtatttttaatagagacggggtttcaccatgttggccaggctgctctctaactcctgacctcgtgatctgcctgccttggcctcccaaagtgctgggattataggcgtgagccaccatgcccggccaacaaaatatattttaaaaactcttctgaaagtctccaaacttatccctacattaccagtttatgtttgtttgtttatttgtaaatgcagataaatagtgagtgttcattcataagtggctagttgcattattgatgccattgcagacagcaaacctcccaatcaagaaattatctcctacccctttgaaataatagagactcaaacatctgtcctcaaatctcacccaaaaagtgaacagaaaatgcatatagataagtaaaaagagaaacagtccaggcacagtggcttatgcctgtaatcccagtgctttgggaggccaaggcaagaggattgtttgaggacaggagtttgagaccagtctgggcaacatagccagaccccatctctgcaaaaataaaaataaactaaaaagagaaacataagtctcccacacatgacatttatatgtcagcattccaatcttcttagtgaaatatagataaaaaggtatctctgtatatatatacagtttatttttagtgatatatatatatctcttatgatgaacactatatgtagtattcatcataagaaattatttacctggtatattagtttcctgtggctgctgtatataactttatacaagtaagagtagtacacagaaaagtgcatgttacaacatttattttatatatatacttatctttatatatatgtgtatgtaataaaattaacccagtgatatttcacttaagattaaattactcttacacctttttgcagaataccagcacagaatgaatatcccctccagaatagagtgtggagaatcgagcacatccgctgctgttgtttaggggatactgtgttcctcacactagatctgccatttttactgaatataatttataattcagttgtcggtttctaaattaagttgttgaaaatgttatgaacagaggaggaagacagaagtagtttttttgtttattttgaatacagtacctggacagatacctccatctgcacagatgaaaactcatccctcgtgattacagcatatgcattgcttgtcatttaaagttgttttaatgtcttgatggttaatattctgtgatagcattatttttaagttcaaattttagaccctagtttcagtttgtggtggagtaatgattggttcagtgccagagttaaatacctttatttgcgtacttacggttaccacctgtgtacttgaaatcataagcagctcatatgctaggcaccagcagggcactgaacacacaacccactttacttcctccatattattatggtcttccttggtcccaagtcctttaaacaccttgtttctacagtacaatgtttatattcatacggcaggaattcaaagccttcttggtacgtgttttctcaaatcctttgtacagtttagtctactgattattttgccatatttcctgtgtatttaaccaaccctagggtagaagctttgtttcataaagttggtgcttgtattcttctatatctttgctcacttgtttcttctgtctcgccttttcaaaatcattattaccttcaagtctgaattgaaactcattttaacaaacacttatattgcagctactattggttgagtacttttctaaggactttacagatattaactaagttatgcctcatcatagtccgatgaggtgggcactgttttgttaacattaccatttttcaaatgaggacagtgagaccagggaggtagattctttgccgaaagtcatgcagctagtggttggtagagccgggtggaatccaggcagtgtgctttcataatccaaacctctcctctctgcttggtccttcccttgtgttttgatccagaataagtaataagttttttttttttttcccattcccttactgtagttctcccagataattttcattctagcacttttattgtgttttcattatggctcatgatcacacttttaatacaagatgaaaagacttaaatagtcatgcaccacaaaatgacatttttggtcaaggacggacagaacatgtaacagtggtctcataagattatgaaagaactgaaaagtccccattgcctagtgacgatgatgatcttgatgatcttgaccctatgtagtcctaggctataggctaatgtgcgtttgtatcttaattgcatacgaaaacagcttaaaaaataattttaaaagttaacagaagagtactgataggataaagatataaagaaaatattttcgtacagattcacagtgtttgtgttttaagccaagtgtggctagaaaagagtcaaaaagtttaaaaaaaaaagttaaaagttgacaaattttaaaaaattacagtaagctaagggtaatttttgaagaaaggaaaatatttttaaaataaatttagtgtagtccaagtttataatgtttataaagtctacagtagtgtcctaggccttcacattcacttgtcactcactcactcactcacccagaacaacttccagtcttccaagttccactcatggtaagtgccctatctaggtttaccattctccatcttttatattgtcatgtctccatcttttattgtgtctccactgtaccttttctgtgtttagatatgtgtagatacacaaacacctatcattgtgttatagtcacatacggtattcagtacaataacatgctgaacaagtctgtagccaaggaacagtaggctgtatcatatagcctaggcgtgtagtaggctacgccacctaggtttatgtaagtacactctgtgatgtttgtacaatgacaaaaacacctaaggagctgttccttagaaggtatcctcatagctaagcgactgtatttatttactcctttttttcatgaaatcacatgcggtaactaatgataggtggtaactaatgcccaactaatatagtccacagaataaaactaaggtaaatataaattgatgagcaaattagggtagaaaattacaaaaacccaagggtaaggtcagtacacaaaaacgtacgtattacaacattccgtagtgttggcagaattggtcttgaaattatactttgagttgccttgtggctaaagatgagggaaatatggctacagaattcagtgtctaaatgtccaaaaccagtcacaatacatacaaaagaaaaacatacttgttggagcctatgaatttctacttaagacttgtgagaaaaatctccaatgaatagccataaattggccttcatatgatgtgataatatcttcaatggcattcttgtttgccatattcagttccttagtaagtcatttttcttttgcctttaaaatcaacctgaagtcattttttctttaatcatctctgccatccttcccagtctaatccacactactcttccattttcagtcacaatgattttttcaaattaaatgtgatcttatatcttccatacttaaaatccttcagtggctcctttccagttagaagggaatccacacttcctcatatgcacttacataatccagcacttggcactctcctcccctatctgactctatcttattccacttttccattgtcttaactccagcgttactggtctcctttctgttgctccttaaatagacgaagctcatttctttcccagatccttcacatttattctccttctcgttgaaggctttgtctccaggtgtctggccgcctccctctcagcatcgcatcctcagcatacacggtcagagaagcccttgctgagcacgcagtgtgaagggtccttcctctcagccagaagctggctcagaaccccctgtcctggtggagtagtatcattggtcaagccaatttaccttatttattcacgttgtcattggttattccttatgggtaatgcaaatccataaagacccatgtgtccctcgtaccttgcatatagtaattgctcagtaaacaataatgtgaataaagtgctgtagcacattctttagcctctttctgatcaagtgttgaccactggaaatattcttttgctaatgctgatcttatttgccacaggactgggtatgtgaaggtactggttttgtctgactcaacagttgtgagccgtccaggatgctgccttctgttcctctcctaacactcggtggcttctgtgctgcttttccattgacctttgctctggctcttctggccctttcttccacgtaggagcagtcctaccttcccacatttgataccagaagcagcaagaagaaacatgaacaaaagagattatgccctctttttaagtattaagtgcgtgttcccagatattggtgcttaatgtagtggttttgttttaagtgagaacattaggctaacccagtcacccagggtcatttatcagttttcatcgaatcagggaaattttcagctactgtttcttccgatattttacttgcccctttccctgtttccacactatgggaactgtcagcttaagataatcctttatagtttcttttgagcattagatcatatgttactgattttcatgatgtcacatctttgtgacgctggtattttaccagatgctgtgataaacaataaacattatctgaaaataagtgtggatcaggaaatgagagtgacagtgtcccatctgatcccatggtttgagaagttacgtagcacccaatatgcataattgctgttatttaataatgaaataaaatatttcctttcaattatgatacatcttataaaataatgtgtattatttttcaaacagctgcaatgttgttgagaaataaatatgtaagttgtttggtactcacaatttaattaccaaatttgttccttattggtttggcctggggcaaatatcatgaaaaaattactgaaacactaaggacattgtgaactgagaaatttggggaagcgtctttatgatattgtcctacaggctgagtctctgctcatttttcattatttttttgtctgttttccagactggtctatgtcttgacctagcctcaaagttcactgcctccttcgtttgtattttgaagccaatccgatgatattttcatttcagatgctttatattttcagatataaaattttcatttgatttttaatagttttttatttgtctgctgaaattttatatctttttgttcattagcaggatcttttcttttgtaatcacacccaggtttggctgctggctgctcactgctcaaaagccagacacaagacgcaaacacaggaggtgagggttgatgggaagaaaagcaggtttcatagcgttctaaatgttaaaatttaccctagggtttttaaagggaaacttggtgtgggagacacgtgggagtgctgcagagcgtaggggctgcgagtcttgttccattggctgtcgtggataatcgcctacccggaggcctggctggtgtcaccttgacttcagaccagtggcggtggactcattgttcgtgattcccgctaagtggaaggattccaaaggagcttcttgcccggtttaagattagcctctggaatttcttaagcaagaacatgatttgataagcatgcattgctggaggggagtttctttagagggaaggaatgaagaggtgagaggggagggaaggaagaagaagtgggtgatttttgaaactgagatccctggttatacttttacacattataaatttttgagagttttgtttaattccttgtctgctaattaatctggttatgttagagtaaatattgtgctttgaaaactctagaatttgctatattcctccaaacagtgttgcttttatttatttttttagactgtttaagcagatagcttgattgaactctaactgcagactgtatctcttggtaagcagctaaaatctcagatgagcttcttcatccttttcagggatacttgcagtctgccctgtgcacttgtggttcagttgtcactagagagttggtgagagttcatacacagaatctgtggctccctatctctggctctcttccttctacagttccttcctcactttccagcagctgtggttgctggaaactttggcctgtgattcttcaagcgcaaagactcagagccttccattggagtcttggctgctcagcatgccccctgcagcctgtcctcattggaaacaccataagaagtcacctcattcagttacctttcttcaagcgtcataaccctttggaatctacctagtcattacccagtaacttcaagtaattgctttttgtattttatccaaagattagttttttgcctaaggtttgatttggtttaagcttatgttgttacaccagaagtagaaccttgtgtgttttgagaaaacacatgtgccagaaatttcatatctgtggctcttcaatgcctcacaacagccatgtataagcgaaatattgttatctctattttatacatgatgaaagtagactacaaatgtagagttatacatcttcaagtgttaggcagttagttgttagtggagtcagggttaatacctaactccctcaattgagttgttgctctcctcggtttcctctgtagttttatatttgaaaaataatactcccaatgtttgctgaatatactaaatttcttattagcaggcattctctctgaatataaatgtaacgttaaagtcgaagttcttcacattagaggaggaacttgattttttaatgttgaaatgttataataaagccaaagccaaagtattataataatatcttcataattcaatcaaacacggtacattcaagcctcccaagaatgtaaaactagaaacagtagaggatgaagtagatcagttgatgaaagaaatgccgagatagagaggaattaacaacgaaaccttcattattaaagttttattttggctgggcaccatgactcagacctgaaatcccagcagttgcggaggccaaggtgggaagatcacttgagcccatgagtttgtgaccagcatgggctgtatagtgagactttatctttacaaaaaaaaaagttaaaaattaaaaatcagccgagtgtggtggcacatgcctatagtcacagctactcaggaggctgaggtgggaggatcgcttgagcccaggaagcagacgttgcagtgagccgagatggttataaaaacaaaaagttctgtttgaatattcaaacctagtagtacatcatcaattgtacttaatccagacatgcatattacaaagcccctgctttggctggtagagcaataaacagttaatagaagaaacagtcacatttacttctgctaaataaaacagcacagatcctttaatggaccccaagtggtggcagtcttcattgactgcataattactcctgaacgcctctgaattaactgcctgcatattaacgcccttggacacatctatagcagctgagtggggttggagttgaccacttgtcaggatgatgaggaactgcgttaactgctgtgccaaagagcttttaagctattcccttgtgattgttaatagcactattaacaatggtttgggtcagaaaactctgggtgcaactcagtaaaacttcatcctagatacagagaataaaggcgttctcagatgtggaaaacacgtcagttcacacttgtgtaagcacttcctgaaggccccagaagagagattccatcagacattttcattagtatattttcattagtatatttcccctatgtttaattattgaaatgtactatttccagaagtatggaataactccagtttgggtattatacatcttttctgagcatgtagcaccccgtgctatactttgctgttactaggaccatatggcaaagcaattactaagtgtgttaatctccagactagcttgggctcatagtagagagggaatgtgccttttgccctttgtattgttgggtccaagcatggtgttgaaattcagtgtgtgctcaataactattcactgaaatagtaagtggagatcaggtttttaaaagcctgagaaatccgtaactgcttctatgtcaggattacatttaccaccaccccaacaccacagattatatattccatgtggccttcccattacccaaaagactaagagcaaagtactatgaatttagccttggactgaatacatgtttaaccatttaatttgcaggcctattgcctgctggaattaaaaaatttctttctttgcccctgaagggtagcacatagaaaagaaagctttagaatcagacctaaattcaagtgtcaccaccactgctacttaaggggcacaggaaggctccttctctacactttagtcagatgggggcagcactgccaatattacaagtttcccctgaggagtcaaagcatgccctgtgtaatgcggttactgccttacttgccacacacacagccccaaacaaaagctgcttcccgtcttccgcttccctcacccaactttaatttaaagaatattaaaatactttaattccttatgctgtctccattctggatattatatattttctttaaaattttcaaagcctaaaaccataacaccattatacaataaaaactataagcatgattggctgctaaaactgaatttattctaaaaaatagggtaactcactggttttcaatatagagctttttcaaaaaataactaatcaagaaccttactttcagagatgcttattcatgtaccctcctttcccctaaattccactaaatgagtgaaaaaaaatgttttaaaatctgtaaacgtactggaaattattaaattactaaatgtaagacatttctggaggagaaaaagtgatgggactaaaatgacaagaaacatcgagaataatgcattataaaaggctgccagggagttaagagtgtttataaagaagcccaaaagaaactctgagctaagagaataaacacggagaaaagaattaaaatgacaagtaaacaaatatacgtagctgtcaagtccaaatataaagatttggaagaactagtgaaagtaataaacatgtgctctctgaaacaatcaatggaaacctgtttcttaaaacaatttaagacgttaaagaagactgaccggtcatctgaatttgtaggaattctcttttccagcccatttgctgaccagcttttgaatgatcattttcctgtgctctgctcttgcttccccctgtaactggtgcctacattttatagtcagttttgtctacaaagcagcctttcattatcagtttatattgaagaaccatgttaaaatctgggcttagatttttttgacttcacattttttaaattttgtgtttttattcgtttgtttaaacaatggtgtcttctaaattttatgagacaattgagttttactctttggaagactaaaccaatcaccattaggagccctgtagtttaaaaaaaagcaataatgcctcaaccgtttttattcatagttggtttcattaaaaaaagaatagcagaatattttaggaagaagttttctgaaattcataaattatttcatcttttgaaatataatgcagtacttaagaaataccaaacctgtatgtaattctgacgtgcactgaaatgaagatttagaatcattaactctaggccttgagatagagaaatgcacatttcaggattcaacatacatagaaaaactagtgttaaattggctgctataaaattactgggcaaattggcaagataattatagaattgtcattaagcaaaaactttaggtaacgaccaggtaagaggttttaaattaagtagcaacatcaaattcaccaggagtttttctaagtttggattgtcttgagatacaaactaacttgagagttagtaatttgaaattataacaaaaagtgaacacttacaggaaagttatactttccttccttgtaatttcctggaaagaaaaaatatatatatttaacctactgtagaacgtgtgaatctacttagaaggtgagccgcatggtctctgggcgacactcctctcttggttactgttccattcccactgcccacaacagggcctgcggcacagcagtcacccagggcaggttctgtggtggagatgaaggagtgaatgctctctaggaggccttgctcagtgcggagtgccaggctgcaaagaccttgtttcctgttcccccttacccagcctggtcccctctgtctttttactcctaacaccaaacccaattccatacagttttttaagaagaaagaaaaacaaaaacaaaaacaaaaaacaaaacctctctgcctcttactttattaaaaaagataatttttgtctataatctttaataatctgtgattcttataaggcagccttacggggcaattctgtatctgttgattatgaatttatatctctatatatgtagactagaaggcagaatgcacttattttggcaaaactttcttttatgcatacacattttaggaatttaatattgtgttattttgataatataaaaataaatgtccttaactccactgccatttggaatgtttaaagccttccattaaaaaaaatctttatttttagaggcgtaaacaccaaagtgttacatactgaatagaaaagttacaagatattatctttaaaattgattaagaatattatagatgctaaagattatcttcataactgcaaatgatgtactttccttctatagtgtatgaagttatgagaaattttattaggaaaactgaatagttaatattagggccataaatgttttaccagagtatggtatgatttatattaatgtaccaatcaatattaaaaagtcctttttttattaaggaaagggtagatataggaaaatggtaatatatttcctaactggataaaattatggaaattttaaataaaagaacactccattgggatgttatttaaattgcttgtttctctaccgggtttacctgctcaggccattctcccatccagtcaccctcttctccttccttccaactctgtgcctactgggtagtctgtgtatttaatcccaactaggcttgttacctggcatgagtaccccacatctcaggcagaaaactggacgacttaccatggaaatgagtttctgtgctttttcttgctgtaaggtccaccgaattccttctactgaaatcagccttcagtattcaattactttttattaaagcactttctgatggtgtgttaatgagcaaccacactggagctgatgaaggggagacaaaaagcggaaaatctttggtttcttttaaaatcacttgcataggctttgagaagacaataacagaggcaaatagtgttacaaattgggtaacttctgacaagaacttgtagttgaaatgctagccagggatgaacagacaagaaatgcaactaggcacagattctctcagttacagctcagccagcacttttacatgtcccgtgcaacataaagctggagaaatgttctgcgcctgctgtagacatcaccaacgggaggaagcttgacacctgggttgccaacttattttttcctaaagtttaaacaagatccactaataagctaagacagtttagggcaaaaggaatccagtgagtatgtttatgtactttggctctctcttccctaccacactttggtttttcagaacttgtaatagttttactcaaaacctctttgaaaatcatctgtttctgaagctaggtcattagtatcacagattttccttaaatcctttttgtgataagagttgaagttcagcaatgaggaagtcattgtatttacctgagtaagtctagagtttaaaaggggaaaatcagagacaaacaactattacagagtggttataaataaaggagaagagacatgaagaaaagagtgccatgaaaatacaaatgaccatgcaagtaattccgcagggagagagcggatatgaacaaacagaagaaatcagatgggatagtgctggcgggaagtcatcccagttaagggtgcaaaggcttggaggcagaagagaagcagggcgttcgaggctggggattagagttgggggaactctggcactggggaagccagagtttccagagtcacccctaactcttactcactgtgtggccttggggagcttggggttacttctctctaagccatagttctttcttcaataaaatggagatagaaagataagcacacacttccaaatcctacttaatttttaaaatttccttttcaaggaatcaaactgtgctgtgattccttttttgattactcaaaataattcgatactaaaaactgaattcctgtagcacagatacttgatcagcccctcaacagaggaccgtaggcaaattacttctctgtcttaaacttatctattatcaaatggatcattgtttccagagaggaaggaattttttgctgcatagttccaaaaggcagtagagctgatagttagaaatgacagagaaagatttttgtttttaaatgaaggaaaaaagtaaaagcatgctaaaaatcagaattggaagacagtgggtgatacaggcttcaaaataaataaggagctctctgttatcagagacttcgctgggtacaaagagaagaaaaataactctcttgcacttaagaatgtacttccttatacactgtcttatttgtcaataattttaccaggaaccagtttgtaacttgttaaattgtatcttgtaaagtgccttggatttcttttatactctatacaatgtaggataaggaagcagttgctcaattagttttttttttaattgcattgaagattggatgaaacacagaataaagaaaagaaataaccaataacctgcttcataaaagggctacaacctctggatctaagactcagctcatcaaaagatggtttgcagaccagcagcagtgcttgagggcctgttagaaaagcagaatgtaaaccccactctggcctaaaacaaggtcctcaggcgatgtggatgcgcatgaacgcatgagatgcgctgccctagaaccacatttcgggtggtctctagagttgctcagagtgagagctgccaacatcatctcttcaaaagttttagtcttcatcagctctgacagtttcttccctgtgttgtaagagactataactgtaggctgtttcgccttttccttttgtcagccttctcatttgcatagcaaccttaggcaaggaaaacactcttagaatgattaaagtttattctcagaaaagctctctcacagaaatgaagcaagattgtcaaatgtattaggaatgttataggaaagatacagttacccctcaggtgcttattgtatcaggacacagacctcaaatggatctctgggaaggtttttctcactgtgacccctgatagaagactaaggccctgtcactagatcttgcaggccccactctgtagtcagcatgggtcctgctgcatctgagtgaactggagtcagctgtgttttcccaggtcaccaagttagcaatgctggagctcgcttaagcagtcagggcatctaccactgaattcattgttctacctgctgtacgtggctgcttctcataaaatttatagacaaaagccaaaaaatttagtatgtgtttacaaactcttatcagaccacattgctgttgctaaatgtgtaaaatgagaactgacatgagttgtactttctgtctccttcccttatctttcactaaacagccaaaaggaaagtatcaggacagagtagaagcagaagtctgtgtactaattaccacttactacatgcctgttttaggctatgcactttacatacccagggtgtaaacatcgcagctattctgccataggatttattaaccccagtttacagataggaaaactgaggcttaaagatcaaatgacagaactgcatttgagtattaatgtgttggaacccaaagtgtatgctttttcattacatcttaaaagtttgtattagtctgtaaactaaataattcatttctgagtgactgtttttttgtttttgtttttgtttttgtttttttggtatttgttcattcaaagcattcttcccatggcagctcactacaaaagccttcctggatttttttcatatctgagtttcaagaccagaaaccgtgtcaccctgctgaaaaacccaaaaagaaagaattattgcattgtagaccatccattaatctgctttcaaaactctatgcagatgtgttgtctttttgctcttctgttacactcagtttgtggtaccctattcctatcaatttggatctgcttttctgtttttaaaaaaagtgtcattgattatcaagttctcactaatagatgctttttctcttctcatccccatgttatcaatccagctgttcagccttgccctgaatgttatttgtagcactcagtgaaaactttgcgataagacaggattcttgtgttagcacgtcacctccatcatgttagcacgtcacctccatcatgttagcacgtcacctccatcatgcctttcttccaccagtgtcatctaaagcattgttaatgctattgctgcttaataccactcctgtggaatttcagcacctaaaaaactaattttcaaaatatcttttatagataagcgtccagaacaactagatatatatcaaatgacttgtctaaaattgcatagcagataaaaatgccatagtgtgatttcatacacgagtggtgcataaccaacaatgtcaatgatcgtggaagagaagtgtgggcttcttgaatatataaatgtatgtctttcaatttgatgaaaggcatacatttatatattcaagaagcatattgaatattttgtaattcataaagtaccttggatggcaatcatggatattggataaggaaaacaggaagcattaattagtttaaatatacactaactaatgaaaatgtcacaaaggagttagatgcactatagctacaaactactctttaatcatgttaaagatttctctagatatatatactggagatatacaaagatgggtaagacactacagaaattatatcaccattaccgttcagagtgattgaagtttaaataaactgttgatttttattgagtcagtaaaaattctaaccactttatgtgcactgtctcatgtttctctcctaataacacaaaagtgggctctatgtttagcctcatttcatagttgaggaaactgacctggacagttcagacccttgattagtttgagtgctaattgtcaggtagatgttaagctagtaagtacatgaggaattgaatcctgatctgattccaatgtttttgctcatgacaactatttttactgtaccaattgttatggtctaggattttaaagaaaaagcctaatttacaatagtcattaaaggtttacctgagggtgagctgacgaaaaagtgttatttttttctttttactgcattagacatattatattaggatcaggttcaactgcgaataccaaatatgcacctgtagtgacttaacccagtagaaatattacgtccttctcctgccccacttaaaacctgtacagtggtgccacactgtccttccccagctccatagagctcgtggctcactgtggctccccacttaaaacctgcacagcgatgccacactgtccttccccagctccacagagcttatggctacgcttttcttagcctttcactttttccctcaagcctgctgcccttacaaacatgtctgcatcctatgcaggaagaagaaaagagtgaaagggaaaagagaacgccaactatgtaattttaaagagtttcccataaatctcagtcagtgctaattaatatcttattggccagaattggatcacaggccaccatagctgcaagaaagctgcaaaattgagatttttttttttaatgtacttagtattttagaacagttgtggctttacagaaagattgtgaaaatagtacagagagttttcgtatatcctgcatgtggtttttctctattattaacatcttacattagcatggctcacttatttcagtttatgaaccaatattgacacattgttaactattattgacaatactggcacagaattaactaaagtccatttcaggtttccttagtttttacctagtgtcctttttctgttccagaatccctggaatacaacatcacgttgagttgtcctgtctccttaggctgctcttggctgtgacagtttcttggacttgtttgttttgatgatcttaacagttttgaggagtactaatcaggttttttttaagatgtttctcaattgggatttgtcagatttgttttcatcattaacctgggcttatgagtttggggaaccaaaaccacagaggtaaaatgccatgtttgccacatcatatcaagtatacgtactgtccacatgacttatgctcatgttaccttgataacgtagctgaggtcatgcttgtcaagtttctccactgtcgaattcctcatttttctttcttttcttactatatcctttaaaaggaagtcactatggggaacccctgattaagaagtggggaattacagttcacttcccctaggtggaatatctacaaaaattatctggaagatttgtgccttctcccctatttatctattgattgattgattcagtcatttctgtcagtgtggactcatggatattaattttatacattgtgttacaattcagtaccactgtcttttcttgctcagattgtctcagctttggccattgggagttctttcagttggctttgacacatgcccataatttgagggtttaattcaaacataatttgagggttttttttttaacactttcttactttctggcactacacattgctccagactagtcttagatatttctacctccagtcctaaaatcagtcatttctccaagaagctcaggttccatttattggagtatggtattagaaaccaaggtcaggctgctggcccgcttgttgtttctgggatgtgctgaagtctgcgctttctcagctgacatagaatggacatatatgtgtatgtactaacctatgtatatacacatatttatgcatatttaaccatctgtaaatatattaagctaaacatgagttcataatgatgtctctgattttaatctgttcccacattgaccattatagcctcttccctttgcttattactccactccaccgtgagaaactggctcccaccattcttttatttaattgttgagttccaggatacatgtacagtgacatcagaatggttaacctgtacttacacttcttcctgtagaaagtaacttcatcaactagaacagtgcttatttacggttttttttttccctttagtctaacagacttctctcatttctaagtttacttttctccaatcccttcaataaaattgttttcatatgctttaacctagttaaaatgtttgttcacattcagcattgcatcctgagagtctcctacttcctcaataatattgtggtttttagtgtgcaaacatgaaaattcactctctgtgctgtgaggttgtttgggttttgacaagtgctttgtgtcatgtattcaccgtcattttggtatcatacagaatagttttatcaccctaagctatagttattcaaccttctctccaccccttaaactgtgttaactactgattttttttttatcatctctctagttttagtattttcagtatgtcatacagttgaaagcatatagtatgtagcctttccagagtggcttctttcacttagaaatgtgcatttaagatttattcctagtttttgtggattgttagctcatttctttctactgctgaatcattttctactgtatgcatgtaacccagtttgcttatctgttcatctatcgaagggcatcttggttgctatgaataaagctgctgtaaacatttatgtgaaagtttttatgtaggcatacattttcagaaccattgggtaaaaacctaagaatacaactgctagattgtataataaggctatgtttagctttgcaagaaattgccaaactgtctaagtggctgtatatactatgttgcattccaggcaggaatgagagtttatgtttttcatatcctcaccaacaattggtatattcagttatttattttagtcattttaatacgtgagaagtggtatctcacttttgttgtagtttgaattccctagtgacaaatgatgttgaacatctttatttggttatttgccatctgtagatcttctttggtgagttgtctgttcaagtattttgcctgctttttaagtgggtcatttgctttcttattgttgagttataaaagttttttctgtgttttggatacaaatcctttatcagctaacatgtttcccaaatattttcttcctttctgtggcttgtctctttatctcttaatagtgtcctacacaaagccgaagtctataattttaacaaagtagaacttaccaatttttctttcaaggacttttttgatattgtatctaaaaactcatcaccaaactaatataatacagattttcttctgtgctttcttctctaagttttatgtttcatatttggttttaagatacattttgagttgatttttgtgaaatatgtctgtgtctaggtgtctacttttttttttagcttattgatattcacttgttcctataccatttgttgaaaaaaaacattattttccattgaattgtctttgctcctttgtcagtaatcagttgactgtatttctgagggtcagtttctgggctctgtattttgttccattgatctgtcttttctttcgcaaataccgcgctgtcttgattgtagctttataataagtcttgaaattatatattatgagtcttctaacattgtttttcttgtcagtattgtgttgtctgttctgggtcttttgcctttccatgtgtactttagaaaatgtttgtcaatgtctaaaaatatatcacttgctgagattttgattaggattgcattgaatctgtagattagttgggaagaactggagtcttaacaatgttatgaccatgaacgtggatgttactcctttgagttcttccatcagagttttgtagttttctacataggaatactgtacatattttgttaaatttgtaccaaaacatgcaatttttttttggcttcagtaaatgttttttgttcttaaaattccaattatttattgctggtatgtaggaaagcatttgactggtaaccttttattaccttgttttactagcttattagctataggagtatgtgtagggtttgaggggttttggggactatttttggggatttttttacattgccagtgatgtcacctgtgaacaaaggaagttttacttttttcttcaaaatctgtatgagttttatttacttttcttgtcctattgaagtaggtgggacttctagcatagtgttgaatagtagttgtgagagtagacatccttgccttgttcccaatcttaaggggaaagcattcagttgctcacaattcaatatgttgcaggtttgctgtacatgttctttcttttcttgagacagagtctcgctctgtcacccaggctggagtgcatctaggtggcaccatctaggctcactgcaacctctgcctcccaggttcaagtaattctcatgcctcagcctgagtagctggcattacaggcgtgtatcaccacgcctggctaatttttgtcttttttcagtagagacggggtttcaccatgttggccatgctggtttcgaactcctgatctcaagtgatccacccatgttggcctcacaaagttctgggattacaggtgtgagccaccattcctgcccgatgttctttttcaacttgaggaaatttactgaaagttgttatgaatgaatgtcgccattggccgcatgctttttctgctctatttatatggtcacatgattttcctactttggccttgttgatgtggtgggttacattgattttctaatattaaatcaaccttatgtacctggaataaatcctacttggttatggtgtataattcttttagcacattatggaatggagtttgctaatagttttgaggatttttgtacctgtgttcatgagagatgctgatttctagttcttcactttagactgtctttatccacattggttatgaggaggccttgttcttgttccccctcagaccacatctcattctaaggaggtcacagagcatttgggctggtcacaaatctggcacctgttaatgcttttcctccccatctctggccagttgtagcctctgagggtgatttagtattttgagagatacttcctttgtcaggtcccaaccagtgctcaagaataggctggggacagtcacctctggcctccctggctggcccagactggtcccagcctctgatgagtaatgtagaaatactttgaacgaggcacttccaatgaccagccccacagattgggttaggaagtgttccctctgcttttattttttggacaagattatagagaactggtatcatttcattctttaatatttgacaaaattcattgaaaccatatggagttgatgctttcttttttggaagatcattaactattgattaaatttatttaatagacataagcccattcagattatttaattctctttgtgttggtcattatgaatcagaatcagtcacattcatgtaagttaaaaaatgtgtgagcttggagttgttcatagtatttcttcattattcttaaatgtccttgaggtcaaaaataatgaaatcctcttcctctctctctctctctttttttttttttttttttaatttttctgagacagagtcactctgtcacccaggctggagtgcagtggtgtgatcctggctcactgcaacctcagcctcttgggttcaagtgattgttgttgctcagcctcccaagtagctgggactataggcacacaccaccgtgcccagctaatttttgtatttttagtagagatggagttttgccatgttgaccaggctggtcttgaactcttggcctcaggtgatccacctgccttggcctcccaaagtgctgggattacaggcctgagccgtcacacccggccaaaaccctcttcatttctgatattggtgtttgggctttttttttctctttagcctgtctagaggtttatcaatttcatcagtcttttcaaagtccagctttgggttttgataatttgctatttttggaaaatgagtctttagctgcgtatttgctatcccagacacactgaagaaggaggaagctgatctgtaggcagccagcctgccagctgcagttcttcctggagggccttatccagatgaggtcatcatgctgtgtctgtattctctggggtagccacacttttctgtccttatgttttctcaggtttttgcttctgtggagccattcttgatagagccatctccttccttcctgacttgaagtcttatgatttacattagaaatacatgaatatgttgaattctacctcagaaaatgcctgtgtttacttaacctaagaatgttgttttattaccatgtggttgacacattattcaggaaagtatattttattgtctctctggtggaattttggcatatattttggcctctggctttgctcacagctgttctgagacagttttaaaatctctctgagcctcagtttccttgtcctgagataagcaagaaaaggcacacctcatagtgtgggagtgaagtttgggtgtaatcctggcatggcattatatagaagtcttgggtgcatgtggcttctccaaatatcacagtttcctactctgtgtattgaccagagattaactccagacttctatattgttgctagacgaactgcctaaatgccttaatttccttttgacagacacctgtttcatgtttgctttagttctttgcttgtgacttccttcttcctttttacaaaaatatagaacattgattttgtttctgaggtataaatatatgtgaataacagaatgttagagactatgatagatactgctaatttgactctcttggttacaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgtaagtgaaggtgtcagacaacagccttgttcatcagattgacttaatccagacttagcactggatattgtacccgcgtacgcttcctcaccttgttttggttcttgagtattctactttgtttcagcaaatatttattgagtgctaaagaagtacttaatactagaggtataaaaatggcctgatctttttcatcaaatagtttaaatctaaggtatggaagaggagtttgggtggtggggaggtgtaagactaaggttcaggagacatattttcaagcccttacaggaatttaatgtaacattcttgcatatttcactcctgaatacttcagtcatttaaaaaataattgcctgcgtataccaagatggtttccgccttaactgtttccttttaagctactctgctgagtatggattcttagtggaaattcttttcagtaaagaaaacaaaagttctctattttcaattagtgcaaatcagtttttcatttatcattcagcgattctttgatataattcatagactgacttaacgtaagagagaataataaccgtgaaagttgagggggaagggaattctttgatgtcctcatttaccataaatgaagaaaataagaagcaatggataggtgattcatattaataattgaaattgttaaagtaagtgtatgtgaaccattgtcaatgaaagggaagcagtaacaatgataaaatgcaagtatcagtaggttttcattgttttactttaggagagatctcttgctaggtgctctgtgcctctttgcatagtttctagaaggttgcaataatcccctgggcctcagacaacctcttcaacctcatctgtgtggccactggtaagatcaaagtctttgtcttggacatatttaagtttttgtaattccctgaacattctgtgtcatcttagtcttccagacctttgcttatactgcctcctcagcctagaatggtgttcttatgtttcatttgactgtctccttgtgtccttctacacgtaggtcaatcattgctagggaaatttagaggtggtaatagctaacctgttgagcattactacagttcttacatttctctctcccacctagcttgtgaacctctggaagggcaggaatggatagcttttatctctttatacttgggagagagtgcatactgggagcccactgaattatattttaacaaatcccgtaatagttttacaagtttgttattcagctgaggaaggatgtgtttcctctctttgaattcgttacagttaaatgtgttcctacttcctaataatcttaccagatgacaataataattatgcctcagctcttccataaatgctgagtctcctgaaagtatcagggactctaaaggagagtaaatcttaaattccttttaggtaggcccagtgtctgttcatttccactttggcttacattgatttcttaggtttagatttaatacagatgtggttggatgatgtagtagaaattgccaggcaggttgtgtgggaaacctggatcctataccccattttaccataaattttaatatcgggcaagatatttaactttttgggcttcataatccacttatttcagaaagaactattgccttcattacatgtattcatctttccattcaataaagattggatttctaccatgtgagccagacacacatgttgtctgtctcagcatgtatactctaattattagagtctggaaataaattatatagattaataaaactgaaaaattcttgaaaggttaaagtccaaaggaggaaaagcaaaagcaagagacattcaagacatttgggtttgctgcttgtacttttgattgttttatttattttttatttttgtaaatgataggaaaggcattaaaacaattgaattgagaagtattctgtaggattaatttactcccttttccatctgctaccaaagataatgggataatggccctgtagaagattacctgcgtttttccagaaccagacaaaggtttaagagctctaaaggaaaaagtcaaccttcattgtttgattcccacactcactcatgcctggcactcttccaggcactgactgttactgcagctgtgatttcaacacagagccagtgctctttctgtcacatggtagcgttgccttcaaataactgacggtcatatccgccagtgttgtaatttggctggaatgcagtatttgcaattttatcagcttcatacaattacaagtcttgcatacataaaacagctgtgtgctttccaggtgtgctttgggtggtatagtgggacaccaaaggaaaagaaataccatcatgagtgcacctccttccccgagttgaaattatcatcatgaagggttcagattacaaacgttatagctttcccacttaatttagcatctattattcctggcagtgccttttaagattactagtcaagagaaaagattttcctcatttagcttagcattttgtgagctgccttggcacagttatagtaaaagcttcagtggctttttcagtatagtaaaagcttcactgtatataacaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctcaaaaaaaaaaaaaaaaaaaagaaaaatcgtttctttgtttcttggattttagatagggtgggtgtattataagatacccaacttagaaaaccaaggagcttgtaacacaaataaatggttattcattcatgcatcaaatgggaaagttggccatctttgaatatactaaaattattacatggaactagaacatcttaaattagattctaaattccatgagggtaggcactctccccctgcctccccttcctcccacccaccacacttcacctttttattcccaataactagtatataatgtctggcacatagtaggtctttagtaaatatttactgaatgaatgaatgaatggtcacaagatggtttttaaaaattgtctcctgcagagaacccaccacagatgccttctgtgtgatttttcagttttattcacatagcaatttttatgtaacatagtatttagtatatagctatgtagaacaatcataatatgtccagttttcaaaagattattaacttctaaggaaaaattctttatctctaggttaatctctggctactagctcagtttttggcacattgtaagcacttagtaaatgttcgttggactgaaccaaccctatacagagacttgataacattgttcagatgaagattaccattgattttttctaagttcctggtaaaagcatgtgatgggaagaaatatgatagtatttgagaaaataactttcctaagttactgttgtcttctagcactggacgggtagtcacaggttacaaatgaataagattaattttgttagctcctgaaggaaacagaaaaacctactgtaaatctcatctcagtataaaaaggggctttaaagaaggatgtaatatttgatgagaaactgctctccacaaggcactttgatatatgtcacgttttccttataaccacctactatgatctctactgtacaaatgagaatttaaggtcagggaagttaagtgccttgcccaaagtcacaggactggtaaagaaggagcagattcaggattcaaagttcaaggcctatgttctgtcttgaaaaaccagtgctttaaaaaacaaaaccaaaaaaaaaacagtgttccactagccgaggttataaataaaatctcttcatctttggagaaagtgtaacagatgctgcatgttcccttcatcagaaatgccataaaagggattataggacactgaattaaataacctctgtgttccttgcaattcactaattccctggttttaagctacccgaagtaggtaaatggaaatgaactgttaggaagaaagggatgatgtttggattaaaaaaatgaacaaagcgctactaatacatttattggcaaaaataagaataacactttcatttaagaatttctcaacatctgtacctctgaaaagggcttgtcatttctttggaactcagaaacgtaatttttaaaaatctccttggaatatatccagtgataaaggtttgatttctatacaatgtgtttggctatatcaaaccaactcagtttacttttcatcaactttcatttaaaatttactatctgaggccattatttccagaataaaagatgaaaaaagatcacatcagtggtttacttaaacaaaatgaggaaaattctattttttaaaatcctgccacaatagctgcatttttcagaaagtatgcatttcaatctttaaagatactcagtgattttcagattatgtgtactgcaagtattctgatatagttttaggcccaagaaaaatttagtcaacggtatctgttctagttctttttaaatacttatattatgcccattttagaaaacgtactgttagccaaagtgagaaaacttgacaatgcgcaggtatttccttgtaaaatgtgcctattgaaattcgtctgatatttctcaaggtgagttggtgaagatattggatcatttatactgtcatctgagccaactgttcttcatcggagtcactgtaacaaaatattccctgagtgtgtatcattgagatgaacatctgttagcaaatacatctatttgactttgtgattattattacgggagtacgtatgacacagccatttgagtaggatagtctagccattggtaacaccaaatccatctctcagtaattctccttttcagaataactctcaaacaagataatttaatgtggttagcttttttccaaaatgaagaaaacagatagtggatgttttttcagttatttaagtataaatttgggaccttccgctctacttttaacttagtaaaattagatataattacagtaactcctcatctctttttggagaacaagaagtgccttttttccaaaatgacattgatttattatttatgtccaaataattaaataactgacaaattaattaggataacccagtacacattcaatgagagcactttaataatttaaaatgctggtgtaattacacaggaaagcatgcctgatgtgtcctggcgagcccaatttatgaatttctaaagtgaaaccattttttataaattgttttagggtcaacatgcaaagaaaacacacaatctgaataaatcagcatcccccctaacactcagtatggtagttttatctattatctctgtaagatctttttcatttccattacttcacctaaacacttgcatgttattagctactgaaaggaaaactgtttcctctttactgctgctctcaatacgtcacttttgcactgtatgtataggttgtgttcgttctctgcagacatcgactgtgtgtcctgcagtttaattctgacgccatttaccaggagttagcacagaccctacagttaaaggcttagtcccacttgaggtgccagttgcaactggtgggcccccaggttacccacaacttgtgtcagacttggatggaaattggaaattcccacaacccctttcttatgtttgataatttgttagaacggctcagaactcaggaaagtagtgtacttactactgctaatttgttatgaaaggatacaggtcaggatcagtcagatggaagagacacatagggcaaggtgttggggagggcattccacaccctctccaggcagccaccctcgcgcggcacctctgtgtcctcacccagcctgcaggcgctccaaaccccttcagctggagtttttaatggaggcatcactacatagacgtacttgattaaataattggccattagcgattgactcaatctccagccccctcccctccttggaggtcaaaggtgggacagcaagtttcaaccctttaatcacagggatggttcccttgacagccagccacctctcctctttccttaggggctttctggaagtcatcttattgatgtaaactcttctgtgatggaaaggggctttatgaataacaaaacgccctcctttcacttttattgctcttatcacttagagaattccaggggttttaggagctgtgagccaggagctgtggaagacaatcaagctatacatttcttactatatcatagtatcaaaactaccaaatctaaatttctaactctggtgtcatctgttcacggtcccctctccctgaatgccctataagcactttgaaagctgtgatatagaccaacacaaagggcctcattcttccccagagtttcttgttaagatgaatggcactaccatataaccagactcccaagttctaattctttcatcttccttctctgtattcaaatagctaccaagtcttttcacttgttcctcatgaatagctgtttgatttcaagctcatctacattgccgttggttttgttatgatgctatttttgtgcactattttattcccagcacctaacatatagtagtcacttaataaatactggtagtttggatggatggatgcacaacagacagaggttgccatagcctcctcagttgcacctttgcttgtagtcttgctccagctcgttcctttccttaaataatgtattcttcatactacttccagtgtactttctaatatctaacatcggatatgctactgccctccacctccccccataaggaagagagctagttgaaaattctagaaggatcttagtctcttcaggataaagttgagactcctctgcattgtgtttaagggccttcctgagacctttcatcctcctgttgactaacccgactgtcattttgcattcagtctatcccaattgccgtcccttaaacatagcaggaactgtaaactgttttcccgagctcttggctccctttgaatgtgctttcttattttgtccatgccaactctgtttactatttatagctttagatcatggagccttctggacctaatcaagcatagttagcagcatcttccatgtccctttaacaaattatacccacctctatgtttacttacttgtccttgtcctcagtagactgcgggatcctttagggaatgaactatgtctttgttttatcgtagtatacccagtctcacagaacctgacattttggagatactaagtaaatatgcggaggatggacaacatgacctttgtcaacgccaactaattctgtgtcgtgccatgtgttatgtatacttttcagcacacttagtgcaataaaattgagtatcttaaacaagttttagcaaacataacatggtccacttagtgaactaataagtatgaaagacaatgcaatttaatataaagattattattctgagaggcaaaatacagtcaagtatcccttaacaaaggagatacatcctgagaaatgcatcattaggcgatttcatcattgtgtgaacaccatagagtgttcttagacaaacttagatggtagagcccactaccgcctaggctatatgcttttaggtaacaaacctgtacagcatgttactgtactgaatactgtagacagttgtaacacaatggggcatctgtgtctgtaaacgtgtctaaacatagaaaagatacagtaaaaatgtggtattaaaatcttacggctccactgtcctatatgtggtccatagtgaccaaaatgtcattatgtggtatgtggctgtacttggtttctaacctcctttctcttcagagtgaccatctgttgtgtttttatgcagactatttaacctttctgggcccgaattttcttttaacctgcaaaatagtggtgatgatacataggtagcaggttagtctaaatgacgttcttaacctctttccaacttaaaaagtctgcagcggtttgagtatgtttgtcaaaatttggtttccactctcaccctaaagatggtttttgaaataaaaaattgtgttttcatcaaatagaaacctttaattgaaaagtaagttacagaataaacaaatacatgttttaatgatggtagaaacaagctaaaaatgagtagttgtgagccttttgaattctaaaacatcttgaaaaatgttttacaaaatgagatttaaaaaatacagacttgccatcccttaagatgtgtaaactaaaattgccttagggattctaatcatactattctctaaatcatttaattatgattgcatcagctctctattcataggaagtacttattcactaatatctcttgatatctcaatgttgtgtaatcaattctaagcatttgaggctgagctgatggcttaatcacctttaaaggtaagtatggtagggcattttaaatgtagtcatacaagctcataagaatacaaaaactcctttcttcagcagatattttttattctttgattatctaactataagatgtttgttgaacagagtgtggaatcatccttaaatcatctcctgaggcttggtagtgcctacttaagagaggcactaggtaccttttcaaagtcacacagtctattagggtagagctagaatttaaagcccagcgttctggctctagagcccatgctccagcaccctgtcaatgtattctaatggagaagctaacaaataaatgggaaaaaatatttaatctctttggacataaaagttattatacagaattttgagcaagtgatactaaggaataattggttttaccaatccttctgcaactactgcaggatgtgttatttcctcataggacagctacctttggttaacttaatccaggtttaaagagtcaaagagatagttttgaataggagcagaaatataaacctcctgttgtacgagcaggcctcccttgtctgtgtgttctccagcttcatgactcactaaggctgtgtaagatgaaagttgtcttgaagaaaacactgttgctaccataaatggtgccctcatctgtacatgggaatagagggaccactgttttctctttgtgataagaataaactcttctgaaattttgatgactaggaacatcaatgaaggcctttaagggaaacgaaatgtattttttagtatacatgttgttatttaatgtggattttatttaaggactcagtgaagtcatccttctcacttttttgagaaagctagagctcacctgaagctttaattgtgactagtttggggatttttatagagacgggagttgtactgacggcaaatttccccaatgcagtgactactcacataatttttgacagttaactaatctcaaaactgcttcaattatcttgttttccatagtgagaaatttaattaaaacagagtacagattgtgaaaaggttatttatgaaaatgcattttaaatgtgaattgaaaagcctagggacacctttttattttagataaaaagatgaaggttctataatttttcatattcattttaccagaagccagggtaagagcagtaggcaatttatttgaaatgtcttatcaggagcctcacaaatcaatcttttgcctaaattgcttgaaaggttgacttattttaggaatgtaagactttaggaaataagttcagatttaaaatatatgagtatggaagttttttttttggtttttggttttttttcttcctacgttaaaacaacaacaaaacaccttatcaaggaagtggaaagctctaaaatgaaaatgtcattaaggcatggaaagcaagttgtgctgtcataattaggcttgcccgtccaagttagttgagctataatggttttatgtgagctgatgtgacagatgtaacatatccctcaggtgatttagggctgaggcagggaaaggaacttgtgaaccactggattattcctttgttataatggactatctgcaagaacctgccatgtttgttttacagttttcaaccagcattcatagaacacggtctctgcctttaagtagataagagtctaagaaggaacataatgttggggaggaaaagtaattttctgtctaccctctgagttcttagctggaatgtacccaaaggaaaaaagttttttgacatgcatattttatatatatgggagagatacccagggaattagtaaatctcaaagagggggcttcgaactctggtttatatagcatcttccataaggaacagtaaatttttgcagaaatgactagatagtctctagggagagcaaattctggaaaggcaaataaatggaagtttgttatgtagattcctctgttgccatctcaggctaataagggtccaaagttatcttggtgggcctcggtgtctcactcctgtaatcccagcactttgggaggccggagttggaggtttgcttgaggccaggagttcaagaccaggctgggcagcatattgagaccccgtctctgcaaaattaaaataaatttaagaaaataaacttgtgttcagtgatcaaccttggtccctcctggtagataggggaggagggaaacctttgcctttataaatttatgtcttgctttgatgcagatataagagggcagagagggcagagagctttttaaatctgctgattctcaattagcttcagctcaaaataatctttatgctaaagtggcatattttgggttggcatgcctgatctcctggagtagttgtcacccccactttgaattctttcatatttacttgtttattttaggtggtcaatctgttatttggatccacaagtatacatcttatttaaggtacttatcttagagtaatgtaagtacttttatttttcttattactctccattatactttaagttgttagtggtaggtaggagctatgtcttttgatctacaggacccagtatattttggttgagacagggtcttgttctgtcacccaggctggagtgcagtggtacagttagaactcactgcagtctcaacatcctggactcaagcgatcctcctgcctcaccattctgagtagctggcaccacatgtgtgtgccactttgcccggctaatttttttattttttatagagacaaggtctcactttgttacccagaatggtctcagactcctggcctcaagcaaccctcctgcctcggcttccacaagtgctgggattacaggtgtgagccactgtgcccagcctggatttcctgatgcagagacgaaacacagttaaccttgagaattagaacacctataattgacttatgtacaaagaatagggaggaacaaacaggaaagtacaactgcttgatggaatgtggtaagactttagaggagacaacatttaaaccaaacaggaagggaatgagtagcactcaggtaggaggaaccaagaggactctgcgcagactcgatgtgatatttaaaggcatggacacagggaggatcttagtgtgctgcagtcagccagaagaattttggtgatgtccattattgatgaggtttattgtcatctttatacatttttattctattcattttgtttataggtagaatagagcatgaggtacataacaggatgtggaatcaggactatagtggttaaaagtaaataaaattaaaaagcaattttaaaatagaactacattgttgggttgggtgacagaagtggaaggccagttggccatctcgatatgttcttatagtgtggcattatcctggagggttcactacagtacagggtctggccctcaattttatagggccagacagtatatcataggggttaaaagcaaagttgggagccaaactgactttcgaatccttgccctgtctttaattgctatgtgaccttactcaaattgctcaactgttctgtgcctcagttcctaattcaaagctggaaatactagggcttatcacatgagattgttaagttataaagatgaggtaagttgccatgtggaaagtacttgatacctgacacattaaaggtgataaataatttgtttttggctcaaaaatctaattcttcagtttaccaatgtagctcaatctttcagagcatactcttgctgtatattggacattaatatataaaaattgtaatatccagtactattcacatgtgctagaatgactaaaattaaaaaggtattttgaattgtggactgggatgtggcacaataggaactctgatgcactgctgtgggaatgtacactgctccagccactttggaaaaatgtctgacacatttggctgtctgttatgagcacaggcctccccaggacctagcagtgggtaattcctcagcagagatgcacacttagatgcactggaagacgtgtgtaagaatcctgtaggcaaaacctaaaagaagcaaaatgtctatcaatagtagaatggatgaacaaattatagtataatcattcagtattttaaagcagtaagaataaaccaattgttgctacacacagcattgatgaatctcacaaacataatacttaatgaaagaagaatggcacagaatagtagatattctgatttcatttatataaagctcaaagccggcaaaactcattgatggtgctgagagtcaggatggtggttacttttggggcaagacggtgattcagagggaacaaaggcagcttctggcaactgttgatgtcccatttcttgatctgagcattggttacttttttactcctgctgtgtggcttggttgtattcacttggtgagaattcactaagctgtgtacttaggattcgtacctttttatgacttattttatgcttgaataaaaagtttaaaaatatgaccaatttgtgaattaagagaattgattagactaaatagaccagatgctctcatttataacagaataacacatcttccttcaagcagatctgttattagactacgcgataatctgaaggttactcagtaagtctaaaagcagatcagagaataatcttaatgcaaatattttaaaactctgatagcttgttcttaacattttccctgtatagaagcctctgcactgtgaattacatgtgccttctggtgggccagtagccatttccccttcacagtgggactaaagacacttggcatctctcatctggcacatcattccaagaggggctgttgttctcaaggaagagcacttggaagaatgaatgaatccatataaatccatgactgattgaacgctcaccctgtgccaggcactgggaacacagtggtcgacaggcagatgaagcccttgttcttgtggagactccatttctattggaagacatggacaataaataatacatattgggtattgatgaaagtcagcttccagactcttgctgagcatgactacaaaaggtgaaagaaacagtcaacaaataaaccaaaaaatctttgaaggcgtgaaagctaaaatggttaaaaaaataataataactgggccaacagcttgggggaaaatgaaaatgaaaggcaattttcctctgaatcacagagaatgaaaaatgactcatgtgactatttcctcaactgtcctaagaatggtacatagctagtatcattctagatacaaaggaaagacattaattcatgttatacacagtggatgtcttaggacatcaggtttcattctctggtggaaccctggtgagaaagactgcaatgagcttctgccaatttctaaagaaggtaggtgagaatgtgaactgagtcttaaaagaaatctagagcccagagaagttttaaaaaatgggccttaagggtccacccagcttaggtgaagggactgataaatccccttggctgtggaatggatcccagagaagctatacttccagagaatgcactgatggtcagcttccaatcatagcagtcctttgtgggactaaggttaacctagacttactaattcccctatcctggagaaatatagcaacatagtcctgaaattatttttttcatgtgtaattgctgatattcaataaaaaaaattacagacatacaagaaggtactataataaactaaggaaaagtacagaagcagacacagtggattcagatagcaaacattatactcaattataataaaggaattaaaaaataaatgtgatgatttaaacagaactggaatgtatagaaaaacagacattttgtaactgaaaagaactaaatggatgggttcagtagcagattagacagagctggagaaagaactagtacgctggaagttagatcagcgaagcgtgaagagaagagactggaccacatggaaaggaccctgagcacaaagtctctcatgtccaccttgctcatttaaggcccagaggttccacatggtctcgtccctgcacctctctcccagctcacttcacttttacttcttgtcttactctattcctgctgctataataaaattataatattaataaactataataattagatgtaattagatattttagatggataatttataaaagaaatgtattctcacatttttggaggctgtgcagtccaagatcaagacacctacagattaagtggtgaagacttgctctctgattcatagatggtgcctcttgcagtgtccccacagggcagaagggcaaaatggatggcagggactggagggccaggcagctctctgaagcctgtcacgaaggcattaaaccagttcacgagagcctgcatgtcttaagcacttcgcaagaggcccaacttcttaattccaccacaatggacattaagtttcaacataaatgttggaagtatacaaacatgcaaaccacagcacccctctacctcatggcctttatgcttgctgttcattctatctgaaattctctcccccctagtcccctaaaatccatgtgaccagctccctcacggctttcacatttgtattcaaagtcttgtctgtaaggatttccctggccatagtgtctaaaatctcaaacctccccaacactctcattatcttatataccatatattttgcttggttttgtttctctgcttccccatgaggacaaagatacttgttttgttttgtttgtgttgaatgctatgtccccggtgctcagcacagtgcctgacacctagttggcattcaacaacatctgcttcccaggatagatggaaagatgtccataaaaatctgtagcatgatgcaaggttaatatggacccaatgaaatttagttattcctcctttttcctatctttgtggaatttctggtttaatttcattttctttaattttttaatttacagttagttttcccttcacttgtttgtaggatttctgacttaacttcattgttattttgtttttctttcagtgtatttttcagcaccttgacaaattaaacaaatgaaattctacctcagttggatatgaactaagagaagagatcctatgaatgattgacacagacatattttaaaaggctgtattcagatgtggatagaatagcagctaatctttgtcagtcattacctaaaaaccaaagtagttaatacaaggattgcagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaatcactcttttgtaaattcatctgttcacttaaaatgatttttcctgagtttaaatgtgagtttacttgtaacagaaatagaattaaataggtcatactgtttcctttatcctggaaaatctcttctttttaaagcaagatttctctgttgtttggccacgtgtcggtttgagttttataggtcgggaatgacaaatgaagaatctccacctgtgtaagaacacatcttcccttcctgtagcctggcatccgccaagcagacagctcacccctgccagctcggtgccgtttcgaagctaaaaagtcagacttgatgaataagcaagtctttttaatgaggcaaacattatttatgtttataataactaatttctcatccatgtttgttcagtttttaataatgttctgatatcaaaagtagaatacagagttccacaggcagttttctgctgagggcagggaatctaagactgatacttaatgtttgacagaaaatgatataggtgagttcttgtcatcaaattttacagtattgtaatacagactgcattttattatacagtatttcctcaagttgcattcttctcaaagaagcacttaactacatttcctgccacttgtcattaattagttcttttcatcatttattcaacaaacatgaccacatgcctcctatgtgctagacactgggaatacaagagaaagggcctgctttttacccttaaggaccttacagactagtgagaggagaggaggcaaagaaataattacagaagctatgaatatacaagttattggttatcatggacgcaggaaggagagagggataattcagcctggagtcttcttgttggctcaccaaaaaggtgatgtcagaggaaacagcctgtgcggaggaattgcgggtgaaatgacacagctgctgcagggccgtcacgcaggtgctgaagcacacagcaccaagcagcagtggcaggcacctccctcacagcaccaggcagcagtggcaggcacctccctcacagcaccaggcagcagtggcaggcacctccctcacagcaccaggcagcagtggcaggcacctccctcacagcaccaggcagcagtggcaggcacctccctgggtgagttgctgagggcagaactgtgagaggcttaggaatttgttctttatcttgtatctttatttattggttaatcttcccctattgttctcaggacagaggagtgcagagtggagattttaagcagggagggaaggggtacaagtgaggatttgcattctaggtgtataatttttggaggaatgtttagataaggaagcattagaaatccaggatcagttacggtctctgactagtccagttgaagaattctgaatgattctgatgaatctaataattctgaatgaaatgattcacattaggaatgtagaggaagcggggatgggtgtgagatagatttagggagattaaaaatagactcattggctagttagatgacaatgggatggtaaagcagaaagcactgatttttctccagatgttaatgccttcctaggtgtgtgtggactgatggattctcaccacagtattagagacctcttgtatctcctgcactgccttgctcacaagtgcacggtctgatttttaaagtgcaagaaaagggataaaacatctttgcagtacattttgacaacatagggatgcgttatatatgtatttgagataaggtcctcctctgtcatccagactggaatgcagtggcctggtcttggccctgcacagccttggtctgcagcctccgcctcccgggttcaagcagtccttccaacacagcctctcgagtagctgggaatacaggtgcccaccaccatgcctggctaagttttgtatttttttagtagagaccagatttctccgtgttgcctaggctgggtctcaaactcctgggctcaaaacagtctgcccacctcagccttccaaagtgctaggattagtaaaggagctttatttagcttcttccaaaggaaattccttaggttgcttgtgactttatactgccaggtttcctcacttttgatcatctgatgaatggctagaggctctggagatacatgaaccagctgaggaaaattcaggaaagaggtgagaggactaaacagagaaggatttggcctgctttgcctctagaggcattcagtccagcaatgtaatgaacatcttttaagtcctcattatgttccaggcactgttgctactctgtgcctggtgtgatagtgtgaaagaatgaataagacacaatccatattcagaaaggtaggtgaagcaaaaagcaaagcatattgtatgcagcccagtaatggaagtacatatattaggtccattgttggcataacaaaggtgtcatggacggttttcatgggactcagaagttataacagaattggaagctctcatttgagcttcaccttgaaaaattcactagacagagcaggccagagacttgcaggaaacagcacatgaactagaaatagtcattgcatgggaggcacaggacacattgcagaaaaatgagtctgacatgtagactggggcttgtcacaatggggtcctctaggagcaaatatggaaatgtgaaaaattacccaaaaatttcaaatataaagtaaacctttcagcatatctgagcagtgccagcactgaagtgtagtgagttcctcatcccaggtcttggcaagctttttaagagtagattctaagcttagatgtttgcttgatctaaatctttgacatccccttctatactttgattccactcaattatctgttgcgttatagcaaataatacattcactattttttaaatttctatcttagcctcagaaacatctactgaagaattttataatataaaactatgtaaatgagaaaaaacgagcaaccagtgattcagaacactagaagataagagcatgagggaaaaaagggaggcctgctaaacgctcagatcacccagtcctcagataaaaaaatcttaaggtttggaggctcttactcagctccactactctctccttttcctcgttttaatcatttgctgagtcatttgtttattggttaatcccccttcactgttgttctcagccagtgacctcatcccctaccttgtgataaaaatagtagatgttcaacaagaattccctgtgctccctacctggaaccttagacactgatttgcagtcacactcagcttttcctccttttctcctattgcaccctgcttcatgcttccctatatgtttcaagcgttgtccactgaacaaataatactcgtcataatggaagtacaaaatattcaccaccatggccaaatcgaactgtgaaattgaaatcctcctgaatgaaatcttgtgaaaattgcaaatttaatctcttaaaatcttcagtataaaaatatcgaagtcaataactcaaagacctaaacaatttgaaaattcagataaattgctagtattgtaatatctgacagaataattgagtaaggaatgagtgtcataactgtagggttaaaacagtatactgcttaatattttagttttttttttataattctagtcatttacaatcttgattcttcaaataagcacagaaatagaattctttgaagaagcatattcttttcaagctaacattactaaagtaaccatgatctttgcattttgcccaactgtgtgcacgatacagtgacctggttgcaagtctcaacttcatcttcaccctttctgtttcgtgccctcacaccaagagatatttcataaacacaacatgaatgatgtcatccaaatttaaatccttattccttaacttggtccttcatgagctagtgtataattttctgggtctcctcttccatttgcaccatacagaggaaccataacaagctatttgattccttgaatgagcttagttcttgtcttcctgtacctccattgtttttcacctgctgttcattctgcctaattttaatttttaatgactattttaatggaaacttctactttctgtgctttgaagctaatttctagcattgatacacctgggaaattttcttccacttttctctttcctaactgggctggtccatcccacctcagtgcttacccttgacatggcaattgacttgtagaattatagttgtctctttagttgtctgtcagctgtctcccactacacctcatgtcatcctacttactagactcctttccaaccatggtgtctagcagagtgccagaaatggcataggtgctaagtgatgaagatttaatttaataggaattttccttccattaggagcctccagcttcttttaattcataagaattatttgtaatgtctgcattttgctacttacctgataaccaaaatcatctcaaagtatttgtttgttgtctgatagctttctctcccttgattgactattggaagatcatactcaaattagtaatctgccttcagctactatgaagaacactgtggcttgcaaattgtgttatagtcatattcatgacttctgttattcctctgcccccatttaatgactatcattttatattatacattctcatcaaagtacaaaacatatagctctttgacaaatattcagttgctcttttctaaaaaaatttttttaaatattagtgatcatatataaattatgtcttactcctacaaagacagcaccatcccttcatattaatatttattttacaaagttgaaagctttatagtagcacactattttgattactgtagctttatagtaaattctgacttgggaagacttatggtctatcctgaagaatgtttcatgcgcagtggagaagaatgtgtattcggttctttttgagtagtgtgctctatagatgtcgattaggtgtaattgatttgtattgttgttcaaatgtttttttttcttttttgaccttctttctaggtattctacttattactgaaagtgtgttgatgaagtacccaactattattgttgaattgtctatttctccctttaattctggtagttttgcttcatgtattttgaagctctattgttacatatattttttatatatgcatacatgtttataattattttaccttcttgatggattgatctttttatcattttttaaaatgtcatttttctctaataatttttgtcttaaagtctcttttgcctaatgttagtattatagctactctagtactcttttagttactattttcatggaatatcttcttccatacttttcctttcaacctgtttttatgtttgaacctaaagtgtgtctcttgtagacagcatgtggttggatcatttttcccataatgctaatttcttccttttaataggtgtgtttaatccatttacacttaatgtaattactgataatgtaggatttatgcctgccatcttgccatttgttttctacatattttaggtcttttttgtaccttacttccttcttttgtgttaaatgttttttttttcactgcactgctttatttgttgtttctttttctacatttttatttttaaattacttatattgctttctcagaattaaaccaacacaaaaatgctttttaatagctccattctctccactcatttttgtcttattactgtcatacaaattacatctttgtacattgcatacccatcaacatagatttataattatttctttgtgtatttgtcctttaaatcagatagaaggaaaagagttacaaataaaaaaaaagcttatattatcttttatatttacctaaggatttaccagtgttctttgttttttttaatgtggattcaaatgacctttgtcttaacttctccttcatttttgaaggatagttttgctggatggagaaattttagttgacagtctttttttttttcttaagaacttgttaatatggcttcctattgtcttctggcctttatagtttttgttagaaatcagctgctaatattataaaaatctcttgcatgtgataagttgcttctctcattctactttcaagattctgtctttgtctttcagcagtttgacaataaccatgtctacatttgagtctctgagtttatcctttttggagattattgagcttcttggatgtgtagattacagtttttcattaaattttggaagttttcagccatcgtttctcaaaataatctctattcctttctattttttcctttgggtctgtcagtatttatatgctcatgtattttcatacatttgatgctgtcccataggtctctgatactctgttcattcatctttttttctcttcctcagaccggattttctccactcatccatcttcaagttgactgagttttttcttcatcctagttctatctgctgatgagcttctcaaatgaatattttactttagttattatacttcgcaacttaataatttattttggttcttttttatgttttctatatctatattaatattctttgtttgatgagacactgttcttatactttagttggttagaaagggtattgtttgattccttgactacacaactatcccctgtgtataccaaaatccacacataatcaagtttcataatcagccctgcagaacatacatatttgaaaagttggttctccatatatatgagtttcacattctatgaatactgtatttttttagttgaaaaaaatctgcagtaagtgaacccacacaattcaaatatgtgttgttcaagtgtcaactgtattgaaaataaccaaattaaagtctttgtctagtaagtccaatgtctcagcttcctcaaggactgtttctattgactgctttttttcttgtgtagggacatacttttgtgagtttttttgcgtgtctcagttttttgttgttgttgtttaaaactgaacatttaatgtgtaaactctggaaatcaattttttccatggtttcttgtttttgttgtttagtgacttttctaaactaatcttataaagtctctatttcttgtgcattgctattgaagtctcctctgtgttagtttactagtcagctaatgattgggcagagattttagtaaatgcctagaaactttctaatctttgccaagggcctctgggtgcctattgggactcatgcttaacctcaaggtcaaccagaagagagagctcagagccctctcaggtcttttctgggcatggatatggcactgtgcatggtcccggccttctagattgccaggaataattcagagctttacaagacctgttttggacacctcattccccacttttcttttgaagatttttgattagcccattgtttgttcagtttttcttcactacctcaggcagcagaaatgtcaaacaattgcctttaagtattttcttcagataccctgaggaaaaaggcattttgcaaggggtgaagtctgagtcaggtcaaatgaagacagttctctaggaatggcgttttgtcagaactccagccttattctgccccctccagcagcatccagactcctggtgattgtggctgttggttttcaaggttccttcagagctggggagtggggcatgggaataagacaagttagaatagcgcaaagctcactgttcttaccaggattcagccatttaaaaaaaagaaaaaagacaatgttttctagagctctgcaatcttttggttaatttccagggttctgaaaatggtgattctgaccatttttaccaattgctctttgcttttgtagagagaatgtgtggaagttcttcaccattttcactcctatatttttctttacactataagtagacatataattaaatgctagctgaattaatggaaattcactaaaagcagaatgcttctttctttttagaaacttctctgaatgtttttgtacttctcctgttatgttttaggactatgatgatggatatggcactgcttatgatgaacagagttatgattcctatgataacagctatagcaccccagcccaaaggtaagagtcagtctttattaccagaccccacaacagaaaccatccccttccacattcatatattctgggaaaagtatggcagtcagctagagagggtaattggcttgccctgtttttgtatttgtttaaatggagaagccctgtctgttctagcaaccagcatgtattaccctacccaagtttactataatgttaaagaaatcagggaaataaaaactgaaattttagtctaaaaattcaacttaaatgttcagtatattttgagaaggaacaatggcctcaaagtctgtgactatttagtcttaaggcccaaaattacattggaaatgtgtaagtatcctacattgtcagtgcctggagaagaaagtgtcaaaagttttgtttcctattcatagaacatttcaatttctaagtagcagcctctcctgttttctatcaacttcaaactcctacctgtgaataatgacttagttgtgatttattttccaaagaaatatttacccacaaataattaaatgttaccagaggcaaaacagagcttcatacttacctcttctgataatattaccttgatgttcattgatacatgaacttagtgtttcttatgttgagaatgttttcctaaatatgtggaaaccttttgttttatgtttaaaattctaagtggaagacaaaggtagatatacacataaaacaaaatattggctttgtagtgattctgaagcataagaaaatatggactatgaggtgattttgatgaaacacaaattcacttttgaactcgtccagtgccagtcaagctttgcacacataggttctctttatttgttaactctggtactgaggtagatagggatataaaaaaaactttttgtttttgctcataccaaattttattcttctataacttgtaagttttgagtagccttcaaactttgactctcaactggtctttgttggtggaagcctgtatatcgtgtttgtgccctttggtgtgttgagggtagacctaacacttacggagcccagtgactggcatgtggtgaatgcttgataagactttgtatacaccgtctcatttaggtatcccagcaactttatgaagtatatgctattgttttcattgtatacatgaagaaaaggagcacaaaattaagtaatttgccagaaattgcacagaaagtgaaaagatgaaattctaagtcagatattctaactcaaagatatgtaccctttataaataagtccttctcagattttgtttaaaaacataaatatccacaaatatttcagtatgtagtctaaatatcctagcaaagcaagtctcccatccccacagcatttgctgagtgcatactatattcctggcactgtttccataagttctgtaaggccttacagtgtaggttgtctgaacacatcaatcctgacaacagtactataaagctgatggtattgctgtagatgaggagatcacataaccaagagattctggcacttgcttgtgaccgaacagctgataaaatggtaacaggtgtgtgactgtcaagtgcatattcttaatcctggtacatttgtgtgagaggctcactgcacatttctgttagttctgttcccgtgatctgttatgggatgtatatacagttatgtgtcatttaacgactgggatatgatctgagaaatgtgtccttaggcaattttgtcattgtgtgaacatcatagagtgtacttacacacctacatgatacagcctgctacacatctgggctgtatggtctacctgaacagcatgttactatactgaatactgcaggcagtggacacacaatggtatttctgtatctaaacatgtataaacagaaaaacttcagtaaaaatgtggtataaaagataaaaagtggtatacccatacaggtcacttaccatgaatgcagctcgaaggactggaagttgctcttgggtgagtcagtgagtgagtggtgagtgaatgtgaaggcctaggacattaccgcgcaccactgcaggctttataaacactaaacgcttaggctacactcaatttattaaaaagccttcttctttcttcaatagtaaattaaccttagccctctgtaacttctttacgttataaacttgtagtttttattaatttttgactcttgtaataatacttagcttaaaacacaaatacattgtacagctgtacaaatacatttcttcatatccttattctatatacttttatctattttaattttttttttttttactttgtaaatttttttttcccctctgtcacccaggctggaatgcagtggcgtgatctcagctcactgcaacctcctccttccaggtttaaggaattcttgtgcctcaacctccggagtagctgagattacaggcatgtgccaccatgcttggctgatttttgtatttatagtagagatggggtttcgccatgttgctcaggctggtcttgaacccctgggctcaagcagtgtgcccaccttggcctccaaaagagctgggattacaggtgtgagccaccacaccgggcctacctttttgaaaattaaaaacaaagacataaatacacacatttgcatagacctacacaggctcaggatctttgagatgtcataggtgacaggaatttctcagcaccattatgatatcttagcgccaccgctgtacctgcagtctgttgttgactgagacgtcgttatgcagcacgtgactctattccgtgtgttggactttcaaatgcaagcatgttttttggcttgaacagtatcacaatatagtgatgtttatggttcgattcattctgtggagaaaagagaagcgacttaatatttattgagtttttaatgtgtttcagatactatgctaaatgctttttgtatttgatttcagtagatcttcacaggcatcaacccagtcctatacaataaatagagtttcctccagttaatagatgtagaaaccaagatgtaactttttttatgaagtatatttacaatacaagattatagtccatgtgatcttctggtttttgatatttgatataaagaaccaaacttaaagcatttgccctattaaatgctgtgatctgtcaaggagagtgatgtcaaaatgtgactgcaggtaaactgatagatcactaaggggagctagcatttacttagagcctgctctaaatcaggcatggaatttaatctgttacttatgtgtcttgttttaatacaaatgacaacagcaagagttaatatacatgatgaaactgaggctcagagaagtaggtgactaatcccaaatgtgaacccaggcttttaaagctcatggtctttctacttgaagctctgattatatatttatatgacagatgataagcatttattctttggttatttattcaatcagtgtttattgaatgtccattttgtgctaggcattatgcttgatgcttggaatacaaagattattaagacggagactctatccttgaaaagcttactggctagaaaaaaacaaatgtaaatattttaaaacaatgtaatattctaattatcgtgagcggtctgaggagaaattcattgttttcataagaagactatgctaaattctggttgggaatactgtggacatttacctgagaaagtgaaggataagtagtagtcaccaggtgacaaacagggaagagcagttcacagagtaaggccagcaagtcacagaggcatgaaacagggagttttgtgtggcaactacacataattgtgtagggctgaaatatgtggcacacaggagctgtggggagagaggggccaggaggagtgacagcatgtttcctccacagggagctgagacagtgccattgaagagttacatgtaaaggtatgatgtgtttatacttgaatttagagaaattaattagatgacagttgtgaaggctggattggcagatggtgagcccagaggcagagactaattaagatactgttatgttataaattataagccctttaaatatcaggaaagattcactaaaagaagcatcttttgtgacagccagtctaccttctttgaagtgatcttttctgtgctacaacttgtcttacctgaaggagtacagagaactgtatgagaagtgctcacatggacaagtacagaagccactgctagatactcttgagtgttcatttaatcctcataacatgtcaaataaacatctgtcccttttaaagaagaaaacagtggctcacacaattagataacttgcttcagatcgtacagtttacacaaaggagacaaactttgaactgaggtctgactgtaactatatattagtatcttttccactacagcactcttagcttacactgaataactgctctgctataaattgaaaggaagcagctatatatagtgtggggtgaagaaatggttctatgcaccatattagtttactatatggggctgccataataaaacactccagtcttcttaagtcctctctcccgggcttgcagatggctgccttctctccatgtcctcccatgctcttttatctgtgcactaacatttctggtgtctctttttgtatccaaattttcttttctttgaaggacaccagtcagattggattagaacccactctaaaggcctcatttcaatttaaatcagctctttaaaggcattgtctccaaatatggtcacagtctgaggtactggattagggtttcaatatatgagtttcagaaggcaaggtacacaattcagcacacaaaatgcacatactctaacaccggtttaagcacaacactgcatgtttcagaattaggaacctgatatgaactagttaggatagcagattttcaggatcatccccagtatcgaatagtagacattaacaagggaaatcatcacggccatcatcttaggtttcctttgtgcttggcattatttcatctactttacannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattaagaaatttgtttttcccttttacatgaggatcccttcagtgaatagcatttactgccactgctgtcaaggagcacccagttttcagatgcactggtgggcagtgccatgtagcacttgatgtcttatctaacatgtcttgattttgacaattcaggttccgtaagatttcatacgtaaatagttctctcaattcagaatttgaaagtacgtgcaatgctacagttatagttcagtattagtgaagaattcttcacttggcctccttttagagtacaaagctgttctgcagatgttctttgacgttttatgcagtaggagggagcacagagcagaggtaaaagctgctcagtcccccatggcagccactagacatggagctgtggacccttgacccgtggccagtccagattgagatgtgctggaagtgtaaaactcacaccacattccagagactttgtatgaaaaaaagaatgttaaaaaaattattaaaattaatttcacctatttctttttactttttttacatgtggctactggaaagctctctattacagtgtcttctcatagacagcactgagttaaatgattctggctgtgtctgtctctggcacatactcacttatgggtaagcaagacagcaagacagtccacaagccgcagagagagaactggaaagcggcccctcatattcctactttttaaattcctattttaatgtttgtatgttatttaaaatatagcttagtaatattatagtatgcataagcacattacagttacaagttcaaaaacatttttatttgtgccgatgtattatcagaaacagagaccggtgccacagtggttaagtctgacggacctatggtcagacgccaactttaacatttactggctctgtaatttgaggtgagttatttaacctctctaagcctccttttataaaatgtgtaactgtttctacttgtgagaacagtgtaaaaagattctcgtttagagggccggcctgaaggctgaaagagacaggaaagcacgtagtctttgtaaactgtgtagagggaagtctgttgtccactccgttgtctctgcttgaggactgaatgagatggtttgcatagggaggtagcacagtgtgagcccgagttcctgccatccttctgcagctctaaattccttctgcttgttgtttcacacaagagtggctacgaagagcaggttctgggaaacctgcaaggactgtgcgagcaaatgttttatagtgagagaggaaaccttgcaaagggcttctttcctgtggatggtcagtgtcagtatttcctgtgcactgagagtcggtaaggtcaacagccatatcctacctgaacacaaacttgagtaagacagcaaggcggcctggctaccgttgggtatgatctgttgtgtggaagggcttctttccataatgacttttaaactcctgaggtcctcattattatgacactcttgtgttacagaaacaagtttatctttggaggttttacagattaggaatttttttcttccaattttcaaataccttgcattcaaatcagagtacaaatgagaattcccataaaaaaattcagtatagttcaggtacatttccccattgatttttgtaatgaccttgataatgctaacattacagtataaaacaaaagtatcgtttatctaacttcacacatttaatgagtaacaagattttgacacagttactatgaagagaaatataaactattctttacaatattggaattattctaatacacattggctcaaaaatagatgttgattacttcctgtggatacacagcttcggaatagctagtatagtgaatcaaaacgaatgggtgataatgacctcagccctcagagcccttcctctgccccgacatggcttgaatcttcacagaccatttctgcctcctggaaaccccttgtaaatatctttattttattctaagctaagtggaattagtttatatttgatgtcttatttacaatcctaataactatcataatatttttagtctatgtttctgaaaaagtataaattctccaaagaactgtttggctcctatagtgatcataaactaaatagaacataaagggtctcaaaaagtgctaatagaaattgagcattataaactgtcaacaaaaatacttctaacacagtactatgtagacatcaacaaaaaacaagggatatcaacccaaattacccccatagacccgtaaatacttagttcccaagaccccatggtaagggaaaaaaaaacaaaaaaaagagtagagacaggggtgaaaaagtgaagctacaaccctgtaaagaaaagaaaaattatttggtgacgcttgttaaagcacagtaaggcggactttattcaggaccactgcagtagatacgtggaccactgcactgggactttgcagtggggaagagagaccgggctccactctgcatctagcattggcaagtgggaattcgtagccaagaagtcgggctagggtcaggagatagaaaattactgagaggaaacatcagtggtaggggggattttggctgaactgacctaacaggattcttgccagaggcaggccagaatggtcagacatcccctcccctggggaatgatggaggataaggaacctgatcagatactgagggtgatcagatatcatgggtggcgtgttcttgctaaactggctcagcaaggttcttttttaaaactggattttacaaggagctccacagatgggcctaggagaaggatcaggaggctgactaaagtttagccaagcagagaatctttgtcagctctgacagggaaaagggaaggaacagcccaagactgaatgttagcatgtgtaagtattgctgtttattatagttattatatattgaccatctgctgtagtgtatcagacacacacacacacacacaaccaccctctgatcttaattttaaccttaaaaggtggatattatcctcaatttattattgagaaaactgagactcagagtttaagtagcctgagtgacactcttaatgacattattgatttcaaggtccattttcattccattatactagtgtttttcaaagagtagtacccatatcattgacgtctcacaatgtgatttcagatgctacatgggcagacttcttaaaaaattgtaatgattagattataaagttattggaagagtatggttagcatatcaaacacatgattttatgattattgctataattcagtgatgtcaagtttatttaaagtaaaagaaaattaacatggagagttagtatgaagtcacgaacaggatagatggcaagtatactgcatatcctgagagttgtccctgaatggctggggtttggtgaatgctgcactgagcatttgtgtcaccagtcagtggacaacctgaaacactgctcatactgaaagtttgattagatgagtctgagaagcaagactgagcttctcactaagttacagtgtcctaccaaatttgatgccttgattttattgaaaataagaagttttgtatcttcaccaggaatttctttagaattaaactaataaaaaaggaaaatgtttttcaagattcatttacttaacaaagtttgaaggaatgaaatatctattgcgtacttaccaagtgtgagttactatgtatctaggtgctctcatacatattctgtcatttaattcctaagaacttctgtaggattgtcattccttaattttacaaaaggagttgacattcacagaatttgagcttgaccaaagtcacatagctaattcatatcagttagtcctcatactgttctctttgagatcaagcttacattcttttgcctaactcaaaagcaactagtaagggggaaaaaaattaggttcctataaatgtagagaagaccaccacatgggatcttcatgcatgatctccacaagtgtatgacaacacggtagtggggcaaaggcaagctagtggcaataaatcaattgccactgtcactttactctttaatgttcttgagactacatgagatttatcactaaggaattgtagaataatggtagtaaatgaaaacaaagtccaccagggagatgtactacatcatttggatttagcgctgccatctgcttaatagcattgagaagactgcaacagtacttacgatcaaccattcatagcaatgacagatgctgcagagagtgaacataccagggaagcaggttcattactaaaatgtagattatgtgacagggtttctaaaaagcgcttgtgttgatgaccaaacctccagttttaaatcttcactatagaattttaagtctgtaagataaagacctactctaaagtctttctatgtttcattcctcgtgtttcatacattcttaaaatgtatttatttattttttaaataattttttctacaaatcttgcatatatagtctctttttgatggaagagaataataacttttgtataatttctgacttttaaaatgaggtagcattattgttagtaaaaaaagacagtgactataaatccacaaaagcttggacttgaatgtcagctctactactttcttagctctacgacgttgactaggttgcttctttgagtcttttctcttctgtaaaatgatgactgtttgacttacaacattgtaattaagtgagatagcagatgtaatatacataatagttcaataaatttgctgtagtagcctgtagtaggtgtttaccattgtaagcattttatggcctttttagctacttttattttattttattttattttattttattttattttatttttcagagacagagtcttactctgtctcacgctggcatacagtggcaccatctttgcttactgcaacctccgtctcctaggttcaagcgattctcctgcctcagcctcccaggtagctgggactacaggagtgctccaccacacccagctaatttttgtgtttatagtagagacagggttttgtcatgttggccaggctggtctcaaactcctgacctcaggtgatctgcctgcctcagcctcccaaagttctgggattataggcgtgagccaccacacccagccagtagctactattattataccattttatggatgaggaaattgtggcacagagaccgtggaacttccctgaactcatggagagtgagtgctagagctggcatgtgaacccaggcagtctaagcactctgctatactacctctctatgtaactgttgttattatgagtttaagtattatatccagaaactattatagtcttttctgagaacgtctcccagtcaataaaatcccaacaaataatctgaataaaattatgcatgccattttgataccttatttgtgcaataaaaagttgttaaaggctcatttaatttagattgtttagagtcctaaaatgtgtcagaagcacagacttgaggacagagctctaagttacttgttgcaggttgacttgtaatggagaatgtcggtgcctgaattccccagaatcgattcatacctcattgttagactcacagctttagaaactgaaataatattcagacatgttgtggatcatatttttcccttgtatttgtcatcatgaagggatatgttccttttggaaggtaatttatgagtgtgcattgagagccttaaaaatatttgtgacttaggagccaatatttttgcaataagtgcctgaacttacaatataacagtgagtgtctgacagtgcgaatatatttaagagccctttaattgaaaagagtaagcaatttctggaggagttctgggaaggaggaggttaggtgataaattcagtttctcaacctgttggatagatagtaatataattaatttaagtggcagtgagatttaggaaaaagttaataggttcatttgggatgtgttgaatttaggttgtccacagaattgtaacaattacattaataattgatataaaaatggtttacatactaataagtcattatatcaatggtaactatatttctctcctagtttttcttagtagttacaaaatgtattatggttagatttttaccccaattttagtaagtaactgagttgtagttttattttttgtattctctttcattgatgtcttaaagtatgtgtacccagtgttttgacatggttaatctcccagaaattagagtaagatagtcaattccaaagtatattaaacaagatagagtgaaaatattatatgattaggagtcaggccgacctgacctttccacttcgctgtgtatgtgatctttcactaaccctcaattttcccacctacaaaaacgtagtgagagaatatacttgaacagtttagtatggagcctggcacgtggcacttggaatttgtgattgtgttttatgtgtctgtcactgctgggcattttgctggtgctctgtaagtagtactgactgtggagggatgatcattggcaccttcgttatcaccaggtgatagattgcttccagctcacctcatatctgctcattttctgtgcagagtatcacaaacctaacttggagcacactgcaagtgtaaaggcataaatgctttgcttttttgttcgttgtttcttactctgatgcttttttgttcagtgttctgtaaaggaccaaaaagtaggcatatacattagaaagtaggaaaataatcattaaaacttgcatgtatttcctttatctatcatttataaggattgctgtaccacatgaaaatgaatttatgttgtttgtaagtttataaaatagaagtatttcatccaattgcaacctttttgaaatagtttatcaaaagtattggatatagtcttaaacattgctaaattttagagacattggaaataaaaaatacatgtaggtatatagcccaataagacatcttacatagaggaaaaaaaaaaactatccatattgtcttagccaaagtaatataattaaaacagtgtctcaattaaggctgcataaagatgtagtaaattaaagtgtgaccatgggcaagttatttaacctgtgctctagagtaaaatggggatgacaataatagtactgacctcatggggttgttgtaaagttaagcgaaatggaaagcatgtcatatatggaaagcatatcacacatcgtaaatgctatcaatagctatcattaaagtcctacaattctttatctaaaactgtcgaagctaaatatgtcttacattccaatttttagaattttggaaaaacaatacaggatacatacacataccatatgttagtacagctccagtggagccctgcatgtgcttctccaggataatgattgccccttggattctttgaagtttatggtcagggaaactggttacaaaggggtgtaaagcatatgtggcaatttgaaaacgaaggggatttcttaagggagcagtgtggcattcagccttggcagtttctaatcccaccaaatatagcaatattgctagtgctagcaagttatttttaaacagagtggattaaataattgatacaagactgtttcttctattagaagtcatcactttagcaaggccttttttttttttttttaattgagacagggtatcaatctgtcgcccaggctggtatatagtggcgtgatctctgctcactgcaacctccgcctccttggctgaagcgattctccatcctcagcctcctgagtagctgggaccacaggcacgagacggtgccactgtcactttactctttaatgttcatactcagctaattttcgtattttttttagagacggagttttgccatgttgcccaagctggtcttgaacttttgagttcaaagcgatctgtccgcctcagcctcccaaagtgctgggattacaggtgtgagctaccacacccggtagcaaggcccttcctgacctggccccaattccttctctgcctcatctcaggtcactcactcatgtaatgtaacctgatactgagtttcacagttatggctcatttatacttgactcaataacctattaaaatgtaaaggctaacttgtgaaagtacattgtcatcaaaatcttcatggctccttagttaatctcaaatataccttttgaagatattgtggtttttagaattttctaaaatggtgcaaacaggacaatttgcctttctttgtattttagtctttgccagattgcttgcaacagagctaccagtttcttggatgagtagttacaccatccaacaaccctcggtgattctcctcacctcacatcccattcttccatgtcctataagtactaaggcttctgtgtttccgcaatgctctgtgcttgctctgtcctccagcggaacctgctggacttgagaatccatctcctttttatagagtcctgcagcagcagggacccttttgtactcatgtttatatcaccaacacctaatgcagtgctgatcagaaaggtgatctatgtgtgttcttcagttgaattgataacgtgtaagtttgcatctgttttaaacatttctttattagaaacccagtaagaaatcttgtaccattgtaagtctaatgtgaaaattgatgtagtcttcaactctggctacgtggaagaatcacctatgcagccttaaaaaaaagggggggaggatgggggggtgccaagaaaatcacctgttattttttaatctgagtcttggtgtagagcagctactataaattctttaaactctacagataattctgataagcagccaaaggttgagaactgctcttcttgagtaataagtactatataaattagataatatgtgtaaagcactttgcacagtgcctaccagttagttgccaaggaaatacttgtttcccccaaaaataaattgttggcctttctgtaatgtcttccatacattcattctgcaaacaactattgaaaccttcagtgagccaaattgttcaaaaataccttattccaaagggaaatttgatgttttctattagaatataagtgcctaacatacttaaaactgtcactattcgaatgtaagctctgcaggggcaggaatcttcatcctgttttgttcatcaacacttcttaagcacctgagatagtgagttattgtttagtgggtagattctaaactgttgtcagtaatagatgaccattctaccaggcaaaccagaaggaagtttttgtgcagaagagcacaaaaaaaaaaaaacgtgcagtggtcctatgaagagattgacttggtgtgcattggtagtgaccagtttttcagtgaagctgcagcctacggtgcctaggaaggaaggtgcactaagtgtctatagaaagatccatagagaacattttgtgatggaccttcataccaggctcaggagttccacagattttttttttgttttggtttttatcaatgaaggtgctccccatgcccgtaacccccacactggtccaagtgaatgtcaccttgcttgtgaagcacccggagcctggctgttgcttgccccacctccactccactcctgagctatcatgtctccctactgcagcccacgtgatattttccgtataattacatgctctcataatacccagcagttttccatcataactgcaattttatattgaagtgattatttgatcaatgtctgtcttcttttttcaatctattcactgtcccctcccccagtgcctaccacagtgctagaacatacgtagtgctcaataaatatttattgaataaatatggagaggtagaattttactttacatcagtaatgttaaaacaaagtaggtattcttatcacaatttcttatctgattaaaatacaatactataagtgtcgtagtttaaattcttttaatgctgcatatttgaagagtgagcctgtataatttgatatgcagattgatgtaagttagtgtgccaccagattccccagaaacactaaaaaccatttgctgccctaacattgtgtcaaaggaagatgctgacaatcccataaaaaatcaaaaggtataattatttcacatgtgtaaatattgcagatcacaatcagtgttttcctaaagagtaatagatatggctttgaaatctaaatatcaaatgtgtttatcagaaatctcctcaaaaagatatgttagtataccagatggaaggattggctgtaaaaacaaatgcaagattcacaaatgatccagagaaatactgtaacctggctcataatatgttgatggaccatttctaatggtatcggaagagccaagtaatccaataccaaaagattccatgccttgacacccagtgtagttggacttggggaatcaaaaacagaaatacaaaaaaataggcttaaggaacccaaccttgatcttggtctttcctcaaagttgtatattttttgaacttctaagcacatatttcatttgcggcagccttcccggccttcctgccacttggtaaccaatctctgaccccttttctactctccagaccttccccggaacctcagtctgtgctaacagttctccttattacatgtccccagtatttcaacctggtttttcaatgttaggttccatgaaattctaatatgtagtttcaatacttcatgcaaagaattgtcattaaaattactcgtgatgtctagtgacagtatctgtaattgatagtattttgtaagtcatcctttgccagaaaaaaataagcgataaggatctgttctcttgtgtgtcttcataagaaatcttagttttcttgttagcgtttctgagaaattaattgatgtttgaaattaacaagctacagtaaaaatactgaagcttgagtcaaaagacatgtctgaatttgaatcctgactgtcatgtaatgtgtgaccttgagcgagccgcacagtaaaccttatgaaaccttacgcttaactaataaagtgagtaggcaaattaatgttcaccttcctgaaagttaaataaaattatgaagttgcagagtactaagcaaacaaagggaaactgttgttggtatttatttttttagggttgtgtcaccaaagctaagttccttactttttttttttttctctcttgaaatacagaattttattgagaaactgtttaaagtagaaaaaaccctgtcaagaaagaccaggtggaaaatgggttcccaataaaatggaattttagggcaacaaaagtctaaaaggccgcaaaagagaaatagcaccactgtcatttgaacaatggctagttactcacagtttttggcattgttaatcactgaatctgggttttcctctgaattccacacagcatgcactacacaacaattttatcataaaatacttgctttctacacacattttaggacaagctaccaccagaaacaaatcaatgcaaatacatcaggggctgaacaaactcagtagtgagtgagacacattttgcagagtcctgcaaatgagggagagttaaggaatgaaatattttaaatattaatttttagacacggtgctatattttctgcaaaagaaaattaacatttagccacacactaatgcattttatctccaaagaaactagtgtactggcaaagtattcagattacagtggacagcagataccgaaaataccccagccttgcagatcccaaggtaacaatggctttcactgaccactccctttgccagaggtccagaaagaattgcagcatggtcacctgcctgctttacttccagctctaagcagcaaacttcaaggagccaaagaggagtccccagtgggcaaagggagcagagaagagaaacatggtaaatgtaaacctaaaagacagtaaaatgggataaaatccccattcaaatcccagagatgtgggcaagtccccaaaagtagttgttagattaaaaatctgggcacacctcacttccccaaaaacataatacatagaaattttggggataactggaaaaatagaaatgcttaatgaaaaccgagctcttcaactcaaacatctcaaggctaaaacacatcctctgttatatccaggcaatgatgccgcttgctttttagcacggatgcagttggccaatgacaccaaatggcttcatagggcaactttttagaccaaagtctaggcctgtgaggcttcaagcagccctgtaagacagaagtttccaaaggtttcaaggtctggcccttccttccccaacacaatgtcaaacacagtatctcctgtcatgttacattttatattttgaaatatggaagcatattttaaatactcttaaggcatttatttttcacaacattctctgatttcacattagcttaaaattcaattcagtctttacatttctccactgaggtcgccacgtcagcatattatataacaccttctccagcactcagtgtgacccgcatctgcatggtgagccccacggtcagcctctttgtttcccaggtgaaccaactagatgttaatactgctctgctacaaggtaaaagctcctgactcaaacttattggaaaaggagtgaaacgtctgcaaaatgcactttaacaagaggcactttttgcttatgaaaagaaaccagtgagtcctctaaggataataaaagggagtattttacagttaagcacatgatttggagtgaagaattcagatgttgctctgctggtccaggctgttaatactcttcttgctcctcctgtgggcctccttcatcagatgtcacaaagccttcatctgtggcatacagaatgtctacaatcctctgcaatacagggtcgttttcccccttgttctcctggcaattcaatgttctatagctttccgaagtagaaatccctctctttctccaagtcttcaacggtaagtttcaatacattgagtgctgcatcaactcagctgcctcatcgtgcccattgcgcacaccagggtctttcacaccacaccagggcagccttaggagccacagcagttctctgtgttgagatgggcctcaggggagctgcactgctagaactgagaggtttcttgggtgtattcagagctggagcaacgagagagggagccactgcagtttcttgaccttgtctggcagccacagggtcagtcttttccatcataatttgcatcaaaaaacttcttgaaacactgaacgaattcaaaattttcctgaaactttccttttactaatttgtccacaggaattattttgtcaacacccatcctcttaaaacctactggtagtattttgaagttctggatgcacccgtgttctagcttagcttagaatttcactttcttcaaggcggtggagccagggaacagcatgtccataaactgacactaggcagcccctgagcacagctgttcgatctttgtcacgttcaactgcagagactaattgatccaggccagcatgtcatgtcgacttagattatcactggtcactgacgttgagtatacgttcactgccatcttcggctcttggcggaaccgtgtccactgcccgcacccagctccggttccagttccttactttttaggcaagaatgaatgtttgctgaatagattgtatgacaacaaaaataaggactcatttaaaaaggacttctgctttaatatcattaacagctgtccttcatatatgtatataacacattatttcatttaaactttacaacagtcctatgaaagattttttttaaacttttacagatgagaaattaaattaactttaagctgacagagaataaatcctaaagtctaatttctgatatttgtttggcttcaaagcctgatttttaactattctatgccagcttctaaaatgattacagtaagatggagaaacctgcttaaaaatgaaaacctgagcctataaaagtaaatatggcattgcacagacctctcacatggacatcagcatgtcctctgtgagctgcacgcctggccattgctgaagcttcctggcatggtggacttgggtgtgttggaggagtaaagaggcacagtgggggccgggcgcggtggctcacgcctgtaatcccagcactttgggaggccgaggcgagcggatcacgaggtcaggagatcgagaccatcttggctaacacggtgaaaccccgtttctactaaaaaatacaaaaaattagccgggcgtgttggcgggcgcctgtagtcccagctacttgggaggctgaggcaggagaatggcgtgaacccgggaggcggagcttgcagtgagccgagattgcgccaccgcaaagaggcacagtgggaactgaggcagttctcataaggaaaacattattctccttgtctcctttttcttggaatctaataaaaattaataattttttttcaattatgtagaaccatctgcaaccttttaagcaactttgtagtaggaaggagtagcaggacattgccgttttctgttaaaataagaaaataaggttagctatctctatatcagaaaaatacagggatactcacacgccttatttccgaatgcattgctgtggcttttagggacgggttaaactctgaattaatcataaattcaatcaaattagatgttttagttttctctcatgcaaggatgtaatcagctccaagctcacgtgacagctttctgtagttactaagaatccagactgcttctgcccttctcttccgcactccttcaccctggcttctatcccaaggctcttctcattcacagtggctattatacttccagctgccaagctgaggttcaggcaggaagaagggggaagagtggaaagccatgcctcctaggtgagttggccttctgttaggaaatttcctggaagcttcactccataaattttgcttctatctcattgtctacttcatctgcaaaaggattgatacattatcactagcacccaatccccagccttataagggatctgttggtaagaaagaaggtgaagatgcatgttaaacaggcagcaacaaatgcctattggttcttaccttttaacatacaaattagggatttttcttttagatttttttccttttactgagatataatgtacatacagcaaagagcataaatttttatttatctgaaaaaaaatagttcagtgaaagttaacatacgtatacacccacataaccatgaggagaacatttccagcaccccagaagtttctctggctttttctcttagatgttgcctatcagttatcttacctctagccatctccttttgattctgaattacatggcttttttttagagtacccaaacatatctcttattattctgagaatgtagtgattgacagttaaattagatggtagtgaaaaacaggtggtgttgaaaaaaaatctacacttggcattcggagtaactagacttctattctgattccatgtattctagccatgtgacttagacaatgtctaaactttatgcctctgattagctgctttcttattactaagccagaatgaatgctgttgttctgcttggaatgatttttttcttcatctttgtctggcttttctgttgtcaattgaagcatttcttttttcaggaatcttctcatgtcccccaaaactggttcaggtatcccacctctgagttcctacagaactctgggtttctcggtatcatcgtgttccattccccggttgacacttgtctcacttgtacactagactcaacatggtttatcacaaagaccaaatcttgttggctgctgcattccaaggcccagcatatagtgggtgctctgtaaatatctgctgaacagatgtcgaatgaaaaagatggtctctgaacctcctaatttcatactaagattattccacaaaacacagtagaagtggtgagagcttgttttcttaaatggcagaaaaatgttgtttttaaacctaaatttatgaaatagacataagagctttattgcaactttattttaaagacaaaagataaattgcatagaatacatggcttataataggtatttgataagtgatatctattattagtgtgatattaaattttatttgcatgtctttgtgtctcatgtgactgtgacctcattgtctccacatgcccatcatctagcatcagatagtagtagttgcaatagggtcatttctaaatcagtcttgccagaaacttccagggcacatgcttccttattgcttcctctgagtaatctgtcttcctgagttttcttacacagaaggttgtactcaagctttgtggagaataaaataagagaaaaaggattctgagtgtctcatgagagattaaggttaaacacaaagcaagaactttctggcagacctgttcgagggtattactgtgacaggttattcaggtttcatccctagaagtctttgaaagtggagagataatcatttctctcagatgattaagacagtttagcctgaaggccagtggttgggccacatgacctctgaagatcgatttcttccctttgattcagccaagtaccagtaagttcctgcactttgtagtggagataaagtttagaagtatttcatagtagaaaagggaagggaccagctgtaaaagacaaaaaagtttgtgtctccaattctctggcaaacctgtgttagcatttgaaatccttttatttgacaaagtgattgttatatctgaggttttgcaaacttagttacaatagggttaaggataatagtcaccatttattttgtactgactaaatggcaggccagtgactagtgttttgtgtaggtgaactcatttaattattactcattcattatcagcctggctgtaagacagctgcagcagacacttattgagcagaaagtataagccagatttattcattcattcattccttctatcagtgtctttattgagcaccttttatgtctgaaacacttctagaaactggaacttaaaagatttaactgcctgcccgagcttaccctgcttctaagtggaagaagaggattcaaaactcagagagcctttaatccaaactctgggctcttaatcattactgcatgctaggtctccataacaataatggactttgttcataaaatgctttcacatacaatcgtagttgatcctatagcagccagtgaaatacctagaatgtgagatggagaggcattggattgaggtgcaaagaaatactgaagttattgatcgggacatctagaatactgtaggactgttagaacccatgttctatgtctgagcttgaatacttcgcctgataggagagcaaatgctccaaccccagtaaattcagtaactcctgtcaggcttctgactgtttcatggcagcagactccacccatatagtaacttctggaagattatggaaaaagccgagacaatgggcagaaacacctcccgaggggaaacattctgctgctggaccctgtcaggagatggtttatggtgggagtgaagagatgaaagacaagccaccagcatttacagcgacatgatctggggcagagagggagtaaggaatgtctggtaccaaggctagaaaacctcctggaagagaacctgaaacaagtaattgcctatggagtcccacctgagcttgatggagcatcaatgcctgtgctttcctgaggaaggagcccttgggtctggaattcctgtggtggtctgggtttcagcagactgactccctggggagtatctgggtagtctaatattgctaattttgataacataaaaccttggtctcagagaaattaagaagagcattgttgtatttacacagacctttgttctaatcctggcttcaccacttaaccagctatgtgattttaaataagtttcttaatttaccaaacctactttttttttctgttttgtgaaatggggtaatatctacccacaatgagttataaagtttaatgtatgtatgtatgtatgtatgtatgtatgtatatacagatgtgttgcttaacaattgggatacattctgagaaatgcatccttaggtaatttcatcattaggggaacatcatagagtgacttactcaaacctagatgggatagcctaatgcacacctaggctagatgatacagcctcatgcttctaggctacagacctggacagcatatcattgcactgaatactgtgggcaatggtaacggtggtcagtatctgtgtatctaaacgtatctaaacatagaaaagatacagtaaaaatatggtataaaaaaagatggtacacctgtataaggcacttaccatgaatggagcttgaaggactggaagttactgtgggtgagtgagtgagtgggtggtgagtgactatgaaggcctgggacgttactatgcactattgtagacttcatagacattgtatgcataggctacactgcacatattaaaaagtgtttttcggccgggcgcggtggctcacgcctgtaatcccagcactttgggaggccaaggcaggtggattgcctgaggtcaggagttcgagaccagtctggccaacatggtgagaccccatctctactaaaaatacaaaaaaattagccaggtgtgatgacgtgcacctgtaatcccaactacacaggaggctgaggcaggggaattgcttgaaccggggaggtggaggttgtggttagctgagatcgcgacactgcactccagcctgggcaacagagcgagactccgtctcggaaaaaaaaaaaaaaaaaaaaaaggatttttcttcaataataaattaacagcttactataacttttttactttataaactttagttttttaactttttgactctttcataataacacttagcttaaaacacaaacatattgtacaactatacaaaaatgtgtccttatttcataagctttttctgtttttaaactaatgttttggttttttttttaactttttaaacgtttctgttaaaaactgagacagacacacactacatagtgtcaggatcatctacatccttgtcttctacctccacatcttgtgcctctggaagatctttagggacagtaacatgcatgaagctgtcatctcctaggataagagtaccttcttctggttacctgctgaaggacctgcctaaagctgttttacagatcaagtaaacacagctaaaacagcttcgggcaggtcctttaggaggtaaccagataggttttcctttttaataagtagaaggaatatactctaaagtaatggtaaaaagtataatatggtaaatacacaaccactggcatagtcctttaattttattttctagtatgatgtaccgtacataattgtatgtgctagacttttatatgaccggcagcacaatagatttatttacaccagtgtcaccaacacaagtaatgcattgcgctatgatgctaccacggctacagcgatagaaatatttcagctccattataagttgaagggactgccctggtatatatggtctggcattgaatgaaacatcattatgcagtgcttgactgtgtatatatacacatgcgcacacacttcctctacaaaacccaaagccaaagtgtgcaaaagttgtctcaactcgctgtcttcacttgatcttcttctactttctcttgaacttgatcttttggttcccacgctgctactgaaacaactctgttcaggtcctcagtgacctcctctgagcacctttgccacacttgatgagggaatccgtcgttccttctgaagagccttaggccctcaccatctcagagcctctgggctcctctctctctggctgggtgttctccatctcttgctagaccctcctcttcttgccctctgcattctggagtcaagggggctcactcctttaacctcttctccatttgctctcttctcagtggtctcactgtctcaggttttaacgaccaagagcaatgatgatgactcccagatttatgtctgcaggtcagacctgtctcctgacccctagattctctttccagcagcctcctctccagaggagggtctctcaaacctaacgtgtcccaaatcaaactccggaactctccctgccctgaaagctgttgctgctatcctcttccctttctctataaatgataattctgttttttttcttggaaccaagaaaaatttcccatttcactcaaccgggattttaaaaacacacacataagaaatgaaagcctctcagtggcctgcatgaccctgcatggtccacctgccttcttactgattctgtggccctctcccttgtcctctctgctccaattgcactgccttcctttctagccttcagctgtaccaagaatgtgtcccctgaagaacttgacatttgatggtccctctgcccacagtactgtgcccccagataatatctgcatatctcctccaattccttcaagtctcagctcagatgataccttattagagagagttctctgactaaactataaaataacaatcttagttcagttcttccaatctcttagctgctcttctaactctcagtagcacatctgatcatgcgacgtattatttatacatatatatagtttattgtctgtctttcccattaaagacagctccatgaaagtagtgaatttgtgttgtttattaaatatgttttaaataacttgaatccatgcatgaatgaatgcatgcatgatatgattgtctcatattatttgattttgtgcatggccactgctgaagttggtaagtggcagagccaggactcagcctggtctcactagagcaggagctctctctcctgcacagtgcggtgttcatgccctcacctcccactgggtgatgcagagataattaacaacaaggcttcactgctgtgcaccccagtttgcatataaatgcaagggtaaaatggataactttcttctagagcaatggcaagacttaataaatcaggtgagtctgctttcctcatagaatttatagaaatataagctcatgttaatgccacaataaggttcagattttaatagtctctgtcttatgaaatatagggactgttaagtatttaaataaaaccagtttctttttttaattactaatttataagaggaaaggatctgttttctcagctatcattttaaaattctgttttgtccctgggagataaattttcagttatgacttttttaaagattttatttttgccacagtcctagattcacagcaacattgagaggaaggcacagatttcccacaggcaccctgcctctacacatgcacagcctccccattatccacatctgccaccagagtggtgtgtttgttacaatcagtgaacctacattgacacatgatcatcactcaaagcccttagttgacattagagttcactcttggtgttgtagattctctgggtttgcacaaatgtgtaatgtcatgtgtccaccatgagagtatcacccagagtactttcactgccctgaacatcctctgtgctctacccagtcattcctccctcccctcaacccctgtcagttgctgactcagttacatgtgtatacacttgatatcaacccatttcttaaaataggattctgttgtaaactgggatttttgttaactcttaattaaatggggagcaggaatgattcctcaaattattttaagtcctacttcccactgtttttcccaaatcacattttatagcttgagaaacatggtgaaattattttttaagtttgcccttgttttccctcccctgtcagcactgtgatggatgttctcccgagcagtgaaatgtctaacagtcaggttcacaatatcaactctgaaagctctataatttagaaagccagaccttcaatttttgtaagctgataggattgctgaatctttctcttagagggggattctctgattaaactataaatttggtttggcgttttcaatggaaaattatgtaaatattccaattattgtcaaatgaatgtgatttttaattcctaaagaaaattatttatttgaaacttaagtttgtttctcttttcttatattcttggcactagtagataaaacatgccagttagggaactgaagctattcccatgttaaaactgtttgtaaggatttgagggtaatctctatatttgcattgcttatttgacatgctagtttctctgactttttgctgtctgccccagaagaccaagctttgtagtcatggtgttatgtgagatnnnnnnnnnnnnnnnnnnnntaatgctcactctgccggcctccctgaaatttgctgaagcccatgtgtcctaggccagtggttctgaaagtttttgatctcacaatccctgtatacttcatactcttaaaaactagtgaagtacattgctgtggtgtggggaaaaaaattactgagagccacaacatgctttaatgtatgtggtttatatatattaatatttatcatattagaaattaaaacaaacatttaaaaaatttatcaatcattaaatgtaacagtcaacccattgcttgtaatctatttttatgaaaaatctctattttcttaaaaaatggtaaaaattgtggattctcatttatgcttttgcatttcttctgatgtgatatgttgttttgattgaagtagttggaacaacagatgtgtcactggcaaggggaaagcagccctttcaaataatagacgatattcttctttgatacgacatcaaaacttggcaggtagtagtgtttgtttgtttgtttgtttgtttgtttttgagacggagtcttgctcattgcccagcctggagtgtagtggcacgatcttggctcaccgcaaactctgcttcccgggttcaagcgattctcctgcctcagcctcccgagtagctgggattataggcatgcgccaccatgcctggctaattttgtatttttagtggagaagggggttcaccacattagccaggctggtctccagctcccaacctcaggtgatccacctgcctcggtctcccaaagtgctgggattacaggcgtgagccactgcacccggcctggcaggtagtagtttcttaaagattagttgtaacgtagactctaaaaccataccagtaaccttttcatactctgttacattaaaataccttggtctgctgtatacttgggttttttggcatcatgcatgcatcatttgaaaaatgtcacttcgctgcattatgcgtatcttcaaagtgctgttaacacatttcattatgcaatatcaaaaaagtcatattatcaccactgatctcaacagagataagtattgacttgaccatcagtttacagtagcaaatattggttttccaaaactgcagtttttactggaaagctcagattctgtcattggtaataaatactgtcagttgttttacttaaagtgacaggctcactttattcatttttgagaaaatgtgaaccagatacccaagtctgagtaagcctagttcattgctgtgagttatttcacgtaacaatgatgtttatggaaaaggcagctagttggcctcacaatgtaagaaatggccccaggtgcttttccttgagatcacccttgtacttcagtgtgccccagaattgctttcaagagcacttttcccgtcatcatacagaagttaagagtgtctttaatagttgagatttaataaaattagtaaatgtttacttcatcaaggacattgttaagtgaaaattccttaaagaaaagaaaaagaattctcatgcagcttcgtgccactgccttgacttttggtcaacaaccaccaacaattttacccaccacataaaaggtcagtatagtgagaaagacacataacatcttagtgttattctgaaaacattttgacttgatgaaaccctgaaagagttcgtgggtcacactttagaaaccactaccctaggctattttgaaaactaagatgcagtaacactgtgggagaggtgggctcgtgatggatccagcagcaagagaagaataaagcaagctgtctgaaacatttgacacctcatgcagccttcccgtcaactgaatcgtcctcacattgtaaggcccttgagggcagaaatatcatcattgcctgccgtcacatggacagcagtctgtgcatgccagggacacccacaaagagaggctgagcttctgccttactcatcagaactggccccatgtagcctcggaattctcaggggaagagggacaggctaaccgtaatgtatttactctgaacacatttaacaaaacaagacgagaatgaagttagtgccatctctttttccagattagatgacagtagtcgtagcagtggcattgccctagtaggagcactagtgaacaaggaccaaggaaaagccaaaattcagcaaagttgtggtcaggtgactggactttggctgtaactctttttccacccaacttgcataacctaattctggagcatattattcaataccctcctggggaaatattgttaaatgttataaaagaactattagataagtaaggctcttattgaaagcagactggaaattttttagtcatttaccttaaaggaatttcaaatcttcagttatgtatgataatgtgaaaacaagagtagtcccaaagtttattttaaatattacatttcatttattttgctttatttataaaaattcctaacggttattgtaacaaaggctccttctaaatagaaaggaaatacaaaactaggtcagtctagagcaattacctggattatgcatgactctttacatttttcctatcacataataagcagttagtaggtgttagctgaagtcttaaattttatcatgacgattacagataagattttccttaaaggaacggggcaaaataatcaagaaaaacttttgcattaaatttaaatagtacagaacttagtaatgtgacttctaaaggaatttactaccccttcgcccacccccacaaactgtcacagacacggcaacaaaacattattattacaggcgagttattgagacatggacaaagttttcagtcccagtgtttgtatgagccattcgtgtatctgttggaatgctgctacatgctagatgtcagcactgtccagaacaaatatgaatgaggtgtcattcctgtcttctgtctcagttttcttacctgtaaaattaaataatatgtctacctcaaataatatattttgagaattaaaagattatctaagtgcattgtaaactgaaaaggacttttaagaaacagtagtttgaatcaagaagatggactaagagcctatatctggtccacccacccctcctttttaaaatcccatgaagtgacagaaacaagttttgaaagattcctgagaaagaggaagtagatgaaaccaaacctctgaaaaaaacaaaaccacacaaaaccccattcaagagaagggtgctacaatggtagagtggcttagggaagatttaacccccacatcaatggctataaaggatagaaagaagctcagggtgttctcataactgattgaagaactgtctctgaaacagcaaggctagtctgctctgcctccaactcagtagttctgagtgcagggtaatggtgttggatcccagagtaaagctgtaacaatgcgaggccaaacctcgggtagtcccaccctctggaggacccaggagcccccagagacaaagcgtacgttactagcacatcccacctaatagtatattgtgtccttctccatagccaccagaagaagcctgttttaaataaggggtagcttttatacacaagcaaactgagaacctcaaaagcaaaaactaacacatatctaaaatttataaagcatttaagaaacatcatactcaacaaactggaaaactaacaccttgaataaacagctcacagaatagaaaatgattataaaataagtgactaaatcttagatggataggaagacatagcgttcataaagtccaaaccagttatagagttgggaatttagaagttagtagatggctagctgggcgccgtggctcacgcctgtaatcccagcactttgggaggcccaggcaggcacatcacgaggtcaggagattgagaccatcctggccaacatggtgaaaccctgtctctactaaaaatacaaaaattagctgggcatggtggtggcacgcgcctatagtcccagctactcccagctactcggacggctgaggcaggagaattgcttgaacctgggaggcggaggttgcagtgagccaagagcgcgccactgcactccagcctggaaacagagcgagagagtgagactccgtctcaaaaaaaaaaaaaaaaagaagtagctagtgagataggaaggaaaccaggaagtataacatcctgggagcaaagtgaagaaagtatgtcaaggaagaggtgtagtaatcagccacatcaggtagttactgattggtcacataacatgtggatgagcattgaccattgaatttagcaacttgaagttcagtggttgccttgataagggatgaaaagtttaagaggagtaatggtggtgattgcgatgaagttgaaaggctaactggtataatcctagaaactaaaagagaggaaatcatagagagtgggatatatgaagttgaagattgaagttattgctaatggcaagatcctagagtgtgacgtggagggattggctaaaggaggccaggtcagtggacaagaggagccagaaagttgagaggcctgcgtatttgaaggatcatcctcccatatgctgaaatcaccaggactcaggacagtgatgctgttgggagattgaaagctgggtgtttgttcagaagagtgaagcatgatggtctggaagaggcagaggtgtctgtaccttaggggagggaggagttagccacaaaaagaaaaatactctcctttcctctaggcccattgtattcaagccatttttgcattgccgtaaagaagtacctggggctgggtaatttgtaatgaaaagaggtttaattggctcacagttctgcaggctgtacagggcctcagggagctgttactcatggcagaaggccaagtgagagtgggagcggagaaagaacagggtggtgccacaggcttttaaacaaccacatcttgtgaactgagcaagaactcacttatcaccgaggggatgttgctaaaccattcatgagggatctgcccccgatccagtcacctcccaccaggccccacctccaacacgggggattgcatttccacatgagatttgtagggggacagacatccaaaccacatcacccagtgatatctcggctgtgggagttaaagaaaaaagtggagagggttgctggggaagaattgtcattagaggtaaatcaagttttcattgagcaagaaactttcaaagaagagattgagactatataagggatttttgctagtgatggagcatgaattccagagggtgcagtgacagaattgcaggggagggtaggagatgaggacagatgggggtatgcagaattttaggtgtgctaaagacaaagagcaacgtagtgatttagagcttcctgagctgacataaatacaagcaaaaggcctaatgagatagttccagtgaatttaaagtagaaattggtggagaggctcaaagaggttgcaggagtagaggaaagacaaatgtcaggagtttcttcttaaccccactcatagaggtgggatgacctggggaaggtcgacttcatcccacttgagtccttgctcagggtttgtggtcttcctgttgacctctgtagatgtagggtagaaggcctaagtagacatgaacttggtctcagtgctatgatttgttccttgacacctatcaggagagggacagagggacatgctgtctcctgatgttaggggctatttcttgactcaagttgatggaattgatgtaaacctctgggaaatccaggaatgatgctgagcacgccggcttcctttgacccgttgtaacggggtgggtcatggagagagggtagagacatggtcctggtgccaggaagggaagcccccctcttgatctgttgagagaggggcctccctgatccctttgatggagttgagaagtatttggcctaatgtgttttcttgcctgttatcaatatgaaaagttgtgtccataaatgaagagatttttagtgttttttccctttgccatatgttgaggttttagtttatcgctgggaaataggacatgtctttggttaatagacatttgaggtacaagaaacgaaatgctgtgaaagcaattcagatggaactgacaggtatgagaatggggcccagctgctcccagctcctcggcttgatgacagtcttgcaataaataatcagaaactgggtgaaatgatagcaaatgtcagttttaagttttcacttgtcaaaactaagattgtctcatcaccaaaccattgctggacctaatcctgctaccttttatcttcttgtgcattaaaaaacattctttaccctcatttttattatgctgaactgtgttatagcacctcacagtaaatttccagtctatgctcatgttcatcactgctcccttcatttaataaaggaggtttagtttggtcagaaaggagttgttaactcttctgtttattagtcacaggacctgtcatttacagttccaagttaaacaattgggaactgtctcagtcaaggaaatccctttcagttttatggtgaggttactcatttatctgtgcaacagagataaaattctcaagaacatcaaggttgtatttgtctgaggagccattatgatgtaacttctgacccttggaaagaagactgaggttcatttaatttagcactgagtttccaagaagcatttgccagtttattttcaacaaaatgagaaattatgttgactactgtggagctagatgctgtgaaagagccatggaagatgttagagctgccaggagacctgagcggcgtctagaccagcccctgatttggcagatgaacaggaagactcccacgtggaagccacactcccaaggtggcactgcgggtaaaggcccaggccttgactgacagctggcagacatttttgtcaaaagctttaattgagtctcaatttcaattctcaagacaagagaaatattctattaatactttaatagcattctcatatttaaagctatcatatcttaagcaggaaagccgtgttttttcttttgttgttagtttctgctggtttattatctttttgaatatgaaaattgatctgctctcttttcagttagtccctcttcttctcaccataactgtatattattccgtgagggaaaattaggactacagaaaggaagccagagagagactaaggcagtcacagatcactatgatcatgtggcagcatgtttcatgtgggcccgacttctgtttctgagcatgaggaaggatcattaaagccctagggagagcaaacaagagaagttctggaagagcaaaggccatgtcaaagtgggaaccaatcacataaggtgtccacccgtggtgagcaaaagccacctgtagcatttgtgttcagcacatagcagtggtagtgttctgagctttgagtgtaggtgctgccacttataagttgagtgaccctgggcagatggctcagcttgggcctcagctgcctcgtctataaaagcatagagtttttttagattaggtgagctcatgcacatgagaagttgtcagtagggcagtggtgtagctcacaatagttgcattcctctcacactcgtttttcttctaaatttttttaggaatgccagcccttaatttgaagaccattttttaaaactctgtggctacatgtacctctgtggaaaaattgcacattgctacttggtatattaggtcagctgtagtagtgactattctgtaatgtgttaagccagcggagcttaacacagcccatttcagagagcttattttatacagagagctcaaatcataacctccgtgttacaccgtatttaattagcttgtaaggatatgattaagccaggataacaaggtggggcctatattctatgtgtggaagaagtattctaaggaatattccggtccaggcatttgtcttttttttttttttctgtgatggagtctcgctctgtcgccaggctggagtgcagtggcacaatctcagctcactgcaacgtccgcctcctgggttcaagcagttcccctgcctcagcatcccaagtagctgggactacagacgtcaccacacccagctaatttttatatacttttttttagtagagacagggtttcaccatgttggccaggatggtctcgatcttctgacctcgtgatccgcccgcctcagcctcccaaagtgctgagattacaggcatgagccaccgcgcctggcctggtccaggcatttttcatcaatacttactatatttgattgaactgcttgttgacacctagattttccaacctgtttcctgcctctgctttgcatattctgtttcttctgcctggaagacccttgctgccattgcctctgtccattccttctccacctgtcttcaccttcaccctcagaacactgtgcaagcactgcatgctccaagccattcatgacacactacactagagtgatggaggtgccccttctccgtatacccacttaacatatgtaacgtgagggtctcctccaggccaaaagaatgagaaccagggcatgctgtcgtgggaaaccaacctcactcagggataccagcaaggttctctttggaagtggcatttaggttaagggcttgagttggaaatagcctggaggacaggagagaagggccttctggcagaaagagtagcaaatataaaaactcatgcccacatgtttgagataaaaaggaacatagctccattgcttacacttttctcataggaatggccatgctgtgccgtagtcattaaatgtgatgattagtctctggtgtcattttcctgagaaagaaaacgtgggggaaaaactccgtgtggttgtgaccacaagtctggcctgtgtagtcacagagattcagttatactgttctccatgcaatttagcctggcttcttagctcttctggtctgcagtatccttatctgtcaaatgggtatggcagttttactatccgaggccgggggtgatgtgggatctcagcggctggtgttcagtagacattcacagcaagcatctgtgctcctcaaactgtgacttcctgaggtgttaaacatctgagctggatcattttccattttgattagaaacctcttgattgtatgaaattggaagaatggggatgtttatttccatgacagtctaagataacaaattcaggatggtggtttccctacaaaatggagtgggaaagaggaaagcctgagagggtacatggaaactctttctcaaatactcagaatggttatggctgagtaatctagacttttcacaagtctattcctgtaaaaaattattcctagttcaaatacattgtatatatgtaggctgttttgcatcatctgcaaaatggcagtgagaactcttccctcttgctgtcagtgatggctctttcctcgtgctctctcaaggatgttgtacattggaacgtggatttgcctgtactttgaaaagatccttggcctcatgtaaccagacttgtgactggactgcagagatccatttccctgctctcctgtcccatgtggccatggctgctgagtcctcttttcccagcagcttccggatggtgatgcaacagtgccggtcaaagaaaacatttcatctgggcatttgtttttaatgtactataaagtacagcacccacaattcatgcagcaccaggttctctggtagacgagggtgtaagaagaaataaagtctttgccttctgtaaacatcccatctattggaaagggaggtgtttacctcctcccccactcccacagtgccttgcacaggcccagccctagctcttggcacactgggctagaattgtccacacacatcctccctctccgcagactcccagtcttcccaggtcaggtgctgtctttgtattccctcgtgcacttttaggcacttactgtgtgttgcgtggccaattgttgtggttaaaatgtcgaaacatatttattatgtattaaaattagggagctagacaagggtcctttgataatcccaaagttgacacttctgctttagaactctgtgatctcggtgggaatttctttgaattttcagtcctgcccttcattagttgtctttaagttttacaatacgttattgaatactgttgaaactcacagccagatgattttgtcctttgttttgttttgatcacttgcagtggtgctgattactatgattacggacatggactcagtgaggagacttatgattcctacggtgagtgactggccagagcatgtgaagagagggaggagagatggccgtagaaagaccttaaagatattaatgggaagagaataaggacatttggactctgaaacagcagcttcctgtcaattcatttgtgcatgtctagctatttttagggctcctttattatataaatatttaaagaggactaaagacttgctgaagattgcatgaatccagattctgaacttaaattttatgtttgagttggtcgccgtgtgctgattttctcacagagtagtttttcaaacttcagacacttgatagctgggtctttttgaagtgtctttgtttcctgacagtgaagggaaatgaagcaattgagactacagctctaaagtgattctcccaccttcatctttatgttttaattcatttccaatctcaaaccctctgaaaaaaattacactgggagtcatttcataaaggttacaaaagcactgagccaaggaggagatacagggtctgtaagctttacaaagggcagcagctaaacccctcttaattcagtggagctggtagagatgctggggacttcatgtccaaagtctcactatgcagaacgatgacaggtttaataattaaaagaattggcggcagcaacataatggtagtaagaagagcccttgccgcagggcaaggagatcagagaacatgaagcttcaatcagttgcaaagctctgatgaatccctggtacccggtgcaagtatatcaggattgtggttaatggatgttaggacatttctcttaacagaacggaaaaaccattttccggcgttaaaccttttgaagtgcattttgttgtatcacctgcctgaagctgtgatggctgcaccttggatttttttttttttttttttttttttgttatccgtaacaaacacttaagagaaatatgttggtttgctgaatgcaggctacctaaattgatgcaagttagcttgagggagtgacgttgattgcatgttttgtatcaaaagaagaggtcattttaagcatttttccttcacagctttttaaattggtctctgtggacacatggcttttaaattgctgtatgttgcagcagggatgttaactgtttgatgtccaagacttatagataactcattaaaagttatcttcaggctgaacaggtgtttaatttcaggagataaagatgatagaatgtccctggttattaatacctttgtccagtacggatttagcattatgatgaatgaaatctgacattatgtcgttaaattcatttcatattcatgaagtgctattgagaagtgaagttcaacccaatgcaactttccttcagtctttccgtgaaagcgcctgtgaaaaatgaggtcatatttccctttctcagtctgccccttcccgttttgctctccggttttcttctttgtcttcacagatgtttacctatgttttttctttgtttttgctgttggaagacatctaagtgatccttttcccattctctttttcactcataaatgtcctgatgtttagcaaaaggcagttctctttgctacttgagcttgtaaactgttgttaaatgagtaaccaaaaggaaagtccttgcgaagttggttaccatttcagatacaagaaccgtttatcttcccacgctgacgaattttgcgagtgagatgattatttttccttgtgtttgtaatttatttaagtaaattccttgtttgtttttcttttcagtacaccaggggtatatattttcaatatgacatgtacctttggttcagggctaagttagagtctgaaaaatgaagcctgtgggattcatggcagtgatctaattgtgattcatcttactgattgtagggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagtaatttttttctatgaacaatccctttttaaataaatcaaaatgcttaaaatctgaatggatggaacttaaaactactttgttgaaacatcaacctgggcagaaaaaaaaaaaaaaaaagacatgtaaaattttgttatttccagtctgtatatgaaaaaataggtcatcaaaaggaaaaaaaataactttgattaactagtgttaaacaaaaaataggtttactaaatatgttaatctattcttttaacataagcctcacctttcattttaaaggtttccatagaatttagttattttatctttcagccatatgctagtttttttttctcttgccaacatgcgtaaaaagggaagccaattacaagtgcaaataatgtggtattcttttgtaactcaagtcttgaaatgttctgtagtgttaagcaaagtctcctcttgcttgatactaaataaacttttgaaagaaattttgtgtgtgtgagctaacaatttcatgggtttttttttatttaaaaaggccttcataaatagttgtaaacagggaaagaattcatttaacaatgcttgtcataaaagggtcacactaaacattgtacaacttattttaaaaatggtataaaattaaatgtaccattatatactcaccatagatttaaatgctgtttaaagagtccaaatggtatcgagctgcttgagtggcacgttaaactacgcaaaaccaaatcttgtttaaaaactggttttaaaataactactggattttctgaaaaagatgtgatcagttttcatcttgttgagcgttttttcactagtgcaactttggattttttatgagaattttggtaccttaatgaacacctcgctccatgctggaagcactaagcacaaagcttttaaagactttctggcttgactaattgaggtcgcactcgccaaggctgagggatgtgtaacccttaaacggtcttcattttcaaaggtaaataaatcaaataagattttaatctcacttaatttatcttaatataactaataaaaccaggaagattacaacttagcaagtttcattatccattttagaaaagttttaagatcacctaaattctcattttaaaaagtttaatttgttttagtaatctaaaaagccttagtttagtcagtttaattggggccaattactccctattaaacaactgtaaaacctcataactagttatttgtaatacattatttggttagtaattgagggcacttcttaaaactgacaaatatttaataaagtttattctttaatcattaagcttttttaattgtagattgtgtaaaatgtttaatttttatttcttgggggatttttttctgtttatgttgagtaaaaaggtcttttcttttgttaggaaatgtcagccatcttggaatgtcacaggaactggttgaacacctgaagcaaacaaaggtaagtttgcctttttgttccaattatcctgacctgtgtggaagatgaagacaatttcacacttatctgaagtcacatggaaaatttcccctgctggtttcctagtacaacactagtgattgtgtcagattaactccaaaggtcagaaaagaagcttcctgaatgtaaacaggtcagacccaggaagcttcattataagcggcagagattggaggctcaggtcatcctgatatttaaatattcagattactttcttcagaaaatatctagcagtctagtcaatagcatgaaaaaaaaaattccagattattcagtaaaaagagcagtttgccaaatttaatatataatatcccaattttagttttctatgtgcgtgcataggcaaaaaaattacacagatatgctggaaatttttgacagtatttatcttagtcttatggaaacatggttttctgtgcttctgaattttatgaaacaaatgataagtattataaaatgtattttataaaaattacttcataaaatgtaaaaatctggggacctataaaggaaaagtattattatttttgtctctctttttacattttcttgattttttttctaaagcatcaaaaaatactacttaggccctgatcttccagagagtcttactttttcagtgtttgtatttgagctctgccacttagcagtgtgactttgggcaagtctcactttctccatcagttcagtgaaaatgatgcttatcccatgcagttgttagaagaattaagataatatcatcagagtgttttgtaacctgaaagtgatacaatcatgtaaagtttaattgtcaaagttgtattcacatatttaatatatatgaaaaatatgtgagcttggttttttccctaatagccaaaattagcctgaaataattaaattgcttttagaaagaaaataattctcatcatttttgtagaccaaactaagtttattgtattttctgtttgtttgtctgtttggatttttgttgttgttcgtttttctcttgtacggaatgggaatgtgacgtccaccacatctctgtagtgtgtgatgttattgaaatttttcacaatttttttctttattaaataatttttttaaggagttggcatacagaataataagaattatggagaggtagagggtcaatcctcaggtgctattcagagttaattaacaggaaatactgtacaattttatgtttattgtcattttttcaaagcttccatagctttatcagactgtaaaaggaattgtgacccagaaaggcccagatcactatccgacaggaactttcctacttggcctttgagatcttctcttatctggctgatgctccaccagacctgatttttttctatttccatgggaagaccctgctatagataagccagtcttctcacgtctctaagagcacatttcattgttcccaaatcgcttccccctaacctttgttttcacccccttggaattcatttattttctcatatggcagcatatatggaacatgagctccatactggacacaacagaggcactggtcatacaaagactgataagacatggaacccggtattcaaataccgcaaaaccgaatggaggtgacagccccatgacacacaactttgctattgcctgtatctttgcatgaagaaaccatacccgtccttcagaactcagccccatgccctctcttccatgatgtcctcaccagttaaatcaggctgtgatcctccaccctctctaaagagcatgcttggtttatatttcctcattttagtattggtatcatatgacacatattggttgtaagttgccataaaagccaagcatgtgcttatcactttctgtagattattttattgaatcctcacagccataagaaggtatcatctacatttttaaaaaggaagaaatttaagcttcaggaggtgaatttcacacttatgttgctcatgtaccttataactggtagagcccggatttgaaccgattgacttcaatccagagtctttgatcttaaccatgttgttatactgtcattctttatattacagtggctcctcccttagattaaaggctctttaagagcagaagcctttaatttgtgttaccttgtatcccagagagtatctcacacaacactgagcattgtgataactgcccccttctctttctctaccccgcccctgcaccagattccttcatggagagagtctttcacttgtttaggttctgaatcttcttatactcaggtattccaagtcaagtcagtatcattatttactcagatatatttcctgaacacctgctgtgttgcagatggtaggaagacagtgattaaagacatcattgttgtccttgcaagtgccacagtctactggggaaatgggcaaagaccacgtctgtaaagctctgacagagatacatgtgctttctaggcacatggaagggagatgtgtaacccaggcaagttggtcagaggtagcagaaggggcccatggagatattaagaccaatagaagataaccacacagggcaggtactctcagagcatccatacttccgctgtgcccttcacccgctttgtgaccttgagtcagtaagttaacctctctaaacaagagtctaaactgcaggttccccacttataaaatagacatagtctatgtatatatttatatatatatatgatatataaaatatcatagtcatgataccttagtattgctgtgaagattagaagcatgcctgggacaaataaaggtgttcactcattggttgctatatgtaaatatttgcaattataagaaaacatgatcattgaggaaacttcaggtatattagataattagagaaagtaagagaccatgctggctgggtaggacaagggacatgtaatgaagggtcttgtaggttctgctaagaagctcaaattcagtgcaaccattttcaagtgtagtatcctctttgcctttaagcttggcctactccattcccttgggcagatatagtgcctcatttagtctgtgttccaaaaagaactctacaagcttctgtttccactggttagtgattttacagtgccttaaaaaatagttgctctcactttttcatcctcttgtccccatctcttcacatagttatttgacagtgtaagggtttagtaagtgaatggtattgtcactgtgagcaagatgattcctaacaggcagtgttaggaacggttagcccagaccccaaaaaacccacacagtcatgttaacgatactataatttagatagtctagctcccttgtttaactcaaaatgaaagactctggtcactgtatacagagacaggttccagaatgtaaaactaatgatttgaagaaaaaataaaattgtagagtcaaaagttaaatgaaaatatgagacattttatagaatatgtgacaaatttaaggaataaagtttattttctgtgcaaacaatatctactatttatattgatattcagtgttttgtagggacagaaaggaaaaaatccatcattattttaaaataacagtctattttatgcctgattctgtttctatttctgattgggaaaggctacagatcatttttcaatctgaatttcaccctcccttatcgatggaaaatcccgtccagttgaagttgattctgactgacattcctgtttcaaaaatctcagtaatgtatttcagtgattagcatccattgctgaaatcatttttcagatcttaatgtgatgagtccttcggtgactttcaggataaagctcagcctccttggctctgaacctcaagccgtgtgtgattctgctgctggcctgcccagccgcctggagcacagcatgctctgaccccagcccactgtggtccagccctgatagattgaaaaccatctagagcttttctatcagtgccattctctgcctgaagtaacagttccgtaccccactcaaataaatgcacacaaatgaatgaacacaactcttacccagctcttggtctagctagctgttgctggcctatccagacttcccagtggagcttgaagcatcccctcaccctggaggccctccctagcctgccatcttcgcagctctactatggaccctcatcttgctctatgaattctgcaatacagcatcctgagattggctgtttaccctcctttcctcccaccagattgtaaatatctttagggcaattaccatgccttatgcctagtaagtggtaaatgaacaagtcgttggatgtatgagtgaataaagtggatgtggtagctcagtggctgatagtacaggacaatgtactaggtcttgtttggccttattcgattaaattagtcatcctttcatttgaggagaacttaccaggttattaagttctgtcctgtgtgtttatctcatttgaactgctgctggcgggatttgtgtgtctgctgcctaacacaggtcctagtacctaacagacagtcaaaacaaggagatagaataaacaaacaggtaccattgtgaagtgtgcggggatggtggtgttatcctgaggctagatttctgttctgcttgttggtgggtttttctccctgactgcaagacttgaagttccttaaagatagaagaaccatgtcttattggacttgtacttccaaatcctagcacactgcctggcacatagacatagtgggaactgacagggtgttcagtgaggaacgaatgagtgaacaaatgaacctgtaattcttgaaacactgacactgagcacttttcagtacagacagtccctactacaatagtttgacttagaacatttcccctttacagtggtggaaatgtagtacatgttcagtagaaactgtacttcagattttgaatatgtatcttttctgcagctagccatagtggtatgatactcttgccatgccaggcaatggcagtgagccattttgtttttcactttgagtacagcattcaaaaattacttgagatatcaaactttattataaaataggccttgtgttcgatgattcagcccaaccgtatgctaatgtaagtgttttgagtatgtttaaggtaggctaagctaagctatgatgtttggtaggttaagtgtattgcatacatttccaacttaatgtttttgacttacagtgggtttatgaggacataaccccgtcctaagatgaggagcatttgtattaatttgttttcttagtggaagtgtgatatttctctaaccattagatttttttcaatgataaatgcgaagttggaaaaccaaaatatgccctttatttagtcagtaatacatgtgcttggtacaaaatatatacacacaatggtgttaattcccacctttacccccacacacccacaggtaactatttgtattgattttcatgtatctttccagagatagtctgtgcataagtaaagcatttttttaaattatcactattttttacatagaaaacaatataccattttctccccttgtttcactttgaagtatgtcttagagctcattttctgttattttatactagaaagctacctttttctttttattggctgaatatttatatgaaagagccataatccaaacaactactgacagagatgtagttagtttctaatattttgctcacattaaaggcaatgcaagaagccatgtttataaacatctgtggaatgaatttttaaagtagacctactgggcttttatagatgtttcccatagaggtcatggtgcatcttcatatgcttttgtaaaagaaacctatctaaatgctacatgtattcattatgatctataagattagctcctgtggccacaccagaaactcatctgctcaaaagttggtttaaaatggtcttttatacacagcatggcgtctggcatgtggcaggctggttaccctgtgtgatttagcgaagagatgcagggcgtgctgggtccagtaaggacacctcctggacactcgtctgtgtcttatggggagagctgaaagtcctgcgacccttcctcagactcctgctggtctcctcgcattcctggagcttatttacatcagcaagtgtattgttaagggctggcccgtggtggggcaggctttgtggaaagtaaggtggccacaccagggtagcaggagaggccgacaggctctctgaggaaacagacaggatctcctctagcactcccctgcacgggctcattgcccaccctctcttcttctctggttatccagatcctcccatttcttcaagatcttttatctctctcagccaaaagagccttctcttctctccgcatgagaaccctggctgagaggactggattggcagatgtctcattctgaccctgccggttgatgggatggtgctgtgtaaatgtccttcatcccttgtatgctccttgagggtcacaggtgtgtctgtcacattttataaacctgaaagcattcagcacaagccattcaagaaatatttattggttaattaaggcaatgccctcatcaatagatttactgtattagatgtttaactttttagaggattcacctttaaataacagtttgcatctgattcatcctagcagtactgatgctttatgcaggtgacactgagacgcccaccgtgtccctggcactctgcagcaataaaaggctagagaagggcagggatggtgcagaggagaaagggatgaacttgctccgaggacaaaggaagaaataaaacctgaatggagttttgaaagtcgaaatcttgcaagccaggaagggaggagaaaatgtgaagacataataagctaatacaggtgggagaggagggtgtcaaccaagacatgaaatggcgtcatgtgttttaggaacgtataagcagctgctggaatataacatgctgggagagaaatgaaagagatgcatctggagacagaggaaggggctgggtcctatggagccatcggcgatgtcctgagttgttttgagcacactttgtggtatcaaacacttacctagggcctgggacttgtatgaccagagtcgtgagaagtcaacatcaccacaatggccatttctctgctgcgattgggttttttgtttgtttgtttgtttgtttgtttttctgatcaccagccagttttttaaataacagagttttgtttcgtatgacacatcaaaataggttctttggggttaggtaatacaatttaaaatatatctgaaagttcagtctcttatcaggtgacaagaatgcaaggactctgccagggtggacccctaggaactcataggttaatatttgaggttttatgtaaaacaaggcattgccatgctgaaatcactccatgaatatcataatggatagtagtgtaatcatcattaaaccagttaatcatttgtctgtctttattgaacacaaatattttatgtccttaattttaacgattctgttttgcattgttttccataaacgtccttatttctattaagtgtccacttgcctgaatcctctaaaccctgccattcccaacagagcatatggttattattaatttcttgatatatacaaatatatttcattttcctctctttcaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattgaaatctcttctactttaaacctagaaaaacaaagtcttgttatttcagcacagctctaaattgtatacacttgaaaaccatgtacagctgcaactcactgcaagaagtcaagattctacacatattccacatttgaaaatgatttatccatctcagttatggactaataaatatgaaagtattatgcaaaaagtattctgtcacataaaaggttaattataaaggcttctgcgggaagctgagtggcactgtcagaatagaaacatgattttcatgcctcagtgtaatttgttatggaacataaaggtcataatccctgtggacagtattattctcttcattctcttttcatcatttactagtgcattgtgattttaattcaatatgccccgggaggatgtgttgtatttcttctgttagaagctcacacaacatgttccctggacttggaattttaagaactgtcttgcacattgttaaattgttgctttcttgcctcaaagacacatttttttgaggcattcactttttacagcatgccatgtttggagcattgtgttaacgacagaatgacttcaaatagcttagctttttcttatcctcgtatgcatcctaaaacataattcttttgtaccttttagatgtgtccagtacacatttctctctcagaaacgcgtagaatacaagcctgtgtgttagagcggtggctctctgcggcgagtcgggtgcgagagtgaagggtaaatgtctgtcatgagggcgagctcaggagagctacggacagctaggaagcagcttcaggcaccctttggttcagaattaattttaaacaaataggaactttagaatataagtcagactatggtaaattgaaaagaatttgaactttttttttgcttgcttcctttttacctgctgagtctctaatacaattcacaaatctacaagtaaaatcccatggattcaaaccttctgacttaacttccatctgtccccttctccttgatcccactcctacaacctaattttggcttcttactttactgcctacattatttaattcattaagcacattattgagaacttaactgctgggtaccgtctaacatactagagagagagcggagaaaaaaaacagaggcggtcttaccctggagaagcttagatccccctgggaggaacaggccaaacaccatgagaatgtcaggtgctgacggagccatggagaaaattagaccatggtaacaggaagaagtgctagactttagtttgagtaggcgaggtaacattttagcaggggccataaaaagtaaagaactaagctacattaagagactagcaagtgcagaggtcctgaggtgggagcatgcttgggtacttgaggaccggcagcaaggatgccagagcagaagtaatggagtgagcaagggacaaagaattaaatgaaatcagtgggctggttgggggccagagaataaagtgccagtgttgagctttaatgggagctgatgggcagatgggaggaggagttgacaagcacaggagtagtgtgatgcaatgtgcattttaacagaaccactctggcagtgtctgagaatagcctatggggcaaggtggagagacccactggaggccactgctatgaaggtaagaaggaatgctagcatagtccggggtggtagggtgtaagcactgagaactggccagacttcatgtgtattttgaaaaagtaaagccagtaagacttagtgcacagattggttgtgagatacagaaattaagttggatgatccaaagatttgggtccagaggcactggaaaactagaattgcctctttctgagatggggacattttaggaggacaaggtgattatgttaagttttgagatacagatctggaggtgggagagatctcagctggagatagaaatttaagaaccgtcaaaatatagatgtcatttaaagctgtagtttgagtggagatcagagaacagaccatggaatgtcgcatcacttgtaagtcagtgagatgaagaggaaccagaaaaggagaccaagaaggagctgccatgaaggaagaagagaaccaagagtaatgccctggaagacagctgaagaaagcatttcagggaaaagggatgtgatcctttgctgcagatagataggtcgagagaaatgaagagtaaagattggacacacacagtaataacagaaaagtcatcggtagtcttgatttacttcatagagcgaaggtttggaacagattcaagaagaatgggaggaaaggaattagtctagtcaactctttcaaggatcttgctttaaggaattgttggagaggggtatagagttgagagaaaaagcttgagtatgtaggagagataagtgagggttgctggagagatgtccatgagcaggtctgtgcgcacacattttgtgcacgcacggcctaggtgggtgcagaagcaggaaggtagataagacagagggcatagcactcatcatgccaataggttccacagttctgctgctgccaaagctatatgacgtagacattaaatggcgcatgttctaccatgaccaaaatacttcagagcctcctacagcttccaggctaacttgcagatttcttgggttatcacacacgttccttcatgattttcctcctacctacctctttagcctgaaatttccactatggtaactatcaggtaaattctaacttctatgccatcttggcattgctatctgtcgttttattcaagattttcctgctctcgatagaatgagtgattttcaaccagaacatggacattttaggtattaggagattctggatcatatttagatggcctccttagggctttagtgagggaagggaggtgctgccttgttcctgccaggtggaaggagaaacagtccaggttccccatttggcctctgttgacaaggggagggggaaggagggccttcttgttactgctgggtaggttccaggtcttaaaaagctgccactgataccaccctgactccactggcatgatatgtgggggtgtgatggcctcattaccactgagcagtggatgataaaactgactctccactacgcctctctgacaccaccccagctgggagggagtagggtgtctccttactgccacgtggaggtccaagtttttcccatagtgtccattgacactattgggtatcatcaccaccaagccgacatgaaagtcctggctttctgcttggcgtctctggcagcaggcactgttccacacccgcatgtattcttcactagggccactaggagcggcttgtagctcttcagattggctgatctttttcacttcttcacatgtatcctttagctggtccacctcactcggcttcctctaacccagtgattcccaactttttcagggcatggcacgtaaagaaaattataatatatacaaaactcattggggtgagtggaggagacccagagcttattaaccctaacccagccccaagctgccccagaagctgaagaaaatcaatgtttttgtacacctttcacccattcacagcacagtgaagctcccaagattttagccaactcattcttcaagacttagccccagaaactctaacccacaacaccccatacctatgtcatcagactatgttagagtcatcctaacagtttctgtcctcccgctaggctttacaagcccttgtctcagtcccttagggctgctataacaacataccttagcctgggtaatttattaacaatagaaatgtactgctcacagttctggaggctgggagtccagagtgccggcagatacagtgtctgctgaaggcttgatctccacttcaaagatggcaccttctgtgtgtcctcacatggcagaagaggataaaaggatgggagcttctgtgaccctctttcataagggcactaatcctgttcctaagggcagcctaatgacctaatcactctttttttttttttttctggataccgggtctttgctctgtcacccaggctgacaggcagtagtgcagtcatagcttgctgcagccctgaactcctcaggtcccacctttcaatactatcacattggatactaggtttcatcatatgaatttagggggacatcaacattcagaccactgcattctaccactggacccccaaagttcatgtcctcacatgtaaaaatattcatttcactccagtgaccccaaaagtcttaactttttccagtactaactcctgagtctgaagtccacaatgtcatctaaatcagatatggttgagactcaaggtacaatttattctgatgcaaattgctctccagctgtgaaatcaaatgtggttccaaaatacaatggtgggacaggcataggataggcttccattgcaaaagggagaaataggaaagaataaaggggcaatagatcctgaccaaatccaaaacccaacagggcaaacatttaaggctccacaataatattcaactcaaagttctacattctggacacactggggtaggagttgggcctccaaggatccacagggctctacctccatggctttgctgggtgtaacccacgtggcagcgctcacaggttagagtttcacgcctgcggctttctcgctggagtttcatgccggtaactccaccagtctagggtctccagagtggccctgctcccatggctaccctaggtattgcattaaagggggctctctgctgtagtcctgcccccacccacagctccactaggcagtaccacctcccaagatcttcaaatgccttcagggtcattcttccattgtcttgatgaaatgcaccagactttgcccattcatgctaatctccttatcaagtggtctctttgctacacctttggtatgagtctctcatgaacacattttctcattctctgcaggctgagatttttccaaatttttgttctgcttccctttggattataaatttcatctttgtttcttcttgcattttactataagctgtcaagagaagtcatgccacaccctcaatactttgcctagaaatatttcttctgctaaatatacaatttgatcacttgcaacttctaccttccccaaaacactgagacatgaacacaattcagccaagttctttgccactttgtaacaaggatggcctcgcctttagtttcaagtaatacattcctcatttctgtttgagaccatcagaatgaccttttccatccatatttctgtcaacattctgttcacagtcatttaggtcatctcaagaggattgaggcctctacagctctcctcttctgagccctgaccagaatcacccctaaggctcctgtcatggcagtatacctcaaaactcttccagcctctgctcattacccagttccaaggccacttcacatttttaggtatttgttacagcattaccccacttgttggtatcaattttggtcttagtttgttggagctgccataacaaaataccttaggctgggtagtttgtaaacaatagaaatgtattgcagttctggaggctggggaatccaagatcagggcaccggcagattctgtgtcttggtgagggctgctctctacttaaagatggcaccttcttcgtgacctaacatggtaggaggggacaagggagctcactcaaggccctttcagaagggcactaatcctgtatgaagatggagccctcatgacctagtcactttgcaaaggccccacctctgaatactgtcacattgggtgatcctgacccacagcctctcaggaggtagtaaactcaactggggccgcagtcatctgaaggcttggctggggctggagaatccacttgcaaattcagcttccactcacaggtctgttggccagatgtctccactccttgccacacgggcctctctggaggctgcctgagtgtcctcacaacatgacatctggcttccccagagcaggtgttgcaagggaaggagagtccatgtgaggggcacacaagacagaagccacagacttttatactctcatttcagaagtgacttcacatcgctcctaccacatgcaatttgttaaacaccactcctgtgccatgtaggagaacacaagggtgtggatgccaggaggcagggccacggaggactgtcttggaggctggctcccacctgggcaaggtacattacatctctgtgccttagtgtcctcactacaaagcggcgatagtactgcctacctcaaggggttgccagaatttagtgatatgcctgccaagcccttaaaatgaggcctgacacatagtaagcacttgatacctattggccatttctatcagggtaatactcccgcaccacacacacacacacacacacgcacacacacacacacacacacagaaccagtgtagaatgttgaagccatcccttcacctcctgcagttctgctgctccactgatcctccatgccggatccacatcttcccctctttcctgccttggctgggggccacatcatttctgcaagatgattgcagcatcagcgacactcctcaggtgtctattccatttgtaacccatctgtaatttgccctttatcatgccttctattaatcttcctaaagtgcaaatcattttcccaaccccttacacccttttaattgcctctggggtaaagctcaagctccctggtttggtcctcatgcccttcaccctctggcccagcctccctctccgcgctgctccctccccatattccatgcccactggactcactgtgttccaacgctgcagctggccccacacacctccatggtctattcttacccacggcgtccaggtcctcctcacctgcagtgtcactcgatcccaaaggcgtccctgaccctgtcagagatattccttcctcttcccaacatgtgccccgagagcccagcccttccatctagtgggtggtttcacgctgcgcggaggtgcctgccttgcgtgtctgcctctcccccaacccagcgcctggaacctggttctggatgccccagtgtccccatcccctgcatctgcctccctaggtgcttccccttgtccaggcatagagaaaggtagaaatcttgcaggtgggagggtgtagtgaggagcagggaacttacatttctcaagcacctcctaagactcactgaagtcagagcatcctcccagaaccacataaggtgggtgtgtgtagcctgaactggaagacggcgaaacagactggtgatgaacagccacccgaaaacctcacagccactgcctgtggagctgaggtctgagccccaggcttgccggccaccgcacagccttctaggagtgttaggccatcaacagcagtgcagaatataaaaatatagaacacatttttatagcacaaaggagtacagttttattaattaacatcagaagatttcattgacaagagaaatgcttcccatgttccctgaaggcgtttagataattttacaaatggaagaaatgttgcagtttcagatattggcgaagctcactctctgctctgagtccctttcaaaatcccaaactctcgtagccagtgaggggcccattaagaacggtgcatccacatagccagctcaccaggaaaacagggacatctgctaacgaatgcaggaaactcagaagtctcttctactaggttgcatttttgctatttaggtatctttcttttgaggtaacagacaaacagagatacagagataaaataggtacatacataaaattgaaaagggttggcatccctccatgtgccacacagcagaggctttcgccggttaccacatttcaggagctactttggagtggtggggttttcatgaacccagcgtttgcactggggctagaaatgcagtgtctgctcgccggcaccttgctggctgctgcagaagcagctgctgctcggggtgtgggggcctggcctaacattccctatgggctgtcggctgtggttctgcagaagctcagcatggacttgcaggctgcagcttcctcctggctggctggcgtgcgtggatccccttggcatgccacgaagacttttccttttggaaactgcccctccttctctcacaggtactcttttgtgtcccctcttcctctcctgaggcagcagcagtgtagtgccttcattcaggcactcgtactgcaagacctcctctgtgctgacacgcctcccctacgtcacacagctagtgggtggcccatctttgcaacgaaaacctggcatagcactggccttttgaggcgtgttccctctaaggcagtgacctccaagggcggggtgaggacacttacacaccagcaggagccaagcgaaatgcttgctaagggagagaatgtgcccatggcttctccccttccaccagcacatgtggccaagaatctgccagcggccgctcctcatgcctggtgcacctgttgagcatttgccaccacttgtcatgcgagtgagtcacagcctgcctgaaactgcactgtctctgctggggctttaccccggtttccttggctggttctccatctccctacctgctgcttcctgagcccttgcccgcctggcaatcttcctagccttcttccctccagaggattccggccccctctggagctgcttaccagccttggtcggctgcctaacaacaggaaccgagaggctgaccccagacactcttctgccagtttcttccagtctttggccgcatcagtgtcagatacagagtgtgtccaggccggcctctgatgtcctgttactggattggttctccagagccaggctatgctttcaacttcttttcccatcagtcagctaagcagcgtggaagatccctctctgagcctcagtcctttcatctgtaaaatggagatacttccttacctactctagaacgttactgagggactctcaaagcctgagattggtaaagtgggccatgggcagtagaaaagttacatggaaaacaggcaactgtgcctcacctattcattcaccaaacgctgatgtgcacctcctatgtgttggcctctgctgggtgcaggagatgtagggaggaaagacataccccatcccgagcagctcacaaactcagagggagggagagaagaggggaaggtagacaggagagtcacagacacacacattttctaaaaaccaaaaatcagacaaagactgtttagctctctagtctaatatggtatgtcagctgaacaaaattcagggtgatctcaaacaaaatgctgtgatgtgctaatttgttctctacccctgacttccccaaaccatgcccctggggaagcagcctggagctgtctaggggagatcagcatccctggccaaagagaattcatccctttcacgaaaacactgcggacaaagggcatggtttccaaaaatgtcaaaagatgatcacagaggtaagatcagaaatcttcaaaagcaggaagcaaaaggcagcacagcccaggcagctgaggctcctgctgcctgggcctctggccgcacagcaccgtctgtgaagcatccctagaggaagcttaaaatccgaggcagttcctggagtgctgggcagcacaggcctcctcctgcgtactctaggttgggagggatccggtgttcataatggaaaccaggagctttccacatgaagaacacaggccgcattaatcattccaaagaccacactggcttgattgaggtgagctgttccttccaccccttaattcctccagctcaaactaaccgctgcaactgtattacaggatatttatttccccagatctttttttttttttttttttttgcctacacatctattatactgaataattaaggtcaaattgtagatacttaaaagaattctttcctattcaacactattaaacaacatgcctatttctctgcttccacatagccaacaacatgttgcttttgggccacactgtgttttaggtttcatttatt

SEQ ID NO: 401 - DNA, 1824 bp, Homo sapiens
gcgcggcgtgcaggtcgcagctgtggctcgggtgctggcaggtgctggcgggactggcggggatcgccgtggactgcctcaggggcgccgcagcccgctcggcccgagggcccgcctaaccgcgccgcccgcgcccgctcctcctcggcccgcgcccggagcgcgggggccgccggcgctgggtactcggcggccaccggggatcggggctgagcggtcggttcccgcccccgtgccgccgccgccgccttccggccgaccgcccggcttggccgctgctgccgcgtctggcccccgggtccccgccgctgggggcgcgggcggggtcgggggttgccgggcgccgccccccgtgcgcctggagtccacatcccgggcccggcggccggcgagcatggaggagaagtacctgcccgagctgatggcggagaaggactccctggacccctccttcacgcacgccctgcgcctggtgaaccaagaaatagaaaagtttcaaaaaggagaaggcaaggatgaagaaaagtacatcgatgtggtgattaataagaacatgaagctgggacagaaagtgttaattcccgtaaaacagttccctaagttcaactttgtggggaaacttttgggtccacgtggcaattctctgaagcgtttacaagaagaaaccttgacaaaaatgtccatccttgggaaaggttccatgagagacaaggccaaggaagaagagttgaggaaaagtggagaagcgaagtacttccatctcaatgatgatctccatgttctcattgaagtgtttgccccacctgcagaagcttatgccaggatgggacatgctttggaagaaatcaaaaagttcctcatccctgattataatgatgagatcaggcaagcacagctccaggagttaacatatttgaatggtggttcagaaaatgcagatgttccagtggttcgagggaaacccaccttgcgtacaagaggtgtaccagccccagcaataaccaggggaaggggaggagttacagcccggccagttggagttgtagtaccacgagggacgccaactcccagaggagtcctgtccacccgagggccagtgagtcggggaagaggacttctcactcccagagcaagaggagtccccccaactgggtacagacctccaccgccacccccgacacaagagacttatggagaatatgactatgatgatggatatggcactgcttatgatgaacagagttatgattcctatgataacagctatagcaccccagcccaaagtggtgctgattactatgattacggacatggactcagtgaggagacttatgattcctacgggcaagaagagtggactaactcaagacacaaggcaccttcagcgaggacagcaaagggcgtctacagagaccagccatatggcagatactgattgtactgtctgatgttgtgaaatagccaatctccaccagtcctgtatactgttcaaagaaatgtcagccatcttggaatgtcacaggaactggttgaacacctgaagcaaacaaaggaactttccttctatttatgcactgcttaagaaccgtcaactcaccaacgtgcctagtcagcaaatgaatccacttgggaacttgaaaaacatcttaattaatttttgtttgcataattttgtgttctgtgacatgtttttattatatggtatgcttttaatttggagaacctacttttttaaaaaacggaaagaaaatctatcttattttgttgactcccaataacaaaaagagaatgatttgtatagtagttaataaaggctgcctattg

SEQ ID NO: 402 - protein, 346 aa, Homo sapiens
MEEKYLPELMAEKDSLDPSFTHALRLVNQEIEKFQKGEGKDEEKYIDVVINKNMKLGQKVLIPVKQFPKFNFVGKLLGPRGNSLKRLQEETLTKMSILGKGSMRDKAKEEELRKSGEAKYFHLNDDLHVLIEVFAPPAEAYARMGHALEEIKKFLIPDYNDEIRQAQLQELTYLNGGSENADVPVVRGKPTLRTRGVPAPAITRGRGGVTARPVGVVVPRGTPTPRGVLSTRGPVSRGRGLLTPRARGVPPTGYRPPPPPPTQETYGEYDYDDGYGTAYDEQSYDSYDNSYSTPAQSGADYYDYGHGLSEETYDSYGQEEWTNSRHKAPSARTAKGVYRDQPYGRY

SEQ ID NO: 403 - DNA, 28871 bp, Mus musculus
  misc_feature (1)...(28871): n = A,T,C or G
tttcttggaggaaagcataattggttaaggttgagaggtttggggtaatagctcaaatctcctaatcagcttccatcactgtaacaaaatacctgaaacgatgagcttttaaagaggaaaggtctgttttcactcttggttttagaggtcctagtccacggtcacttgtttgcattgcctctgggcctatggtgacatagaacatggtggagagggtgggtacagcaaagccaggaagcagagaagactggcaagagggtcactggttcagtgaccccacttcctcccaccaggccccacctcctcaaggttgcaccacccatcaatagcataataggttatgaccaagtttcttttgtatgtgacttttgagggacatttacaacccaaatcataacagccagatacagaaggagggatctgagcctgttcatgaagatccagacccagggttatttcctatagacctactagctatcatggacctgagaagaaaaagtcctgccctgaccagaccagcaatgaaagacatggggtagcaggcaaaggccaagtctggggttgagcaggaaattcgagaagtagacactggagacattctggaacgtcataccattttaccaagaatggtgttggagctctttctgtggtctctagtccctgctagagtgctgggtctagtgcgaaactggtttcaggaagagtctgttccttgtttgtttgaggttctgacaccactgatgctaagcacatgtcctaccactgggctccagccccagctggaaatggggactttttgctggggtagaggtgggtgggggagaaagaaaccagctagcaagcatttcaaatacatggcttttgtttctctgtctctccgtctctgtctctgtctctctgtctctctctgtctctctctgtctgtctgtctgtctctctctctctctctctctctctctctctctgtctctgtgtgtgtgtgtgtgtgtgtgtgtgtgtagtgttgttttgtttttcagagacagggtttctctgtgtttgccctggctgccctggaactcactctgtagaccaggctggccttgaactcacagaaatccacctgcccctgcctccctagcactgcgattaaaggcctgcaccaccaccttgtttcagtctcttcaaagtaaaatgccagatggtgatcaaatagttagccgaggggtgggaggctgctccgggatgaaaggttaacttctgcggttacctggtgttccctgtgcctgttccctggatgttggctggagtccatgtgactcttagacacgtccggaagccaaaccaaacaaactggagcagccagggggaccgtaaacctggacctggacattcctgcagcctgagctgggccagctgctgttccacgggacaggcagtctaatcagacagccctacctactactccactacaccactacagtccagtcccctgcgggagagaggcagtggggcccagggatctttcagcatttgctatgtggcagctgttactttgttttcttctcttggcttgaaaggctgggaactcagagccaacggaacagcaacaacaacaataccgagtttccacagagtccctgtggacccagcacctggccagtgctcaagagcgccctagcaccaatggtttcatcaccctttaaaagaagttctggacgggtaaggcagtcactcccaagtcactccctgacaaccactaatctgctctgtctctacggatttgcctagtctgaatatttcatatcaataggcatagcctgggcccttctgtgtcttgtttctttctcttggtccaccactgtttctgagggtcgccacatcaccaagggttcacacttgacacctcttgatggctgggtaggattctcttgtgtgccctgcccccacattttagccgatctttagctgacatatacccaggttgtcttcactttgggagaggttgtgcggttgtaaatcatgctgtaatgaatatttataagcaatttttttctctccttaaactgttttcaattttttttttgatgtaaccctaagagtgaagttgctaggtcagagggtaatattatgtttgacttaaagtgaagtctgggtacatttttaaacaatgtcagagcagaggaattttttttgggggggagggggtttaggatatgtgtgtattcttttataatgtagaggtgggggggggcagaggtcagcagggagatgagtcccacaagtcctctccctacttgattcttctggatggtggtggtggtggtgcccacatgcgtggcagtgcaagggtacccctggaggccagcagaggcatttgtgagctgctgcatatgggtcttgggatctgaactctggtgctcatgatagagcggcaagtgcccttaaatggcaagccatccttcctctctctcaagtggaacagctgcctagcacgggctgccacagttagggaggatcagactccagagcagcttctggtaaggcaagaaagttgccccggttatcgtgggcaggtgggcttcagaaagatggatttcagggatggggaacatgacacggggaacacgacaccctcttgctggcgacagggatgcttttgcacgttgttctggtgacctcagaaatgaccataaaaggtgaagttcttggtgctttgattatttaggggatttctagcaaccaaataaaaacaagagtgccaaaaatgaaatgcagaagttctaccaggcctgtgacaccagatggtttgaaataaaacacgcacatgctgagttatcttcttccaggtccggggttgtgaagacctcttctgcgtctcagatttgcctgtgcgtgagaccgtctgggagtccttggcgctttccttggcgtgttcagagtataaactggattaggtctcagcacagacagatcaccatcgtagcagagcccacatgatcgaattctaactggtcacagtcctttcatttgcagataccatctaaaactgtggatttctcatggaaagtctcagcgatgactttcgtcccttgatccacttgaagtcctgtctctgaggggcacagaagccaaccagtgacggcagagaggagtggcaggaaccaggaggttgactggggaaggggtgctgaggaggatgggggtgggggtggggcagggaagaaggaatgttctgtgttgtgagagaggtatgggttacagaggcaaaaacagtggccaagatatgtgtcaatcataactcagtcccagttaaacacccagtttaaagagctgctcgatgcttccgtttgcctacctgtaaggtggaaacggcagcaccatactctctaaggcagtgctgggcgattgaacgatgaggccgtgcatgctccctgaggctgtgctatgcagctaaccgttgtgggtggtggctgttatccttacaatttctatgcaaaaggcagtcttcactgtctaagcccttgttcctcccgccttgatttttcggggtatctcctccctgccatagtgtaattccacctgcctccaaatctgtatctcttcttccattgcaaagtagcatgacccagcctcaagtctgtctctctctgtaatggctttgaccccaactacccaaattccccaaatactcttctaagagggaccacagtcttcgctgagctggccctaagacttccttccactcagtctcactgatgttaatatggctattattattattattatcatcattatcaccatctaaaaataaatcctgtacttgttgccacacttgacgagtggggcctttgaatgtccatccagttgcgtgtatcaggccctaacaggtaggtctgagaggcttcacaaaatctgccctttagcggggaggcagctaggatctccctgagtagctcacgctgacctagacttgagatcaccctgcagagatctccggagttctgtgtgccaccgtacccaactcatctgtcctttgtaaagtatggatacttgtaaactgaagttgcatgtaaatgcagtcataggcacaaatttatttatttggtcttcaagacagagtctctctgagtagccttggttgtcttggaactcgctctatagccaaggctggtctcaaactcacagagatgagcctgtctcagcctacagagtggtttaaaggcttgtaccaccacaaatcttaaacacacaatttgatcgtttgtttgtctgcagtgctacggatgtaatgcagggccttgtggatgtcagggaaatgctctactacagagctatccctctggccctaatttgattagttttgatgccagagtaagccatattctaatcaaaacagagggtagatcctcccctagatatgtttctggtgccttgtagtatgctgacagaattgtagcccagattcctggggaaaacatattgatgagctctgtagccatttaaattaactaaaatttatagcaatcaaggcgggagtcctgaaggtccctgaggtaacttgttttccgaactatatacaaaatatctatttataagcctgattctacaactaaactgctagctctttagaaatctctttctatctgtgtcattctacagagctagtctacctttctcttgagatcctccaaacccaagtggtcctgtcctgccagctgcttctctgtggttcctgcaagcccagagagagcccatctcttacctgcagctcctctgtaaaggttcttcaacgccaagagcaagggagagagcttcagagtgcatgagagcaagagagggcaggaagggagggagagagggaaggggaggggagggaagggggagagagagagggaaaggggaagggcggagagggggagaaataaagaggaagagagagaactctattaaaggtccaattgattataaaagaagtttctagttcctcccctcatcttggcaggctgaaccatatccccaccttgatgggagatgggggtgactctaaaccaagtggtggggtggctcaaagccacccagatgacgctgcctcaggtcaaagagcaaagaccacaagacctctcccaagcaacttgccttaaaataggcagggactttcaattctttagcattcttatctatggaggcttttagaagcacccccaaatggcatctcttcaggacacacctaactgcatctgacaaacgcagtatctgttgaggtttttatagtttggtaacatctaggtcttctatgtgcaataatccattgtcctgtcacagatctccagtgcttgttgatctccctggtactcgtactcagacatggtcaatctccagctatcagtgtgccatcactgagtcagcgctgggcagagagactcacaatgagtcttgatgaaccaggacaaccgggaccataactgtaccccactcaagcccatgcccactgccctgtgtcctcccaagggagctaccatttcctgtcatcctaggatacttttgcatccttgagttccccatcctgaatggaatggggatgcatacctggggacctacactagccattgggacccatggagaattcgtttcagggttccttgtactgaaatcggtggacgttccagtccttcacacaattgacaaacacctgtacagaaccttcacacatcctcctggggactggcagtcatctctagattagttaacagtatgaggtcacagaaattgtctagggaatgatgacaaaaggttccacacagttcagtacagacacataatacttgggttttgcttccattttgaaaacagggtattgttttgtagccaagttggccttggacaggtgatcttctttcttcagcttctcaaacactggggttatgggtgtgtactactatgcttggctcctgacacaactttttaaaaagatgagggttttttttgccggccactcctggctctgctgtccagtgatctgcagccgcacactaggacagaccagtccaatcagagggttgcctgtaacatctctaattgctccagtgtcacagcaactctgcccaacataggtgacagtatctggcaggagtcttctctcagttacctctcatggaaggggaggagggagaagaggggagcaagataagcatgggagggtgtgagcccacagtgagagaaggaacccacacctgtgatcatcgagtccggtcagttcacatcacggcataatcagatcttaagagccgcacctctcaatatcctccgatggcaattaaagtttcaagatgagtttggaggaggcaaactttcaaatcctggcatcccttcgaagaagaatccactgggtgactttggtttcagaaccaatcagctggagtcactgctgctctccaaatactgatggttagtattcactgagccctcaccagatactgggctctgtctgtctccagaacccaatgatggcatcctgtgtcagcctcacagtcgtggtatgaaattttaataattaaaattaagtagctaagaaaaattaggtacggaaaggctaagtaacttcctaaggccacacgattagtggcagaagttgggcttgaagacaggcagtttggctcattagtttaaccacagaggtataccccaccccctatacaaattctgtataaagttgactagtcccatagatattaaccgctaattgttatatataacatttatatgttattatatattatattatatgacatatataacaatatatattatgtaatatatatgtgatatatacacatatgtataatatatataattggaggaatcatagctcctccaaaaatgagttgatggctcagaaggtaaggtacttgcccctcaagcacaaggacctgagcttgaatcctcagaactctaataaagccagatgctgtatctggtctctgtaatcccagtgctcccgtggagagatgggaagcagaaacagaaaaatccctggaagcatcagaaacaaagaaagaaccaagagaccctgtcttaaaggaggtggaaggtgaggaccatcctctgaggttgtcctctgacataagtgctgtggcaggcacatatccatgttcatatacatgaatgagtatacacagacagacgcatagatgcacagacacggacacacacacacacacacacacacacacacacacacactcttttaaccctaagaagctgaggctgaaggatcacaagttcaagaccagtctgggctacacggggagtccctgcattcaaaacaaaaaccctgaggcttttgcattctcttttgtatttctattatcactgtcccatggctgttgccccttggaattgtagggccaggaagagcaaggtcacatcacgcttatctttctatccttggcaatttattgagctaaattaagtgtttttcaaaacacactgtaagcagaatccagccttcagagagggctgtttcacagggagataaaatttaagacagaaacaaattggatgtgcttttcttcttggggggagggaaggtaaagtcaacaacacagaaccccccccagcaaccccccctccactactgaggctcaaaccaagaacctcatgaatgttagacaagcctggtaccatcaagtgatattccaagcccatcctttcccagtagtacttcgtggaaatggacaagctctcttagggatgctgaggtttgtccctgaaggcaaggggaaagctttctgtaggcacacttcatttgcccagtgaggcccgtgtctctcgaagctgtctccccaaggtctctgcttgtcttatctaatcttccccgacttgcagttcctagccagcgagcctacgatatcataattagctatgttttcccattcagaagaatcaggtagggaaagcttcaaactttctggggcccagagcaaaatgaaagtattagtcctatgaagggagtcttagagagaaggtggagtgggagaggtggctcagggggttggctcacgttttcaaaatcctgaggactagagtttagatcccagcgcccacaggacaaactgggcatcccttgcaaacgtctgtgattccagctctgagtggtggagagacaggaggattgctggtgcttgccacttccaggctcgctgagaaagcagtagccccaggttcagggagagaccctgcctcaaaggaaatgtggaggagaacctcggtcggaaactcttttctggtctctgcaccattgtgcctacatacaggcacagggatacatacacacgcgcaaatagcataaatcttcaaaaataattttaagagagaaacaacagggtattaagtcaaatgtgaagatcactgtggcagagatcacatgccctggggggccagtcttcatgcaaagggacagagccctcctagctgccctttagtttctgaagatctgcctgcttctgcctcctgatgcaggcctttatgttgtaacaccacactggcctcagtggtcttcaacataaaacctgggaaggaaagcagctgaggttctgcggcgtgtccctggtggaccactggcaaatgccgctgcggtgaggtgcagggtgtcctccagagagacgctgacgtctcagccccagaatgtgatggcatttagaaatatctttgtgaaagataatcgttaagatgaggtctttagccacgacaatgcgaatgatacccttataaagggggcaggggagagactggacagagatacgcataaagatgatgcagatacactcacacccgtgtatgtgcacgcacacaggtgcacacccggagaatgccatgtgatcggaaagctcgagattggaaaaatactccccaaagctaagaagtcccaaggacagttagcaaacctgcagaacttaggagagtggtacagattctgcccccaaagaaagcaatgctgccctaacccctggtcgcagacttccagcctctacagcttcaaaataaacttctgttgctcgagccctccagtttacgacactttcttatggttgtgtgacaaactcacataaccatctcccgaacaggactctcctatcacctctctgacctctgtaagctctggacatggctgaaaacccaggtatcccaacaggattgggacaaagatgggccggagcaatgccagttttgtttttcaaactcagaggaaacactggagcactgcctctggtcagatttcaggtatctgagaccactgctgtgcttgtcgcaaccccaatttaaaagcagcagatgttgttagttcataaatgatgaccctttccagtgtctcctagagggtttgtcaatcaagaggcacttagtgccattactataaggggtatgttccacacttgatgcatcgttaaatttgctgcaggcacattggaaagtgcccgaatccttcatcctctcagctcagagcaacacaggcctggtttctcttcgcttctaaggcctggttagttcgtaaggcttccctggatgccaggctgcgcagccaccagggaaaatgcaagcggacagacgtatgcccaggcgcctggggtcagaaagggcggagggccgctttgtgagggcacaatttgcagagcctgctgatcttgggagtcaggcaggccgccaggctcaggcaccgcacgcatcccgcgctaaggagcctgaacaggaccagcgccccagagggcaccctgacatggccgccgaagacccgctcccgcgccgctgtcgggactcaggatgacgcaaccacggcgggttgcatcagcccgcacccccgcgcttagcccgcctctccgccgcctttctccgggcgctgattgggccacgttggacactgacctctgtctcagccaatggatggcagccacagagagcgctatctgcggagccctggcacggggcgcccataaaaggtacccgagacgggggcgcgtgtcccaaagacgccaagtgtcgttgtgtggtctcagacggctgcgtcgccgcccgttcggcatccctgagcgcagtcgagccgccagcgacgcagacatggagcccgagccacagcccgagccggtcacgctgctggtgaagagtcccaatcagcgccaccgcgacttggagctgagtggcgaccgcagttggagtgtgagtcgcctcaaggcccacctgagccgagtctaccccgagcgcccggtgagtgggaccccggggtgccacgcctgcagggttgcctgaactcacctgtcacacaccacagggcgcgagtctccttcctgcccaaccgtctcctgtgcccctctgctcgccctagcgcttgtcatctcttctgggcctccaccagtccgcgcttgccctcttctagcccctcatctcttcacctcccattacacctaactcccaaggctgtcacacatctgccccacgtccctgtaccctctcctcatcctcccagggaaacagtaatttgaccttaatgagtcatttccccatccgagtcccagtgaccctccacaaactactaggtgactgactgggtgttcccagttcggcttgcatctgatgggtagaaataagaaaagtaaatgttgccaaacgagacttctgggtgtaccgaggacagacagtatatgtgccagattgggccattggctagagggtggggtgcgtgcccagtcaccaacttctgaaggtcccacgcccataggctagacatggctcttctcctgcagccttccgttggccgcccctccctgtcgcgccgcacttagtctcggggaggagcccccttaactttctagcgaaggatgactgagaaaggaagccagcagctggagtagccctgagtctgatttgacgacaaccgtgggtcagttaggagactttcttgttccgtggggttccccacccctccccctccccctttggttgacacatctgtcaacagctccctagccccgcccacccctccggtccctgccacgtgacggaggctgtgcgctggaccttcctgtatttactttgttctctgatgttatgtaagtgtccacgagtacagttctggatccgacaggagagggcaatcgggtggctgcagatggggactttgaacagtggccttagagctccaaccggcagtggcgcgtgggtttcagtttgtttttgttccgagttgtcgggaaagtaaacaaggcttttccttttagaattggcgaggaactttatcactttgggtgtaagcgtctaagcccctggaactggtcggggcagtgtgtaggatctccgtggttgttttcaagaaaccaggtgttcttgttgggaggtggcagttaggtgcataaatgatgctcctgtcgggtcaggttgcatcatttgtaaaagctgttttgaggcctgttttcctcaggtgaggaacattgggccccttggatttgaagacctaagctggtaaataccagtaggtctcctgggtgtacaaatctgtaccttacaaaaataccgggaatggacgcagtggtgcgcttctgtaatatgtcactggagaggccaaagcaggaggagcatgtcttgcagactgggctatacatagtgtgagtctctcagtaattaaagaagaaggcatgttcatggtttttttttttttttttttttttttctgtagtagtacttatcattgggtgatgataaaagtttataatagttatttgcttaacattttattttcaaattggccttccaggtgaggacagagggtcagtttggtttttaccatttgctggtggttggcttcacatttagaacagcattttgcaaattggtgtgcacagcatttgtcagtaaagcagtccaaacaacatggaacacagcatccaatatgtgttttaggtgtagtgtcaaaagtcctaatggatgttgataagaagatgaaggcttcctaatagtctgaggctggccataaactcttgttctttctgcctctacctcaccatgtgccaggcttgtgggcatgtgccaccatgcctaggtggatacagttttcctggtcttttggggagcagcgttttgagatagggcctctctagccagatttgcttgcagctcattcatatcccgggatggcctcaaacttctgcctcagttacccttgtgctgagagtctagatatgagcccaggtttttttaaaatttaatttaatttttatttcaggctgtttggaaggaacatcttaattccaagttttgcttagtgggttattctgttgtgcaggctggtgacctgtggggtggtagccattatttgaggccattgcttttaaggacatacttttaaaaatatggcttaggagaaatttaaaaattgattttagagatgagaattatataaaggcatatggactccgtgtccttaaagtcactggtatagaggagaatatatgggttggactcttgattctagcagcaggtaatatcgggtggcatggaagaagactgaccaaaagtaaattgagttttctctggctttagagttcattgctgccaaagcacgaaatacaatttgtgtttttagtagcagaaagaagtttccctgtgaataagaagtaaagtgtgtggcatagtttttacgagctagggggttatttgcctcccaaatttatttgcatatttgagattaaagtcaagcacttcctaaataaacgttttatatatgagaatttttcttaaaaaaaaaaaaaaaaaggtcttcccgtggtggcggggggaaaaaaacttgttcgaatctaagctgatgtgtgcttttctttccttttacaatcagcgtccagaggaccagaggttaatttattctgggaagctgctgttggatcaccagtgtctccaagatttgcttccaaaggtatttgtagcccttagctcttgctttggggtggggtcgggcgcttgtgtttgaagtcaggctctgaggtgtctcttgttacatcagcaggaaaagcgacatgttttgcaccttgtgtgcaatgtgaagaatccctccaaaatgccagaaaccagcacaaaggtatggcatctttttatgataatagctacttgtgtctctgattctcaagggagggagaaaggaagtcgagtaaaaccgaagagagacttgatcgcatctccccaaggcatgccaggtctcagaggctgtgctctcagcacactgagggctgagcagactgctgtttgcgtgccatgtgcaaaagcaaaggcagtcccctgacctgagcttgctgtgtgcccagaacacagcgccagaatggcacgtgaaagtggggtttatagaaatgaacacatttccctaaggaactttgtttattttcaagacagtgtctctctatgtagccctggctgtcctggaactcgctctgtagatcaggctggcttcagattcccaaagatcagcctgcctctgcctcctgagtgctgaggttacaggcctgtgtcacacccacctggctaggaacatgaattttataaggagtagagaagtaaacatatttcctgtagaaatttctgtcaggatgacttgggtagggaaagaccacagtcttcattacatgatctctaaagactttggtttgacaataaaacacatttgcttttcttgacagtagttgcttatatgtgcactctccatattctagcgtggtatttgacttaaatttgtatttcacttgtatttctcacaacttctgagtatcacatggaaaattctctttcctttacattgctgcctagttatatgtgcacatcctgtctgtcacattgatttctaggcctactcctgggtttaacactgtacattttagcttcagtgggaagcagtctcagtaatgatagctgcattcagaagattttctgagactacagtagaaaaacattttttatttgtatgtgtgtctcgatactggtgtctgcatagagagcttttgctgggacttgaacccaggacctcacgcaggcaaggcaagagctctaccactgggctacattcctcagtcctagtatctgtatgttcattttgtcaggttgtggggtggggatagggccataagccactggtagcaaagtaattcttttagcttgattgcaaagagttgcatcaggccctttgttctgacgtttatgttacttaatttagggtgctgaatccacagagcagccggacaactctaatcagacacagcatcctggggactcctcaagtgatggtttacggcaaagagaagttcttcggaacctttctccctccggatgggagaacatctctaggtgagtgcccattaagaacacgagtacttcatttgtgtcaagaacatgattgtacttcatttgtgtcaatttaaaaataaggcgtatttaagctgggcatcatggcgcactcctttaatcccagtactcaggaggcagaggcaggcacatcgctgagttcaaggccagcctgatctcagatcgagttccaggacagccaggacttacacagagacaggggagtgtggagcgaaagtacacagccccttagcttctcagatgcttgctcccagcaagggaaggaaggctggtgcatgcctggcccagcacagatgtgtctgaaagtccaggcctgttcctttggctcgtgagcttgtgcgagtcccctggttttctgagctgcacttgggctttctctgtaaattagggtggaatctttctacaaggctgctggatatctatcaacctgtgcgggataccagatgagcagtagacacagggagggttgtcacggcactcagaactgccacagtgtagattcttaccccggggtcagggaggacttggtaaggtgacttgggcattcccctctaaagcatgatccgtggatttaatccccagtgagacttgagaggggaagcgttagtctgtttgctcggcttgcagaaagcatgcagcaactccctgccaatacaatgagaccccagggcagggcagggctcttgttttccatgggatctgatgagccacagcgctgctgccctcgacttccagggtgcatcatagagatggctactgtgacatctgtcctgtctctttgactgtcattgctgattataatttactattaagcttgtcatcctggactaactcgacatgttcttttgtttgaatctgcgtacaggcctgaggctgtccagcagactttccaaggcctggggcctggcttctctggctacacaacgtatgggtggctgcagctctcctggttccagcagatctatgcaaggcagtactacatgcaatagtgagtcctactgtgggtgtggctgctgggaatggcaagaaatcccatcattgccatagtgtcaaatggagagaggggtgtgttttcatgacttctagaaccctgtcttttgtagttctggatggagtagggtagaaacaatagcagcttcaagacgtgtcaattgatgtagaattagttccagatatgctttgcggtatagctcttcttagaaaagacatcatatagatgtgatgtctaggactgcctaacctgcggagagagccccgtctccatgacgccctgccttcagctgcatctgcttctgtttttattttagcttagctgccactgctgcatcaggaacttttgtcccgacaccaagtgcacaagagatacctgtggtctctacacctgctccggctcctatacacaaccagtttccggcagaaaaccagccggccaatcagaatgcagctgctcaagcggttgtcaatcccggagccaatcagaacttgcggatgaatgcacaaggtggccccctggtggaggaagatgatgagataaaccgagactggttggattggacctattccgcagcgacgttttctgttttcctcagcatcctttacttctactcctcgctgagcagattcctcatggtcatgggtgccaccgtggtcatgtacctgtaagcacatgggctctctttacctttactgaaaatgacactgtattgtcacttgagtatagatagattctttcagtctgtgacccttaaaggaggtgtgtttacatttttgtcactctggcactttttggttcaaggagcactaacacagaatgcagaaatcctgtgttagcaaaagaaaaatattttcatcatctggtcggtggataaatgacctgtcaggctcatgaagtacagtacagagccaccctgaagcataagaggctgtatttgtttccagaaggacagagtgtcctttatcaggtcgtagctgcctttcaggacaaagtacagacagcgtcgtcacagctatgaagggccagtgacccttcacacactctgtttgctccagctgccagctggagataattctgcatctttctccgggggacatttggcagtgtcagaaggatttcccagctagagggctggtgtgtttaagtagatgacaggaagagatgcttcaaagtctccagcagtgtgcaggagagctcgcctggaggacagagccccagaaagctgggcctagaaggataggtctctggttagaacggaaagaaggaagttttcctgtagagtaaaattgggttttatcttagtttttcgaaatgtaagaagcacaagcattcttaatattttgtcttgaaagttgaattttgtagattttttttccagttaaagccttttatcaaacatttctatgtctagaatcaaatatttctatgaccaaattaaggttgttatcatatgatatatatatatatatatagagagagagagatacacacatacacatatatatgattacagcagctttatatatgattatatctcccatctcttttgggtttggtttgctttgatgctgtgaggctggagttgaaccctaggccgccccgcttctctccaggcaagtgggcactttccactaagttatagcttcagctttttcctttctctcctttttttttttttttttttttttttttgaggcagggtcttgctgagttggtcaatagcattgacctcactctgtagccaaggcagaattgctattactatttactgccggtgaataaaacacacacccctgcttttaaggaccagaggcctaagagaatctagggactggcagactggctgcacaggtagtattgtgtaagctttggggccttcagattcttatgtgaatcccacagtgacttagctgagatgtgcctgtttgtgctttcttcaaaggcaccacgtcgggtggtttccgttcagacagaggccagttcagaacttcccggatgatggtggtcctcgagatgctgccaaccaggaccccaacaataacctccaggtacaggcctcactgcccggcccgctctagtcctgagcttgcagacttgtaaactagtggtttgccattttttaaggctaagtattttatgtttttttttaaaagttattcttatggcaactatttttaagactttcaatattctatataggcatatggcaattgggatttttgcatatgtaatgatgggggggttgacccacattttgagaataagagatatgtaacagtatacttaactatggaaactgctggtgggtagttattcaaattgactgggtacataaccacatctcagaatagattttcgtcataaggcagattagtgcatcatcctgaagggtatactttataacagaaattgcctctgtagtctgcttttagaacactgagatgccagattggtcttttagctcagggcatggcccaaattagaggactggttagcgtgcagcaaagttaattactatttgatagtaactgaaggccccttctctgacgctggccaagggaagtgtttgaactatggaaggtcaattgcagatgtgctatagaattggagaggtacctcctgcagccaagggctcatccccagggcttgtcagcctgctaggctttatccggacctgacttcaggataggtgttcctctagaccctaatcattttctcgttgtgtctttgcctatagggaggtatggacccagaaatggaagaccccaaccgcctccccccagaccgcgaagtgctggaccctgagcacaccagcccctcgtttatgagcacagcatggctagtcttcaagactttctttgcctctcttcttccagaaggcccaccagccctagccaactgatggcccttgtgctctgtcgctggtggctttgacagctcggactggatcgtctggctccggctccttttcctcccctggcgtggactcgacagagtcattgaaaacccacaggatgacatgtgcttctgtgccaagcaaaagcacaaactaagacatgaagccgtggtacaaactgaacagggcccctcatgtcgttattctgaagagctttaatgtatactgtatgtagtttcataggcactgtaagcagaaggcccagggtcgcatgttctgcgtgagcacctcccccagatgtgtgtgcatgtgtgctgtacatggaaagtcatagacgtgtgtgcatgtgtgctctacatggaagtcatagatgcagaaacggttctgctggttcgatttgattcctgttggaatgttcaaattacactaagtgtactactttatataatcagtgaattgctagacatgttagcaggacttttctaggagagacttatgtataattgctttttaaaatgcagtgctttcctttaaaccgagggtggcgacttggcagaggtaaaacctttgccgagttttctgttcaataaagttttgctatgaatgactgtagcagagactcccattgtcctggcaagcttgctgtgtcttttgtcactggagaatcaacagttgagctgctgattcttaagtaacccaaatgcttctttcctaaaggactgtttgtgccagcaagggacaaggctgctgcagaggctcttggtaaccagggctgtgcctctgtgtggcctcatttcccacctaaatgtcaccagcttatgtaggagcccaccaagactagatcccccaaattcaagggactggcctaattatttcttccgagaaacttctatttcaactgagagaggaaaggatgagcctggaaggttttagtcaccaacccaggttcctcatgagtgactttaaagctacatctgccctgaaaacaacccttatgcctgggtagggcagagactgccagaaaccaagcccagagtcatcttggaagtgagttacagcacacggtgttctctcaatgtgagagatgaggctctggtggcagaaatacaaagggggttaacctggggttctgtgatgtgcgcccactaagcagagactttgagtgctctggcacaggagttaggaagggttctaactggttaacaagaacatggacctaaaggtggtcgctaccagaggaaacagaagtgctggggctgccttagtgtagtatagaggaatgctccctaatgctgatggagtctgcagtgttagaggagacttctcgggtatcaattcctaatcaaaatggagtggtgtgtctatgataaaatctcatgccggtggtcctcacccctgataagccccctctttctcagtctgcccctaagccctcatgcaaattccctatgattgactgtcaaaggaagcacccacagacctgcttcaaagatagttctgcatggtagctcctggaaaaggacagctattagcctagtgtctgtctggctgtctggctgtctggctgtctgtctctctctctctcgtatcccagcatcccagagagataacagtggtatagggaactctttcttgtgggcagaactttaggtaatggcatcatatatttgggggaagagaaatagccagaatcacaagtgtatactgattagaccttgttcgtaattatactgtggtgtatactaattatattgtggtatatgctcattctgtattgctggttatgggctgaggctggtaatttagttggttgggcaaagactctgaaggaacaggattgagaagctggtggcaggagccctggaaagaggcatgagcaggcaagagttcatggtacctgtgccctgtgtgaattctcactaaggagtgatcgccacaaaaaggcttttagaaagaggatgggagggggcaaaacatcaacattttgggttgtacataattaaagaaacatctcacttttggaaatactgtaatagccaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngctcagtggttaagagcactgactgctctcccaaaggtcctgagttcaattcccagcaaccatatggtggctcacatgtggtatcagatgccctcttctggtgcatctgaagacagccacagtgtactcatgtaaataaaataagtgaatcttagagagagagagagagagagagagagagagagagagagagagagagagagagagagagagaaggaaaggaaaggaaaggaaaggaaaggaaaggaaaggaaagaaaagaaaagaaaagaaaagaaaagaaaagaaaagaaaagaagtagctaaggcaggctggggccattggaagagcagtgagccgtgaagtttgatggtgatatactctgtggagtttaagaaggaagagggaaaatgagccaagtgtcttcactgactcgtgaagacagctcctccacatcctccctccatgggcaggtagacaatgacaatcccagagactgtatcagccagcatcatagctcttaggttatgaacacttttgtgtttccctttaaaagaaaaacttaaaaaataatgtgtgtgtgtgtgtgtgtgggagggtggggaagcggtgttgtcataggcatttgtgagcttcccagtatgggtgctcggaatcaaacttgggtcctctgcaggagcagtatgcacacttaactgccgagccgtctctccagctggttctcttatgttctgaatagtcgctgaagaacacatctcctagcgtagctcccttatggccggagaaaggatgtcaagatcaggcctgctgcatccttatggatcaggtatagcaaacctactcagagccagctcatggagggggagcagacaagaagacagcagagtgccggccaacgttgatgagcagcattgggaacgggggcactgtgacaccacctggtactagtggcagaagacagtgggaaagtagaaggttgttctgaggacagctggctggctggggctgacctgagattgttcccacagaaggacagtggagttgacacaagagggcctgtttgtttcccttagcagggcgcctaacggaagtcacactgcctccaagctcctgttccccacagattgacagacactagctctgccaagaccaagtccacaaggctccaaggaagccacgtgtgccttctaaaggtctctctggtggcacaggtgtagggtaagctgaatgaaagaaacatttgtctactgtgttattttttttaaaggtattaagtaaatgtattcttcgagtcaagtgaggacatacagttctccctttaaaatccatttaactaaaagaacaggtgaaacgttctaaaaagttaagcaagcaggagccagttgcacaagcagaaaaggcaaccgtccagacagtggttcctgcaagactgactgacaggagacacccactaccccttaaggtctctgtggacaccatgatcatacgaggtgaattctaaaatgtgtgcactggggtgcttgctgtgggtgggactgcatagatctgaatggtgagtgtgcctcacagccagatctctctggttgtctgtatgtagtcggcatgtgcttatccagtacagggacatactgtacacactggtgccctaggcttcctgcatacaaatgtttgtctgggcaggtatgtgggcagagtgtaccagctacgtgcatcttgggtggctgctattaacagagtcaaggaggtggcaagtgcagtaattttctctcaacgttcagcattatagtaaggggtatggcttggttggaagccgagatggcgggccaccagtcaccagaggacagaacatatctgggcagaagctgattcagtcagtcccaactctcccattttcttgggtctttgctagataaaattagctctgagcttgactccaaaagtcttggcatccctctgcctcatctccatctctcccgacctccttcagtcctctgctttatccagtgatccctgtctgaaatttctggaaggcccagggttcagaaaaaaagactggttgttatagggtgggttaggactttgaggcaactttggatcttttggaatgccaggaagggtgcccctggcccagccagcttggacttctgaagtacaaatgtcaaggagcagggctggcttagcccttctggctctcccaccgtttgggttctgttgggaggtctgcactgagcactatggagctatctgccattcctcctcaggctcagggcctgatcagaacattgccaaactttggcctggcttgtgtgtagtgtggggattcatagtagggaccatgcatccacagaaacaccaaaggaacattttggtggtggctgcagtgatcaacagggagctctggtcctccttaagtttatcgagcttactgaacctctgctctgtgatgaactagccttccatgataggcaggtcatctactggaggctctcaaagcctcactggtgcacagacactggtttggcaggtgcttcttccaaccagaaagaatgacggcacacattgagaacggggcagcgagctgtggactgggcactgtgctcagtgtcccccttcccacacaacagcttgtcttatcgtcactgtctgtagagagaatctcttacatgcatcacctgtcaataaaaagcagtagccaatgagctgaggcaggaaataggaggtgagacatccggctgggagagagagaattctgggaaatagggacaaaggagatttgctcagggaacactgaggagacagacataaaccagtcacacagctgaacgggttagaataagggagatattctccccagaatgctgaggagacagatgtaagaagacaaggagaggaaaccagccacatagctgagctcaggttagaataaaaaggaacataagttaggaactagtcagagaacaagccaaagctatgtcataagcacttattaataaataattagcctcagagttgttatttttgggaattaagtaattaggaggaaaaactaaattttacaatccctttgaaagaaaaatcctgaggttttaagaaattccacagctgccaggtatgtggctcttccaaggccaaagctgggcccctccctataagactgccatctgttaattctgctgtttctttagagatcctccaagctcatagcctactatacctatgatcaaatgtgaagaccttggcagtcctgtgggtctcaaggatgacaatagccccaccccagtctttcaacttaataatttagtgtctgtccttccagaagattctctacacaacaacatacacacacacacacacagggttgggctttctggtttataaaaatgagactatgtccttacccatgcgaacacagattcaagaacctgcagacaaaatacggatcttgattcccagaactaaagtaagacaaaaaacaaacaaaacaaaaaaccaatctaggaatggctgctacttgcttgtaatcctaacactcagaaggcagaggcaagaggatcctaggaacttgatgaccaagtagacttgcttccttagtgcattccaggctagtgagagatcttatctttaagaaagtgtagaggttgtcctttggcctcctcatacatatgcatacatgtgcatgtgtacctgcacatacaggaacacataaagttgcactcatgctgacatgtatgtggttaggttaggttgctcctctctattgcccattctttttttgtttgtttgttttttcgagacagggtttctctgtatagccctggctaacctggaactcactctgtagaccaagctggcctcgaactcagaaatctgcctgcctctgcctcccaagtgctgggattaaaggcgtgtgccaccacgcctggctctattgcccattcttgctccttcctgatgcttgctcttcctcctccctgatacccactcttgctcctcccggatgcccacatgcttcctcacagccaacacttattttatgaaagaaattcattactagctttctttttcaaaaaaaattttttaatttcttttttctctctttttctcttctttctttttttctttcttttatttttatttttatctttatttatttatttatttatttatttattttggtttttcaagagagggtttctctgtgtagccctggctttttttttaaataaatattttttattaattaggtattttcttcatttacatttcaaatgctatcccaaaagtcccccataccctcctccccccaccatgccctggcttttaaatttctttatgtgtaggtgtatggaagcacttggaagtcagaggacaacctcaggcgtcatcttaaggaagacctcccgcctccttcaataaatataaaaccttgagacgaggtctcatcaagctctgactggcctagaactcactcactgtgtagaccaggctggccttgaggtcagaaaactctgcttgcttctacctttcaagtgctaggattaaagacaatcaccaccacacttggctccacatcttttgagacagtcttttattggcctgaagcgtaccaatcaaaaggccgggagggcaatcttctttcttgatggatgatgaaaccgaggctcacagtggtcacgtgggcccgatcaccgttgctgttcttctccctttctcctgtttcaggcactcttgggggctgtgctggagagaaggtgccactatgtggtcagcagacactttgctagtggtcacaatcttgcccaccaccaggagaagctagatgggagtgtgagaaagctgtgggaaccctataggtggaacaacaatacgaactaaccagtacccccagaactcatgtctctagctgcatatgtagcagaagatggcctagtcagccatcattgggaagagagaccccttggtattgcaaactttatatgccccagtacaggggaatgccagggccaagaagcgggagtaggtggggggggggggggagcggggtatagggaactttcaggatagcatttgaaatttgaaatgtggggtggggaagccgtggctcgaagctcccggaggcgaggctcgcgcgcccgccccccgccctggccccagcgcccacccgatcagcagccccggcccagc

SEQ ID NO: 404 - DNA, 1873 bp, Mus musculus
aaagacgccaagtgtcgttgtgtggtctcagacggctgcgtcgccgcccgttcggcatccctgagcgcagtcgagccgccagcgacgcagacatggagcccgagccacagcccgagccggtcacgctgctggtgaagagtcccaatcagcgccaccgcgacttggagctgagtggcgaccgcagttggagtgtgagtcgcctcaaggcccacctgagccgagtctaccccgagcgcccgcgtccagaggaccagaggttaatttattctgggaagctgctgttggatcaccagtgtctccaagatttgcttccaaagcaggaaaagcgacatgttttgcaccttgtgtgcaatgtgaagaatccctccaaaatgccagaaaccagcacaaagggtgctgaatccacagagcagccggacaactctaatcagacacagcatcctggggactcctcaagtgatggtttacggcaaagagaagttcttcggaacctttctccctccggatgggagaacatctctaggcctgaggctgtccagcagactttccaaggcctggggcctggcttctctggctacacaacgtatgggtggctgcagctctcctggttccagcagatctatgcaaggcagtactacatgcaatacttagctgccactgctgcatcaggaacttttgtcccgacaccaagtgcacaagagatacctgtggtctctacacctgctccggctcctatacacaaccagtttccggcagaaaaccagccggccaatcagaatgcagctgctcaagcggttgtcaatcccggagccaatcagaacttgcggatgaatgcacaaggtggccccctggtggaggaagatgatgagataaaccgagactggttggattggacctattccgcagcgacgttttctgttttcctcagcatcctttacttctactcctcgctgagcagattcctcatggtcatgggtgccaccgtggtcatgtacctgcaccacgtcgggtggtttccgttcagacagaggccagttcagaacttcccggatgatggtggtcctcgagatgctgccaaccaggaccccaacaataacctccagggaggtatggacccagaaatggaagaccccaaccgcctccccccagaccgcgaagtgctggaccctgagcacaccagcccctcgtttatgagcacagcatggctagtcttcaagactttctttgcctctcttcttccagaaggcccaccagccctagccaactgatggcccttgtgctctgtcgctggtggctttgacagctcggactggatcgtctggctccggctccttttcctcccctggcgtggactcgacagagtcattgaaaacccacaggatgacatgtgcttctgtgccaagcaaaagcacaaactaagacatgaagccgtggtacaaactgaacagggcccctcatgtcgttattctgaagagctttaatgtatactgtatgtagtttcataggcactgtaagcagaaggcccagggtcgcatgttctgcgtgagcacctcccccagatgtgtgtgcatgtgtgctgtacatggaaagtcatagacgtgtgtgcatgtgtgctctacatggaagtcatagatgcagaaacggttctgctggttcgatttgattcctgttggaatgttcaaattacactaagtgtactactttatataatcagtgaattgctagacatgttagcaggacttttctaggagagacttatgtataattgctttttaaaatgcagtgctttcctttaaaccgagggtggcgacttggcagaggtaaaacctttgccgagttttctgttcaataaagttttgctatgaatgactgt

SEQ ID NO: 405 - protein, 421 aa, Mus musculus
RRQVSLCGLRRLRRRPFGIPERSRAASDADMEPEPQPEPVTLLVKSPNQRHRDLELSGDRSWSVSRLKAHLSRVYPERPRPEDQRLIYSGKLLLDHQCLQDLLPKQEKRHVLHLVCNVKNPSKMPETSTKGAESTEQPDNSNQTQHPGDSSSDGLRQREVLRNLSPSGWENISRPEAVQQTFQGLGPGFSGYTTYGWLQLSWFQQIYARQYYMQYLAATAASGTFVPTPSAQEIPVVSTPAPAPIHNQFPAENQPANQNAAAQAVVNPGANQNLRMNAQGGPLVEEDDEINRDWLDWTYSAATFSVFLSILYFYSSLSRFLMVMGATVVMYLHHVGWFPFRQRPVQNFPDDGGPRDAANQDPNNNLQGGMDPEMEDPNRLPPDREVLDPEHTSPSFMSTAWLVFKTFFASLLPEGPPALAN

SEQ ID NO: 406 - DNA, 31652 bp, Homo sapiens
  misc_feature (1)...(31652): n = A,T,C or G
ggccggtggataacccaaggtcaggagttcaagaccagcctggccaacatggtgaaaccctgtctctactaaaaatacaaaaattagccggacgtgatggcaggcgcctgtaatcccatctactcgggaggctgaggcaggagaattgcttgaacccgggaggcggaggttgcagtgagccaagattgtgccattgcactccagcctgggcagtaagagtgaagctccatctcaaaaaaagaaaaaaaaaaaaaaaaaagaaaaggtacatgacatttaagatacatgtttttttcttttctgtttaaagtaaaacgctggacagcaatcagaatatttagaaggaagctgtgatgggagaaaaagaatgtgggcttcagaggttacctggggcctccgaattcaaccatgacccttgccctagatgctggcctggagggcgggctccacctgactcttgtttgtcctgggtccaaacctggtcagccagggagagccataaacctggcatgctctagggcaaaagcaagtatttactgttggagagacaaccaaatcaggtagatgcctcccatctacccgtcctctccaggatttaagtcctttgttggagtaatcagtgaaagtttcctatgtgtggtggaggtgattttatttgccttcctcccactcttggaagaaaggctggggagtagcactcagaacagggaagcccaagcagggtctttttttttttttcttttttcttttctttctttctttctttctttctttctttctttctttctttctttctttctttcttctttctttctttctttctttctttctttctttcttttctttctttctgtctctttctttccttttctttctttctctttctttctttctcttttcttattttattaaaaaagagagagagatggggtctcacgcccaggctggtcttggactcctggccttgagcgatcctccagcttcagcctcccaaagtgctgggattataggcatgagccactgtgccaggccaaggtctttaaaaaattgtggtaaaagacataacacaaaattcaccattttaactattttatttttttgagacaaagtctcactctgtcacccaggctggagtgcagtggtgagatctcggctcactgcaacttccacttcccaggttcaagcgattcttgtgcctcagcctcccaagtagatgggattacaggcacacgccaccaggcccagctaatttttgtatttgttttttttttttttctgtagagacggggtttcgccatgttggccaggctggtctccaactcctgacctcaggtgatctgcccacctcggcctaccaaagtgccgggattacaggtgtcagccactgtgcccagcctgaactattttaaagtgtaattcagtggtatttagtacattcacggtgttgtgcaaccatcaccactatctcattccaaaacattctcatcgccccgaaaggaaattctggacccattaagcagtaaatccccactaacccctggcaagcattcatctgctttctgtctctatggatttgcctgctctagatatttcatataagtagatacaatatgtggccttatgtggcctttcttgtctggctttttcacttagcatcgtgttttcaaggctcatccatcttgtagcatgcatcagcacttcattcctgtttaaggctgaataatagcgcattgcgtggatatgccgtattttgcttattcattcagctggtggaccttcaggtggtttccacattttgtgttattataaataatgctgctatgaatattcatggacaaatttttgtgaaaagtgctttcagttcttttgggtagatagatatctaggagaggaattgttgggtcatctggtaattctatattgacttatccagcaactctgggtacactgtaaaactttctaagggctgagttttactatcagacctattgttctgctgccacagcttggcccccgttgtcagtcttgactggtcttaccctctggtgtctcctattcaagagacactttgaggttctcaaaaactagctctgttttcattttcttccatttaaaaactgtgtataacaaacacctttaagaatcaggtagcggccaggcgcagtggctcacacctgtaatcccagcactttgggaggctgaggtgggtggatcacgaggtcaagaggtcgagaccatcctggccaacgtggtgaaaccctgtctctactaaaagtacaaaaattagctgggtgtggtggtgcgcacctgtagtcccagctactcaggaggctgaggcaggagaattgcttgaaccgaggaggcagaggttgcagtgagccgagatcatgccattgcactccagcctggtgacagagcgagactccatctcaaaaaaaaaaagaaaaaaaaaaaaaagaatcaggtcgcacaggggaataacagggaagtggttgccccaagtcctcaaaagttgataaccacagtctgagattcctccttccttcaaataaaaacacttccccgtcatgggccacaatgttaagggagggtttgccttgggggactacttcttgtacagaaggaaagctgcttctggcttagcaagggcaggagagttgctgtgggaagggtttcatgagtatggaacaggacgtccatttcctgggctaaagaaggtggcttatgtgggtggtcaaattaggacttcagaatgaccataaaaagcacagattctggttggagtttaaattactccaaaaaaaaaaccaaaaaaacaaaaaaacccccaagagttcaaaaaacaaagtatagaagttcagcagggcctaagacaccagactacttcaaataaaacatgattactggcaatgatctcttgctgacttgggttttgcaaaggctctaccttcacagcctgattgtaaaataagatagcgcttgattcttccattcctgtccccatctcagaatgcaaacatgaattagatcatggcagagagacagcaacactgcagcactaccacagtcaacttaaagagtttccatgttcctttcatttccacatttccagaaatcccattgaacactgtggatttcccttcagcttgctaacttgcattccctcacatgctttctctcctactttatttctttttcctttttttttttttttttgagacggagtcttgctccatcaccaggctggagttcagtggcacgatcttggctcactgcaacctccgcttccggggttcaagcaaatctcctgcctcagcctcccgagtagctaggattacaggcacgtgccaccatgcccagctaatttttgtatttttagtagagatggggtttcaccatgttggtcaggctggtctcgatctcatgacctcgtgatccacccgtgtcggcctcccaaagtgctgggattacaggcatgagtcaccgcgcccggcctatatatatatatatcttttgagatggagtcttgctctgttgcccagtctggagtgcagtggtgtgatcttggctcactgcaacctccgcctcctggggttcaagcaattctcctgtctcagcctcccaagtagctgggattagaggcgcccaccaccatgcccggctaatttttatatctttagtagagacagagtttcgacatgttggccaggctggtctcaaactcctgacctcaggtgatctgcctgccttggcttcccaaagtgctgggattacaggcatgagccactaatcctggccctcatctcctcttgaatgaactgatcagtctcctggcctggagtctgtccccctccataatgacgtggatccatactgattctgatctgtcccttctactgctcaaaaacctcccattgtccacaaaataaggcccaaactccgaagggtgaccattcaaagtcttttctaagcttgtcccaagacttttttccattcttaccaatgactgttatctgatattatcattatcttaatataatgatgtggtcattattcttatttaaaaatatatcctggccaggcgcggtggctcacgcctacaatcccagcactttgggaggccaaggcaggcagatcacctgatgtcaggagttcaagaccagcctgaccaacatggagaaacgctgtctctgttaaaaatacaaaaaaaattagctgggcatggtggcaggcgtaatcccagctacttgggaggcagaggcaggagaatcgctggaacccaggaggcggaggttgcagtgagccaagatcacgccactgcactccagcctgggtgacaagagcaagactccatctcaaaaaaaaaaaaaaaaaatgttcctggagtgattttgttgcagtcagatttgggaaccactgtactggactcagtccagtcctctaaatattaatggctaacattgattgagcacgtagtaaatgtctgggtttgtcccaagaactttgacaacttgtgctatttaagcctcacaaaaaccctatgaaacagaagatactgttattattcctaattttcctaatttgggccgtggccccatgagtttaaccactgagctctacctgcccatacaaattctgcgtataaagtcactggcactccatggtgtttagtcagtaattgctgccattattactttcattcaaatctcacccatccttcggaattcagctcaaattctacctcttccatcaagttttctctgactccctctcttcttttctcaatgtaatcataagtccttcagaaatgtattcgactttgggatagtcttttatttctgtgttttttgttagcatcctcattatatttgtaaagtcattgagaatagggtcatgctgtgtttatctttctattcctggcacattcgttgacctgtatttaacattttcctaaatgtgctataagcagaatcaccgaatttctctcttcttttttttttttttttaatttgagactgagtctcgcgctgtctcccagactggagtgcagtggcgcgatctcagctcactgcagccaccgcctcccaggttcaagcgattctcctgcctcaaccaccccagtagctgggattacaggtgcccaccaccacgcctgactattttttttctatttttagtagagatgatgatttttcactatgttggccaggctggtctcgaactcctggcctgaggttatctgcttgccttggtctcccaaagtgctgggattataggcatgaaccaccactcctgtccccaaatttctttaaaaggagctatctcaccaggcgataactcaagagagaatcacagaaattagattgccttttccctaggggaagaaaatgcaaaatcacactcctaaactttctttcttctgagtggaaagggataagatatcttaacgtcttaaggggccctgaggcttgtcactgcaggtgaggggaaaccacactactggcatatttgatttctcaatgcagctgtcacctcctgccttgctgcctcctttaatgcctatgttggttttacctgggcttgctccactggttagcttctccctagttgcaagactaccagatcataatcagttattatctcccatcctgatgtgtgaaaagctacagaatttgtgggacccagtgcaaaatgaaaatgcaaggcttctgtttaaaatttattaagaatttaaagataatagcagagcattaaaccaagcatggggccccatccactacatgggtcccacacccatgaagccagctttgatgaaaaaagggttaggccaggtggtggctcgcacctgtaatcccagcactttgggaggccgaggcaggtggatcatttgaagccaggagttcgagaccaggctggccaacatggtgaaaccctgtctctactaaaaatacaaaaactagcttggcttggtggtgggcacctgtaatcccagctacttgggaggctgaggcaggataattgcttgaacctgggaggtggagttgcagtgagcggagatcatgccactgcactccagcctgggcaacagagcacgactccgtctcaaagaagaaaaaaaggtcagagccttctcagccgaccaaaaccacttgcagaaagctgagtgtggggacaatttatttccaaagccctcaacctctcatcttaatataaagacagctgagaaagaaatcaccctgtattgtgtgttatattaagattgactattgtggactgaattgagtcctccaaagagatgctgaagccctaaccaccagtacctgtgaatgtggcagcattgggaaatagggcctttgcagatgatggagttaagatgaggttattagtgtgggtcccaatccatgatgactggtactcttatggaaaaaagaaatgtggacacagagccagacatgcacacagggaagatgatgtgaagagacctacaaaaggagaacccatgagaagatgaagacaggttggggtgatgcttctatatgccaaggaacgtcaaagagtgccagcaggccgggggcggtggctcacgcctgtaatcccagcactttgggaggccgaggtggacggatcatgaagtcaggagtttgagaccagcctggtcaacatggtgaaaccccatctctactaaaaatacaaaaattagccaagtgtggtggtgggcgccagtagttccagctactcaggaggctgaggcaggagaattgcttgaacctgggaggtagaggttgcagtgagccaagattgtgccactgcactctggcctgtgcatcagagcgagactctgtctcaaaaaaaaaaaaaaaaaaaaatcggccaggcgccgtggctcacgcctgtaatcccagtatgttgggaggccgaggcgggtggatcacaaagtcaggagatcgagaccattctggcaaacggtgaaaccctgtccttacttaaaaatacaaaaaattagccaggcgtggtggcgggcacctgtagtcccagctacttgggaggctgaggcaggagaatggtgtgaacccgggaggcggagcttgcaatgagccgagatcatgccactgcactccagcccaggcgacagagcgagactccgtctcaaaaaaaaaaaaagtgccagcaaaccaccaggataggagaggggcctggaagattctcccccgaggcctcagaaggaaccaaccctgccgacaccttgatctcagacttccaatttccagaaccaagacaataaatttctgtttcttaagccaggagttcccaacctttttgacactagggaccagttttgtggaagacagtttttccacaggccagaggtggggtggggggggcattgtttcaggatgattcgagcatattacatttattgtgcactttatttctattattattacattgtaatatataatgaaataattatactactcaccatggtgtagaatcagtgggagccctgagcttgttttcctacaactagatggtctcatctgtgggtgataggagacagtgacacccgaagtatggtgcttaagtcgagtctacccattttggctgctgtcactgcagaaaaccctgcttcacagagatgggatgttgcaataggccaggcatggaggctcacatctgtactgctagcacttttggaggccaaggcagctggatcacttgaggcgaggagttcaagaccagcctggccaatatagcacaaccccatctgtctctactaaaaataataaaaattatatatatagccaagtgtggtggtgcactcttgtaatcctagctacttggtaggcggaggcatgaggcacaagaatggcttaaaccagagaggcggaggttgcagtgagccgagaacgtgccattgcacttcagcctgggcgacagagtgagaccctgtctcaaaaaaaaaaaggatgttggaaatgaaagcaggcttttcagtgtttttgtggccatctcaggattaaagcctagactttaacccagaacgtggagatttgaagttgtctcaaacatactgtttttttgttgttgttgttgttgtgtttttgtttttttttttttgagacggagtctcgctctgttgcccaggctggagtgcgatggcacaatctcggctcactgcaacctccacctcccgggttcaagcaactttcctgcctcagcctcctgagtagctgggattacaggcacgtgccaccatgcccggctaatttttgtattttttaggagagacggggtttcaccatgttggtcatgctggtctggaactcctgaccttgtgatccacctgcctcggcctcccagaatgttgggattacaggcgtgagccacctcgcccagcctcaaacatacttttaaggccaccagatgcagctgtacaactgaagtacatacacttgccattgtaaagcctgccaccagatgcagcttgtcacttgccactcactgatagtgttttgatatgagtctgcaagcaattgatttatgatggcctctgtgcagtgaaacctctctgctaatgttaatccgtatttgcagccactctcagcactagcatcagcaactcagctccacctcccatcatcaggcattcgattctcataaggagcacagcctagttcccttgcgtgcacagttcacaatagggttcggctcctgtgaggatctaatgccccctgatctaacaggaggctgagctcaggtggtaatgcagcgatagggagcagctgtaaatacagatgaagcttcgctggtggctcacctcctgcggtgccgcctggttcctaataggccagggactcatagtggtccgtggcccaggggggttggggaccccgtcttaagccatccagtttgtggcactttgttatggcagctgcagcagatgaatatacccaccaaccagaccaggctcctcctgttaccttcctgaccttgacaagctcctgacaacacctgaaaaaacagatgtcccaagggggttggaacaaggagggagccggggcaatgtcagttttgtttttcaagcctttttttttttttttttttttcctacagaggaggaggagggaacgcctacaataaagaggcctttatggtcccacttcaggaatcggagaaccccgccctcctcgtctcagccccaatttaacgggtgcatgtgtgagtatcttataaagtgacgcgttttgagggggactccagtgtgagcaggactgtggctgacttgtcaatcatcattagggtgatgtcccaaacgttcaagtctgaggcccagggaaattggcaacagctgcctggatgcctccatcctcccagcccaaggaaaatctggccttgctccttcgttgtctttcttaggagcacgtggagttctcctaggtgggcttgcactcggggtcgcccagccgttctttgagggttcgagtgggtaggcttcccctgtaggacgggcttccccgtaggtttccacgtggggccacagaggcaggaaaaggggaagtgggcactgacacctggggtgaaaaagggtgggggtgcggctttgtgaggaaagaatttgcagagactgctaaactggggtctgctgggataccccactccccaccccctgcctcgggcgccctcagccacccgagctgggggcctcgcaggtctcagaccaagctccccgcgcggcctgcagcgcacccaaacatggccaccgaacccgggttcccggggcacagccgcgcctctgggtgacgcagacgcggcgggttgcatcagcccgtgcccacgtgctcggtccgccctctgccacccggatccggacgccgattgggccacgttgggagagtgcctccgcctcagccaatgggcggcagccacagagcgttctgtccgcagagccaggcgcggggcttctataaaaggcgcccgaagcgggggcgcgcgccccagagacgtgaacggtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccggtgagagcggccccgacttcccgcccctaggctgtggccccccgccctctgctggggatgccacgtccggctgccctgtcctgtggcctcctcccgctgacggctgcgatcgctcggccggtcacctcccccagggctgtggtctccccttccctgccccgccgacgcgggcgcccctctgttgcccagtagccgtcagtaatcagcagcctgaccttgggcgagtcatttcaccctccaagcctgtttcccccccagcggccaggcaactcggtgttcctaattgggcttgcatccaatggctagaagtaagaaaacatccgtgctgcaaaatgaggtttctgaacgcagcctctctgcagggagaggagcgggcaggtgccacccggggccgtggcttgagaaacctggggaccgcccagacactgtggacggaaggccccacacccagaagcaggacgtggctcttctcctccctggccaccttccgccgtgcccctccctgtcgcactggaccgagcagccattgccgagtcccggggtggagccccgtgcactttctgaccaagagcgactgagaagggaagcaggcaggagtcgccttcagtctggttttaggacggcagcctctccattattagcaagacttccttgctttgttttggttgacacatctgtcaacatcacccttagcaccgcctgccctggccaccacgtgatgaggctgtaagctggcccttcctgtatttactttctgctctgatattatgtaagtgtcagcagtgttcttcactgcccacgagcataattcttcatcacacaggagagggcatccgggcaggaaaagatagtgaagtcgtgagttccagcttgtggtagcgcctgtgtctgtttttgtttcatatggtcaagaatgttttagaagtgagttttccttctgagttgttattttgaaatttgcatatttatttagtaagcttgcattccatgtcctctagaattcaccctggcacatttttcagtttcaccatagctgcttccaagaaactgggtggctgtgttgccatgagaatgactattgggtacacaaattggtgaagcaggtgtagcctatggttgcatcatatggcaaaaggcaggattttggcggaggatttttaaggtcttcctttgatgaggaatgccgctcccatctgttcagtctgaagacctaacattgtaaacaaatacctctcaggtatacaaatttgtgtctaaaaattattatggctgaaacatacttatcatttgttttctgtagtagaaaatggcataatatgagaaggcctactttgtaatagttgtttgctttacttaatatttttcaaatcagccatctgtgtgaagactcaatatcaagttaggcctttaaaagggggaaaataattcaaaaccactggcagctgtggttttccggccttttctattggttgaactctgtaataaatgcaggaccctacatatacaaaaggtactgttttccaaattcacgtatgtattagcatttacctttaaagttctcatccgtcagaaaaacggtgaacacagcattcagtatatttattttggtttagttacacagtgtcaaaaagttctgatgtatatggataagtagatgcactttttgctgttttgtttgtttaaacagcttgctttaattatctcaagctacttggcaggaacacctttattccaggtttcgcataatcagttattctggcaagagtagattaacacgttagtgatctccaatagacagattatttgttaatattatttgaggccattatttttaagtacaatttagacggagtttcaaatagattttaaaaatgagatttgtataaaagagtgtgcagtccctatggtgttaaaatcactgatatggaggagaagaggggttggaattgtgacactgtggcagcagatgaccttggacaagtcagtttttcagactttcctcccttaaaatagggatactaaatctcacagggtggttgtgtataatgtcacccacacgccatctcctctataactgcatttgtatgccaggaaattgtctgtgaaggcttcagtttagaatagcttcatattattttggggcactgctgggtgattttggttaaggctggccttgggagttctctgagttttctctgaaaccaaactcaatttggttgtaggttccctgtttgctgtttgttgcttttagtaataggagtcagtcagtttacctgggagttaagtttggactggagataatttgccattctttttttttttttttttttttttttttttttttttgagatagggtctcactctgtcgcccaggctggagtgcagtgacatgatcttggctcactgcaacctctgcctccctggttcaagcaattcccctgcctcagcctcctgagtagtttgggttacaggcacaagccaccacgcccagctaatttttgcatttttagtagagatggggtttcaccatgttggccaggctggtctcgaacccctgacctcaggtgatctgcccgccttggcctcccacagtacttggattacaggcatgagccaccatgcccagccgataatttgccattctgtatttatttgcgtgttagagaccagttaaagttaagacactttctaaatagaagtcttgtatatggggcttttgagaaagtgttttcccgtgatgctggggggaaacacacatattcaaattacttgtataaaacagtttattctgtgtttaggaacttgtaggggtgaaatgctgacctgtgttactctttctttccatgatcagcatccagaggaccagaggttaatttattctgggaagctgttgttggatcaccaatgtctcagggacttgcttccaaaggtacatcacttacacattaacttctgaatgtttttaagcactcaccaggttaggttcaggtccttaagtaccttcgtattacttttagcaggaaaaacggcatgttttgcatctggtgtgcaatgtgaagagtccttcaaaaatgccagaaatcaacgccaaggtgtgtctgcctcttcatgatggtaacaatttgtatcattcagactttcaggggagtaataaaagaagttggataaaacgtttattgagagactgtatggtgttattaccaagtaatattttgtttctttcctaggaattagaaactgtattatcaacacaaagtgatgagttaatagtagcagattgttccgttagtgctgtagtagaaaggtggagttacatattgcactatcttatgggatatgatttgatctatggttactgtgtatctagattactgaactaacactaattgggtttttattgaatttagcacatagcaagtttcttcaaaggagtcactaatttttataaagagtacaaaagtgaatatatttcctttggaaattttcattgtgattagttggataggaaaagatcagagtttttatcaagtgatctttaaagaattttttttttttaaagatggtctcgctgtgtggcccaggcttttctcaaactcctgagggcaagcgatcctcccacctcagcctcctgagtagctgggactacaggcatgtgccactagacctggctctaaagacatatatgacacacgaaaccatttatttttcatttcacaatgtttattcacatatatggtattagtattctaatgtagtgatgcactctaaatttgcattatatttcctagaacatctgaacagagcataggaaattccctattttgccattatcagttctaacaaaaatcttaaaagcactttatcatttcatttccctgcactgtaatttttttaaatgatcaaaaacagtatcataccaaggcttacttatattggaatactattttagaaagttgtgggctgggttgtatttataaatcttgttggtcagatgtctgcaatgagtaaatttagcaccattatcaggaagctttctcaccaatgacaacttcattggaagattttaatgaaagtgtagcatactctagggaaaaaatatgaatattttagcatctatgtattgaaaattatgttgaataaatgtcagactattttttacataacgttgcttctgtttaattttgtcacgttcagaggtggggggtaggagatgtaagcccttgacagcaaaataattccttttgcttgatttcagacagttgcatcagctcctttgttctgtgttcatgttacacttatttaggtggctgaatccacagaggagcctgctggttctaatcggggacagtatcctgaggattcctcaagtgatggtttaaggcaaagggaagttcttcggaacctttcttcccctggatgggaaaacatctcaaggtgagtgttataataaagatcttggcttatgcaacatgaatgttcctcgtttgcatcaatttaagaataaggtatgtttacacgtatataatcagaacttttaaacatacagaattttgctttataaatagcttcgctttaaagatctcttatatatttaacttttcttaatacacagccttttagtacacacaaatttaaaaagtaggtaatgcatatattgaaaaaaaaaagaaaatgtaggcgttttatccttccattgtgctgaccgcttggttgccgtcatgataggaaattagtgctgctgcaggagaaaacagctgtcgtaagcattgtgcagctgctttgctgagtggctttgtgctttattgtaacaatgggtgacaacaagggagagactgtttaagaagtgtccttccaaagacttgggggtactaggaaaattggccaatttcttataactattaaagcttttctttagagcaaaagtcagaactaaatgctctgttatttggatttttatagctcttggaatacattgtttttggggaaaaattcattaactgcaagttgcaattctgtaactctccaattctccgtccccctttttctagtactttttatacacaatattttataaagccaggtgttttaggaatgagtttttcttccttttcccccttaatggaactttcaaatatacacaacagtggggactggataattaatccccacaccatcacccaggcctaataaataacaatcagagttttaccatagctcatctattaccctttcccttttttttaaaaaaagagtatttaaaagtaattcccaggcatcatgttatttcatccctatattcttcagtatataactatgaaaaccttttagttatcttgtatatctagaatgccattatcagatctaacagaaatcttaaaagcactttatcattttatttccatgcactgtaattttcttaaatgatcaaaaacagcatcataccaaagcttacttgtattggaatactattttagaaatactctgtgtatggaatttagttaaaagattgtcagcatataaattggataattattggatagaaaattattggttagaaaaacttaaaactacttcccttattctgattcaactattcttaacttgagaattgaggctcatatttgactctctgaatctcaccatatttaaacttgatttcctttaacaaatatttattgaacagccagtacatacaactttgcttaaggatatgagttgacctgcaggaatgaccacataaccaatttctgatctttgggcaattctattatggtttcaattttgtgatgtgctactgaagaaattgactgtgtaagaagcacaaagccaaagatgactcgcatacacctgccctgtgaagttgagggctgtgtggcctgattaaagaagcatgcatttggccgggcgcggtggctcacacctgtaatcccagcactttgggaggccaaggtgggcggatcacgaggtcaggagattgagaccatcctggctaacacggtgaaaccccgtctgtactaaaagtacaaaaaattagccaggtgtggtggcgggtgcccgtagtcccagctactggggaggctgaggcaggagaatggtgtgaatccgggaggtggagcttgcagtgagccgagattgcgccattgcactccaggctgggcaacagagcgagactccatctcaaaaaaaaaaaaaagaagcatgcatttgacatcagaccagctctgaaatccagccctgctacttactagctcagtgaccttgtgcaaagcccctgtcttccctgagctgtacttgggttccccttgtaaaatctccttcatgagattgctgtggacccagcagcctgtacaggacccccggtggtcagtaagcatgcacaggtgataccacatgcacacttcactatagattcagatagaggatggaggaagaagtggatattgggaggatgggagagatttccttcaggaaagactgggagaaatgtggcttttgagctgctctctaaaagatgaacagtgggttgagacctgcagtgagactcaacaagtcaaaactgaggtgggatctacttaacccaaaaaggttgtttatatatctgtgcactcagcaagcaggtggcaagggctgttgttttcctgtgggatgggactgtggtagaagtgctgtgtcatttagtaccttctgtgcttgtggtacatgggtgcgtcatacagtcatttaccatgtaactgccgtaaattccattcttctgtctcttcgatttgaattcttgattttaatttaaacttagttttcatttgttcatactcaacccactcaaaatgagtgttttttcaaatctatgtataggcctgaagctgcccagcaggcattccaaggcctgggtcctggtttctccggttacacaccctatgggtggcttcagctttcctggttccagcagatatatgcacgacagtactacatgcaatagtgagtccttcccgccatgctgggtgtggccagggctcccgggaattgaagggaattttatccgtgttacctgtaaagttcagaatggagggatgagtgtattttcatcagtctgcagagccctgctctgtttggtctgtgggtagagtgtaaatgacagctgctacctgatttgtgtattgacacaagagtgcttttgtctgatacatagtttagtgactttatttagaacatgttactttcttttcaatttgtgctatcttcaaagttttgtgaggattttaatttgctactgtgccataatcttacagtgggcttgatgtttaatttcaggtgaaattcaccttgtggcttttcttagaaaaggcatttatagatatagttagtaaggaagttcttcactaaattgaagaaaaatcaaaggcatatctacctacttgaaattcttaacagtaaaagactgctgtgtaaataagccacagacttcacggtgctttggtctcaacagtatctgcctctgtcgtttttattttagtttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgtaagcagatggtttctctaatataaattacactacactgtgttcacactaagcagattttgctctttttgtttcttgttttttttgagatggagtctcgctctgtcattcaggctggagtacaatggcacaatcactgcaatctccgcttcccaggttcaagcgattctcctgcctcagcctcctgggtagttgggattacaggcgcccaccaccatgcctggctaatttttatatttctagtagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctgtaatcccagcagtttgggaggccgaggcaggaggatcacatgaggccaggagtttgagaccatcctggccaatatggtgaaaccccgtcttttacctaaaaatacaaaaaattagccgggtgtggtggcacgggcctgtaatttacttgggtggctaaggcaggagaattgcttgaactggggaggcagaggttgcagtgagccaagatcgcaccactgcactccagcctgggtgacagagcaagaccctgtcttagaataaatacataataaatagtatgtattctggcactttcgatacaaggaattcatggcttggttgtatggtcccaagaacatatcaatcctgtgttaatataagaatattatcttgtcctctagataagctaccttaccttccaggctcacaaaccacaagtatgtagccatactgaggcatggaacagaaaactgtatttgttttgaatgagaacacatttgcctttatcaggccacagctgccttccagggtaaagtcaggcactgactgttagcatggccctgaaaggcaagggaaccttcacatacctgacatttggttttagctgtggcccgaagcagtagttctcaactgggggtggttttgtaccctctctccccaggggacatttggcaatgtgtagctatttttggttgtcacatctaggggaagtggtcctgctggcgtctagttagtagaagcaagagtgctgctgaattttctacaatgcacaggacaactcccacagtaaatatttggctcaatatgtcactagtgccaaagctgagaaagcctggcctagagtgatgggtcttcgtggttgaaactaaaagaagaaattttcctgtatagtaaaaatggatttttattttagcttttaaaaataaaaaaggaataattagaatataatgaacactcaaatatccacaattagtcattgttaatattttattatatttaagacttgggatttaattggtttcttcaaataaaacgtttagttaatattttctgtagtctctagaatcatatatttaaaagaccaaatgtaggttgtcattatgttatatataattatagctttgtaggtatatgcattctccccgctctgttcaggttttcaagggtaaggtttagttcatataaataagcatttattgagtgcatactatgtgccaggtgctgtttatatggctgggtgtgcaatgatgaataaaacacagtccctgccttcaaggaccttacagactggtgagaatgtctgggagacagtgtgatcaaatgcctctgtagatgggtcttgcagtgagcttatcagggtgctgctgtgattagaggtggggagccttggattcttgagtaagtctcactgtgacatcagctaagatggacttttatgtgcttcctttgaaggcatcacgttgggtggtttccatttagaccgaggccggttcagaacttcccaaatgatggtcctcctcctgacgttgtaaatcaggaccccaacaataacttacaggtatggagcctcccacgaagcccaggcgagcttgacgtgatatgccaggctctccaatcctcaacctttagattgccagcttgcggtttaccattttattgggctaaatatttcatgatttgttcacatttcttcttagagcagcagctatttttaaaacgtcgaatgtgccatcacattctatcacatatttttgacgtggcaatttgcattttggcttaagtaaataacatttttttaaacccactattttgagcgttcagtggtctgtaacagtgtgttataccataagaactggtatgaagtggttaactactagtttaataatagttgaagcctgggcgtggtggctcacgcctgtaatcccagcactttgggaggctgaggcaggtggatcacctgaggtcaggagtttaagaccagcctggccaacatggtgacaccccgtctctactaaaattacaaaaattagttgggcgtgcctgtattctcagctgctagggaggctgaggcggaaggatggcttgaccttgggaggtggaggttgcagtaagccaagatcacaccactgcactccagcctgggtgacagagcgagactctgtctcaaaaataataataatagttgcagatctagttgtttcatttgatatttgctgccaggagcagtcaaaactatgacaacatcaacacagttgtgctgtggaagcctgagaaacagccctatccagcctagggcatcattccctggggtcctggctgcctgctgctgtgcctatggggcagggggcagggatttaccctgccctttcctaacattatttggtgttcatcatagccctaattgttttctcattgtttcattacctcattgtttcattacctgtaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcagagactcctgtcatcctagcagtttactctgcgtttgttgtatctagacagtcaacaactgagttgtcggtgtttaacctgaatgcttgtttttcagaagaggactgtttgtgccggtaagaatgatcaggtaaggccatgaaagtttttgttggtgtttttgtttttgagatggggtcttgctttgttccttgggccagagtacattggctactcacaagtgggctggtagctggctacagccccagactcctggcttaagccacctcctgcctcagccaccctggcagctgggactacaggcatgcgccatcacactcagcttgaaagttttaatttactaagaatatacctgtgtttccccccatttcctgatttaaacagtactggcttatataggaacccatcaaagttaaattccccaaatttaaatttagtaaatttagtggtttcaccttggcaaatctgcaatagtttcaccagctcaaatttcatgcttttgtaagctgagcttatgtttgtgattttaatcctttaagtactactgtggtaactaatcatttttttgttttttttggtggtgtttttgtttttgttttgagatggagtctcactctgttgcccaggctggagtgctgtggcgcgatctcggctcactgcaacctctacctcctgagttcaagcgattctcctgcctcagcctcccgaatagctgggattacaggtgcccaccacaatgtctggctaattttttgtatttttagtagagacgaggtttcacccatgttggccaggctggtctcaaacccctgacctcaggtgatctgcccgcctcggcctcccaaagtgctgggattacagatgtgagccaccgcacccagccagggactaatctttaaagcaaagttttatatatttttacgtgagtaatgttatgtgtaggtgttctatttggcaaaataaatcagccttttctatcatgattgtggtcatttaaattaatcctcatcggaaacattgtttacctaagataaacattcactaaacaactcatagcaagacgctgggtaggtacaaagatgtcttatgtgtggttatgctttcaaagccaactgaaacccttttgtaaggagttaaatagcaaaaagtttcaaataactgtgtgcctctagaacagaactatcagaaggcaatgaatattcacaaattgtgaagagatagtttgcttcaaggaagaaatgacttgtaactagagtaggtatgaaatgatgggggaaaaatgatgaggtatgaaatgactcaccttctctccagctcaaggtaagaagggtggcagcaggagtaaaagctcagccacaggacgtgctcttcctgccaaacagctggattctgcacatgcttgggaatgaggtcctgctggtttaggaaaacaaacattaagaattcccaaagtcttgggtggaaaagcctgttgcttttcagaggcaaggccatcaccatttggcaaggggcccaaggccccaggcagctgtggtaccatctgtttctgaaggagtggggattttaccccctgaaatgtcagtttgtggcttaaactctgggttctacaggcccaaaataaatagtgccaggaaggtgcccctgaacagagctaaccagggttcagattggcaccccatccccactggggcaagcaggacacttagcaattaaggcctaagacggctgacaggtgggacatggcagaaattcagtgcttccaccacagctactcaatgtgccatgatcatgggccacacaccactctgaatacttagaaaattattggtttgggcctttattattaagtagcaagtaaataactgaaaaagccccagatttcagctctggctatagcagctttctaagtctgtgtttttaaggtgcaatttcttgaatcctagttctgtagaagaaacactctacccccccgccccccccaccccccccacccctaaaaaatgagcttcatgatcaagtacattttggaaccctcaggctgatccaagttcatagatttcttcactgcaggccttctgggtcctttaatatgcctgaagctggggctttcccttcctgagaatggcccaggactatccatgtgcctcattttgggaaatttagtaatgagttactaaatcaacaccacctttggcattctacatagcaaacatactttgttagatgtgacattttacacactaaccaatggagataaaattttttaaatttatttttggccaggcacggtggctcatgcctgtaataccagcactttgggaggccgaggcaggcggatcacttgaggtcaagagtttgagaccagcctggccaacgtggcgaaatcctttctctactaaaaatacaaaaattagctgggcgtcgtcgtgggcacctgtaatcccagctactcgggaggctgagggaggagaattgcttgaacccgggagggggaggttgcagtgagccaagaccacaccactgcactccagcctgggcgtcagagtgagattctgtctcaaaaaataaataaatgatttcttatttatttttttttaccagtgctctacatgttcagagaaacttctctggtaaccaaccacagaaatgatccctgaaagtatagtcttaggagataaatattctttacatagccaggagggagatgagaagccatacctgtctacagtctgactgacaaaggaggaggctccaggtcccctggagaatcccaggttttatgtaataattacttggtccttttcaaagtacttggatgagtgtaggatagtctctttgtcttatcagctagtcctgcaatctaggtgttctcccattttgtagaggcttgcagagatgagagacctgtccaaggtctcaaacccctaactggcagttctgagactagaaatactccctctcaggagtggacctcctctacaattttttttagcagtcctcatgtgccaaatatggcgtgggggccaggagacagaatgaggcataggttgggcgtggcccctcccctcttgggtcttgtagtcggctgtgggtggcaagtacagcagtgatggcagacaggtgtgatgagttcaaggacagggaaataacatccacagccccatcccagtactcctgtgcagcaatggaagtgtgccaccgacacaggggctacagggtgagcaggagtgacaggcgaagagaggaagagagctctgcctgtgcaaaggcggagggaacatggtgtgggaggaactgaagagaattccacataagtatgaagagggtagggagattgagactggagaaaaggggaagccggggctccccttttgaccatgcaacgcactggaagcacagcactcccagcctcagggtcctccatgattggagactgacaatgaattcagaggagcttgtggaagtcacccagtcaggtccagaaatcctgcagtgcatcccttccgttacccctgtcataactgggagaagacaccacccacatgacgcaggggagagtgcaggcatgagctagcacccatattgtcccctgcatctgtccttggctatgttttacaccccccaccccttagaacattgtagtcaaactaggatgtattaaattggctggttgctcccaactacactggacaaagtggagaaaaaaaaaaaaaggaggagctcaaggtttcaaattcccagctcaagctctgcataaaaactgctgtgacttccttagaagagacccctatctcctgtagctgcagggttgagatttctgagctcaagtgatctgcctgcctcaccctcccaaagtgctgggattacagttgtgagccaccctgcctggccagggctgagatttgtgaaaaggaaacccaaagtctcatcttgcatgtggctgaattatgtcgcaaatccaattcccaaattccagccttgcagggtgtcttcagttaaagtgaggacaacttgaaaatcggaatgggaacataagggaagattccagtaaagctggggacattgaatccctaaattctgtcatgttccctgccagtagaaacagcccatctacccctccctgggtccagctgtgtggacacagattggcagcgagtgtgcaggtgttatttccctacccttgtaatcatcacactttctttttctttttctttcttatttttttgagtcagagtcttgtgctgctgcccaggctggagtacagtggtgcaatctcagctcactgcaacctccgcctcctgggttcaagcaattctcctgcctcagcctcccgagtagctgggactacaggcgcgcaccaccacacccagctaatttttttgtatttttagtagagacagggtttcacccccaatagccaggttggtctcgaactcctgacctcaagagattcacccacctcggcctcccaaagtgctgggattacaggcgtaagccactgtgcctgacctcatcacaatttcttagccctttgagaaaccctgtggccttccctgaggtagctgtcttgcggggcacttctgattcttcttggatcctatgcccttcccctctttgctggacctgtaactagactcaagtcccaccaggccccagagagaaaggtacacactgtgacccatgaagaggtgtgttacacaccaaaagaactgcatgatttttccaatttatacagacaaatccaagagacatgtatgggagtagattttaaggttgtgagatcacggaaggaccatagtgttggatctggctgaacgtaatgatatgggcccactaagcagagattcttaactcagtgctttagcatgaggggttagaaagggctctaacttggttggttggttgtttggttcgttggttggttggctggctgaaacatggaccaaaaggtaggtggccgacaccgttccttattttgttattaatatatttgtatattcatatacaaacttgtatgctatgatatctaatacatattatagatataaaacaaatctttaggccaggcatggtggctcactcctgtaatcccagcacttcgggaggctgaagcaggtggatcacgaggtcaggagttcaagaccagcctggccaacagagtgaaatcccatatctactaaaaatacaaaaattagccggtcacggtgtcaggcacctgtaatcccagctactcaagaggctgaggcaggagaattgcttgaacccggaaggtggaggttgcagtgagctgagaccccatcactgcactccagcctgggtgacagagcaagactccgtctcaaaaaaaaaaaaaatcttttgtttctttcctctctcattcctttatcacctaacataagatggatcatcacagcattgaagtgacaggatgtcaagcagaagagtaaacatcacccaaggacgttgcagcctctctggggaaaggattggcatgttttctgttgtatgcaggatggttgagtcatgttaggtggaagtatggctttgttactgtctttatctggagattaagtgtggtttaaggagatgcatacaggtgccaggttgacaaagagagtactgtaatgattagttttatgtgtgaacttggctaggcccagttatgtaaacacgaatctaggccgggctttggtggctcacgcctgtaatcccagcaatttgggaggctgaggcaggcggatcacctgaggtcaggagtttgagaccagcctggcaaacatggtgaaaccccatctctaccaaaaatacaaaaattagcctggcgtggtggtgtgtgcctgtagtctcagctactcgggaggctgaggcaggagaatcgcttgaacctgggaggtggatgctgcagtgagtggagatcatgccactgcactccagcctgggcaacagagtgagactgtatcgcaaaaaaacataaaagaaaaaacaacaaaaaccccgtgaatctaggtgttactatgaaggtattttgcagatgtgattaacctgcatgggcctcatctaattatctgaaagaccttaattgcaaaactcagggttccccaaggacagagcaattaagtctatggcctgcagcctcagcttccacctgagtttccagcccaccatcctaccctacagcttcagacgcatctagccagcccctacaactgtgtaggacaatttctagaagttagttaatgaatacgctattggatctgtttctctggaggaaccctgactgacacaggggccggctctggaggttgtggggtccagttccttatccctgtgtagtgtattggccagttggggtgggaattgcttccaggcaggctgtgtcatttgttcaggcagggtcccctccccttggctctgcctgagagcaaaggcaggtgggggtggccctggggagggcctgaagctttgctctgtgcctcctaaagctttcccactccagggaccaggccaggcaggctggcaggaagaggcaggcttcatctggaaggatgtctccagggtggaaatgatgagatttaaatggtgtagggacccggagggtggggtgggacagcaccactgacccagctgcagagttggaccctctgaagcccattgtgtacatgagaatctgtgtgcctgattgcgtaggtgcctatacatggataggctgcgaatctgtgtgcacacagctggctggagagcacatgagtaggtatatgtaccacattgtcagcactcacccattagctcctggggactcacttgctgcaggtgatccctgtcctcgtgggctctacaccctggcaggtcaacacagactacaaagaaacaagcggacataaaatgacaagggctaggacaaaaagcatggaaaggagaggggataacgtggcaggggacattttagaatgcagtggtttcgacgccaggaggaggagtggttagacagtggtcggggagggcctctgaagaggtgacacctgaatgatgagctggagcaaaccaagcaaagattggaggaagagcctccaagcagaaagaactgcaaggacaaaggccctggggcaggagcgggtacgtgtgtcctgtatgtgtgtgtcctgcacggtggcaggtgtctgaagctgagcccagaggagctgtggagatcaggcccagaagtggagccacagcacgtagggccagagacctgcagtaagaaatgggatgtggtcgagatgggatgggagccaccgcagcaccatggggcgggagcagcagagtctgatgttgtgtacttcagggagctggagttctatgaaggaagagcgaggaggcgtgtgggaggaagaacagccccactgaggcctgcagggaaggcagcagaccccaggtcagagcatgaaggtagaggggaggttccaagaagtgggttggggaataagcactggatggctgatgacagagggcagggtggaggatgcggggccagggagggctgcacagagtcctgggagggtgagcggtggccctggctggctaggaggcgccaccttgaggtgctactggaggatacgccgcagggaaggtggatggtctcttctgatgacaaccttcttgctggcattagactgaaaggggaggtgatttgtagggatgaggccagaggggttgtccccagggaagggcaccagatgtggggcaggagagctggtgtgagttgcagccgtggggcctagaggaagtcacagcaccccactgaattctcacttcctcatcataacagaccctgtgacatataaaacctgctctgcccaccgcacagggatcacaaggctggagtgaaataatggagcacttccccagagtggcacacgggacccagggacgggtgtgcaaaaccgttctaggtggaagaacactttttttttctttttctttttctttcttttccttttttttttttttttttttgagatggagtctccgtctgttgcccaggctggagtgcagtggtgcaatcttggcccactgtagtccctggctcccaggttcaagtaattctcctgcctcagccttctgagtagctgggactacaggcacccaccacaacatctagctaatttttgtatttttagtagagacagggttttaccatgttgaccagactggtcttgaactcctgacgtcaagggatccatctgccttggcctaccaaagtagctggtattacaagcatgagccaccgtgcaaagccaaaaacacttgattataatagcatgctatttttcaatgtattagataaatgtattttccatttaaagtggggatataaagctcccctttaaaatccacataagtaaaaaagtcagtctgtttaaaaggttaagtaaataacagtctagggcagatgcacaaaagacagcatcatgaccgtggttcctgaaggattaaggttgcaggaaacactgaatgctaaaagctttgtgaatgtatagtccatgaaaatgtcttttaaaaaatgaggtgcataccaagatgtttgagtgtgtgtatttggggtaggtgctgtgggcatacgggtgtacctgtgtgtgtctcacaagcaggtgtagctgggtgcttgtgtgtatgtggtgtgtgtgtatctgtgcacacgtgcatatctgtgcccacatatccatgcacacgtcctcataaggctctctgcggccaggtgcggtggctcacgcctgtaatcccaacactttgggaggccgaggcggggggatcacgaagtctgaagttcgagaccagcctggccaagatggtgaaaccccatctctactgaaaatacaaaaaattaagacagtgagtgttgatcgtgaagaagggaagatgaatgtggggattaggtgggaggaatggggtgctgtcaagatgaaaataaacttagggtggagaggctggggcaaaagagaggcccaacagtatgatttgccccagtgcggggactttgtgcctggtgatttgaggtggcagggcttctacccaggcctgatgggagctgggattaaaagcagctgtgacctaaggcaggccattgctctgtggcctactcccctaactcttttgcagaaagtcccaggctaagagatgggggatggttgtaatgacccctcccagaaatcctggctctgtcctgcagaggtggggcccggggatcaagacgcctctaggttcaagagagaggcagaatgaggggtcagccagctggggcaggaaggcttcactctaggctgcaaggagagacctttcgccttgactggaaggacgtgaggagcctgtggcctcctgtttgcaaccaagggctgaggaaggggccgggcattcctgctgtaggtcaatgacctggagaaacacatgcttgaggacagagctcagatcattgtcccagcgcaaaccttggtgggatgtaaggtttggagcttcttaagttccaagaggcagtctcatgcagttcaaggagggctggagaagcctggtctgctcatgggagtcaattgttaaattttcaggaattttgtgagccaattattgaacacagctattattaaaaacaaaattataggctgggcgtgatggctcatgtctgtaatcccagcactttgggaggccaaggcggtggatcacttgaggtcaggagttcaagaccagcctagccaacatagcaaaatcctgtctctactaaaaatacaaaaacattagtcgggtgtggtggctcacatctgtaactccagctacttgtgaggctgaggcatgagaattgcttgagcccaggaggcagaggttgcaatgggctgagaccacgccattgcactccagcctgggcaacagagggagattgtgtctttcaaaataataaaataaaataaaataaaataataggctgggtgccgtgactcacgcttgtaatctcagcactttgggagaccaaggctggaa

SEQ ID NO: 407 - DNA, 1867 bp, Homo sapiens
gacgtgaacggtcgttgcagagattgcgggcggctgagacgccgcctgcctggcacctaggagcgcagcggagccccgacaccgccgccgccgccatggagtccgagaccgaacccgagcccgtcacgctcctggtgaagagccccaaccagcgccaccgcgacttggagctgagtggcgaccgcggctggagtgtgggccacctcaaggcccacctgagccgcgtctaccccgagcgtccgcatccagaggaccagaggttaatttattctgggaagctgttgttggatcaccaatgtctcagggacttgcttccaaagcaggaaaaacggcatgttttgcatctggtgtgcaatgtgaagagtccttcaaaaatgccagaaatcaacgccaaggtggctgaatccacagaggagcctgctggttctaatcggggacagtatcctgaggattcctcaagtgatggtttaaggcaaagggaagttcttcggaacctttcttcccctggatgggaaaacatctcaaggcctgaagctgcccagcaggcattccaaggcctgggtcctggtttctccggttacacaccctatgggtggcttcagctttcctggttccagcagatatatgcacgacagtactacatgcaatatttagcagccactgctgcatcaggggcttttgttccaccaccaagtgcacaagagatacctgtggtctctgcacctgctccagcccctattcacaaccagtttccagctgaaaaccagcctgccaatcagaatgctgctcctcaagtggttgttaatcctggagccaatcaaaatttgcggatgaatgcacaaggtggccctattgtggaagaagatgatgaaataaatcgagattggttggattggacctattcagcagctacattttctgtttttctcagtatcctctacttctactcctccctgagcagattcctcatggtcatgggggccaccgttgttatgtacctgcatcacgttgggtggtttccatttagaccgaggccggttcagaacttcccaaatgatggtcctcctcctgacgttgtaaatcaggaccccaacaataacttacaggaaggcactgatcctgaaactgaagaccccaaccacctccctccagacagggatgtactagatggcgagcagaccagcccctcctttatgagcacagcatggcttgtcttcaagactttctttgcctctcttcttccagaaggccccccagccatcgcaaactgatggtgtttgtgctgtagctgttggaggctttgacaggaatggactggatcacctgactccagctagattgcctctcctggacatggcaatgatgagtttttaaaaaacagtgtggatgatgatatgcttttgtgagcaagcaaaagcagaaacgtgaagccgtgatacaaattggtgaacaaaaaatgcccaaggcttctcatgtctttattctgaagagctttaatatatactctatgtagtttaataagcactgtacgtagaaggccttaggtgttgcatgtctatgcttgaggaacttttccaaatgtgtgtgtctgcatgtgtgtttgtacatagaagtcatagatgcagaagtggttctgctggtacgatttgattcctgttggaatgtttaaattacactaagtgtactactttatataatcaatgaaattgctagacatgttttagcaggacttttctaggaaagacttatgtataattgctttttaaaatgcagtgctttactttaaactaaggggaactttgcggaggtgaaaacctttgctgggttttctgttcaataaagttttactatgaatgaccctggcaga

SEQ ID NO: 408 - protein, 391 aa, Homo sapiens
MESETEPEPVTLLVKSPNQRHRDLELSGDRGWSVGHLKAHLSRVYPERPHPEDQRLIYSGKLLLDHQCLRDLLPKQEKRHVLHLVCNVKSPSKMPEINAKVAESTEEPAGSNRGQYPEDSSSDGLRQREVLRNLSSPGWENISRPEAAQQAFQGLGPGFSGYTPYGWLQLSWFQQIYARQYYMQYLAATAASGAFVPPPSAQEIPVVSAPAPAPIHNQFPAENQPANQNAAPQVVVNPGANQNLRMNAQGGPIVEEDDEINRDWLDWTYSAATFSVFLSILYFYSSLSRFLMVMGATVVMYLHHVGWFPFRPRPVQNFPNDGPPPDVVNQDPNNNLQEGTDPETEDPNHLPPDRDVLDGEQTSPSFMSTAWLVFKTFFASLLPEGPPAIAN

SEQ ID NO: 409 - DNA, 71057 bp, Mus musculus
  misc_feature (1)...(71057): n = A,T,C or G
agacaccaaggaaaggatttgtaactgatagttggaggattagggacacaggaaatgaacatccgacagcagagaaaggggttttgcggacaaggcagatagctgacttgaaactgagctgcctgtacgtttgcagaaagaaccagtatcagtgcagttccttggtcaaagcctttggtttgaatcaggatgagaaaagtgaccaaggcactggaagagaaaggagaatcacaatctcattgttaaagtatcttggaaagacactggaggagggggtgggggtgtgttctattggtgggatctttttcaccttctaacacacaaaatcctgaatgacctaagagaagattccacccgtggctttgcgttggtttattcattcagagatttgctatgtctatttcaagtcataggcttgatgtctttggctgagagatgcctacctcccctaaaacgtttctgatgccagtgactaagacagaaaatacaaagtgttcaagatgcagaagagggaaagcaagaggctcccttatacctcgggaggaaacaagtctttgttgacatgcccattttagacctcttgctctcaaaactgtaaaagaaagctttctatggctttcagacgcatcttcaagaggcagacacaaggctggagagatggccacttgttcttgtagaatagtggttcttaaccttcctaatcctgtgaccctttcatgttgtggtgacccccaaccataaaatgtttgttgctatatcataactgtaactatgctactgttctgaattgtaatgtaaatttctgatatgcaagctatctgatatgtgaccccgggaggggtcgagacccaacaggttgagaattcagctttgattcccagtactcacgtggcagcttgcagccagttccagggaatgtgatgccgtcttctaaccatatatatatatatatatatatatatatatatatatatatatatatgtatatatgctcatatgtatatgtgtgtgtatatatgtacatatacatatatatatatatatacacatatacatagttatatattgtgctgagatagaggtataaaaaacactcattcacataaaataaatcttgaatgactgtatatttttaaaaagcacatataccctatgccagaccaaaatagactctttaagcagcagacccaaagatctgcactctgtagtgtttctcaggactttggaacaatcaggcttggccaggactggaaaagagcaactgagtatgtcactggtctctctgaactcacgtagctcagtgctgcaaggtgtttttgaaataaaaatataaatttcacaagctgcctgccattttcttaacaaaatacccaagacgattaggcagcagtatgagatacccagattattagttattggacctctgtaactacgtcagagctaactggtcagcaactggaggccctaggctacaaacacagcagcaggtctggtttggatgggaaactattgtgtttgggcgtgttcagaaagggataaggaaggagacctgaatggtcaggactaagcccctgcaggtaaacagaaacccaagctggagactcagtagagaatgtgggaggtactgataacaaacaaggctaaccctcaggggtggagaagaactgacaggcaaaggaggaaggaagaagcgtctctgtctttcctgggagttctcgttccttcagaggtggccgaggaagaacagttaaaactggagagtgagagaaaacaacccttctataaacagatccgcccgaatgagcacaggacccaagcagatgaccctaaactttggcaccatccccagtagaatctgtatataactagaccttcaagccatgatcacacgtcttttatgcagctcccatggctgggaatacagttcagctgatggagtattcgccttgcaagcttaagtgttcaatttccaagactctatataaaaacctgcccatggtggcaatgcacctctaatcccagcactggtgggagggaaaagaatatttctggggtccacttagtatggttcaggacactgaaagacactgcctcagcaagcatgatgaagggggcccaagggaggatatccagtgttgccctgtggccagtgcacacacatatacataccacacacacccacatgcacacatcacacacatatacataaacacatttacataccacacacatacatatgcacacatgccacacatttacatccatccatacatacaaccacacacacacatatatagcacacacatatacataaacacatatataaacacacataaatatcacacacacatacttaaaccacacatacataatacacacatacataaacacacatatatgccatacacacatacataacacacacacacacacaaaaccaagggaaagaagtttctcatgaatgaagggaatccaaagataaggaactcttgaactgggggtgtgacatgccccagtgtgcatctcaggtgagtttgcagggagagaaggaagcggcaggaagggaagcagcaaggcaatgcaaaggctggaggaagcttttgatattcgccctgcattgcatcagccagtttgccttaggctggtagctgacttgcagtgttactttaaagacagatgacaatgtagcatgcacaccttcagcagagtgcctcatggggcagagggtcacaagccatagctgtgcgtcttactgttctcagtatcttctccctcaggtaaaccttgtcttctagaaagctgaaaagcttgtacttggaactgtaccactgcgcatgcctaccctgagtcaacctgcttcccatttcctgcccccagaacccactcctatcttcaaagccgtccccacagctgccctatgaagattgtcagtcttcagagttgactctcctttgtcctccctccccccacccccgccattaatggtagattgccagactacaggagacttatgagtaagtctatacccttcaatccaatcctcggggcccaatgaatgcctagcccagaaatgccttccagtgatggtgtgtgcatccgtaagaccatgatgctggctgtcgtcttcggaaagcagtcctggtgagagcccatccatcttaatgttctctgcctggcattaacagatggggaacggtgtgcttggagcctcataaagcggagggaggctaaaacttaggaattgctgcctcttgcatggtgcagagtctgggtgatgccccagagacataatgagcagggagatagtaaccttagaatgtgtctgtcatatgtccaaaggtctaaaccacttcaggccacacaggatctttctgcctttgtctctcacctcagtccaggtccctgtgaggaatgctcacatccacacatttgctcaactagagagaagccagcaacactctgggcacctggttggcactgcctcatatcattaaggtcgttccagtcactttctctgctctgattccatgcttagtgggaagagctctcacaaagagcagccctcgagggcaggcaacccactgacaaggggacagggatttactttctttttaagtattgcttgaagttcaacataactggcctgctccttagaaagaattctggtctaaagaaaagcagtggtaggccaacctggctgcacatgggacagccacgtgtctgagttaaaccagcttgtcctggcctgtaataagggaagttatgaccaacgatccaacaaagacaccagttataggcataatgtccgttggtcactcatgacatggttcacataaaaccccaggaacgccataaaggatggtgatgatgttgatgaagcaaacccttgatcttgatttgaaggctctgtgaatggagggtcttgagctcctttgtgactgtaggccatggctttacgccttcccagtttcaaagtttcctaagcactagactatacactctagcatttcagtctcctagtgatgctacaaggtgggaaatggacatttggtaatatttcactcagaaaaacaaaaacaaaatggagatctgagattatccaaggtcacagaacaagagttgaatcagttggaaatttcatgggtttattaaatggccatatatcgtttattctccaggtaaggggaaagaccacgtgtgctagctagagtcgggcagagctcttttcagctcacaacttgtgcatgtgctagccagccacgggaaaatagcatcgctcatttctctaggcctcgttgtcttgtctgtaacatgggatgacagtgccgtatatgctatactgtgcgacaagtcatgactgagatagagttttagagattgatactgagtcagaacagttaggcacatgataaagatgctgcttctgccgccttgttctccttctccttctgctcctcctactccatgctaagatgttactatgtactgttaagatgtgccctagtgacaccagttacccaggtannnnnnnnnnnnnnnnnnnntctctctttctttctgtctttctctctctctctctctctctctctctctctctctctctctctctctctctttctttctttcttcccttctttctctctttctctcctaaacaattccctggtcttctaccatgcgtgcataagttctactatctttaaatactcccataccgagggttgtatttttatatctctcctattatatgccactggtgttcaccagagcagcacaggccttagggaaaggatggggatgcctagtcattcttgaagaggaatctagagttccctgtagttgtcttacttttgttttcttcggtttgcatattactgagcccagagaataaattattcataggtaagttgattaattataattgtccttttcaatgttttggggtgagttggaggcccctggaagagggaaaaggacaaatgacccttgctttggcaattcaatgcttttcactgtggaattaattccctggctaaattggcaacaggctgaacaggttcatctagagctttggctccactgtacaatgcgcttcataatctcagagcagtcctcccaatgcacaggttcccaggccctgggagggcacaggagcagggcaggcattgtgcacagagctaaatttcacagctatcaggagactgaaacatagccactactcacataggacaaaccctccgcagaccttcagaggcaggatggctgattcccaccacctgccctgtcacattcctctgcacggccccaactcatccctactgatcagtacagttaagtctcttgaaaggacaacaggtagaaaccactggttgtatgtacacacataagggtaatttccaaaatcagagaagagggccttacagccagcatggaaccttgctttctatggtctgttctattcctccctctctgaaccacacactgaaaggttggaggaaagagaatcagcaaagtcccccaaactctaaggatgtcccgtcattgaccatcgggactcagagatggggccaggaaggaagagcagcccagaaatgaacatcatgaatgaagacagatgggtattgtggttatacccggtgtaggacactgaggctgagctcagtttgctttatctttgcatctcacatatgaagctgcatatatcattgcttagaatggccaacaagccatacattcaactagtgactcattgaactggcagccaaaggatccaaggaaagtgcttctttacttccctgatgccttcatatgaaaccagaatcaccggatgtgataaacagatcctctggctgttgccaatgaactactccatgtcctatgtactcccttccctccttgactcagtcttagccacacccctaattttgaatgatgggacatcaggcaagtaaaggcttcagggacagcatgttggggcttatctactttgctgagaaaaccattcaaggaaggccaactgagaagagagagaccttgatactaactacatggaagaagaggaagaagaagaggaagaaaaagaagaaaaagaagaaaaagaaggaggaggaggaggaggaggagaaagatgagccatgcaagcacccagccaacagaagactggggtgatcgtctttttatggaattgtctggaaaaaaaccaaaccaaaccaaacaatagcatgtcatggaaggagctcaaaaataggcaactgctactggtaacttagggtgtagatgcaggtcaaccttcatggtgatttgccactctgcattcacttaagaatcagcctcaggactcaagggccacctttcctggcagatggagaccatcacagaaacccacaagggaacacaatgcagagatgatggcgagcacccctccatcacagctcctacatgtgtgtgtcaaggaatgaacatttcagaaacaagagctgaaacatttggaagaggtggagttccaggaagtccgcttacgagggattctctcctataattaaaattctggaacactcgtcacacccttgaagtagagaagacagagggaagagcgagtcagtgtagtaagggagtaggggcttcaggtcgccgatatccagagatgaccaagaccaataaagggactgagcagtcagtcaccaagccagtttattttccgcaatgagaactactacaaaaccacagccttaggctctcttggggtttaggacaatgattgctccaggcaagcaggttccttgaatcaatgagtttcctatgtggaaacatggggaagagagggaaggcagagaactctgaacatggagccctggggctgtgctaatggatcatcacactggcctcctttcttatgcctggaatcttctgcctgtttccagtcagtgtgcttgcacatcgccttgtggatgggttcacagggctgtggggaaattagcaagattttattgaaaggacccagatgttagctgtctcttgtgagactatgccggggcctagcaaacacagaagtggatgctcacagtcagctaatgggatggatcacagggctcccaatggaggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncattggaaatgtaaatgagctaaatacctaataaaaaatggaaaaaaaagagaaaattactccaaaaaaaaaaagttaaaagatgaaaccttcctctctctctgacaagagcacagaagctctcctgtgtgtgtgtgtgtgtgtgtgtgtgtgtgtagattaacatgggcatcttctctgtttctgagacagggtctctcactcaacctggagctcactcattgcctaggctggcagccagtgagcttttaggatctccctatctctgcctccccagtgctggggttacaggcccatgctgctgctgctggaggctgttcttcctccctccctcccttttcatgttgatgcaggggaatccaagcttgtatcttcattcttatgacccaagtgctctttaatccactgaataatctcttcagcttccagcggagtcccttcttttctgagaagcaaaccgactgaagggttgggaagtttatgagggaccactggctccaagctcacctcaggctcttctctgcactctccttccagtaacagatgcccacgtcagctctctctgttactgggttttggagtccagactttgtgtgcttctatggcatcctttccctggtatagccaggtcttatccatccatcatctcaccagccccagcccagtcaatggcatgcagtggtgctcactgaatgtacaccgcatccaccccagggctcatgtttctgggatctgacatcacaagagcatctcagaatgtcatcttaccattcactttgcccaggtgttagcaggaggaaatgaaggccacgggaccagccgtccatttacccggaaacttctgctcagagaaagagtcagggctacttatcatgaacttccagtgcccttggccagggtccggaatttcctgaattttagatttctcttctctcctttcttatctctcattttttggtagtggggtgggggaggggcatcccagtaatatttgcaccccaggaacccagtctatgttcacaaaagcctttctgcctcattgaaaagcttcttgcagacccttccccacaggtctgaggagacagctcactgtgatatagaactagctagacatgggtaaggccatacattcaaccatcagtactgcaaaaaccatcccacatgctcctccacgggtcagggggacttagtgctggatagaaatgtgtaattggtgggtgggtgggggtggaaagtggaaagagaagcgtggagatgcggtccgtgtgtctcagttctcctggctggggaggcagaatgcctacattccaatccatccactccgccaaggtgttctcccccacaccctcagcagcaaggtcaaaaaactggccttttcacagccttcaaaaggccagagggttgtgctgcagccacaaacaagattcccctaatcttttaacaaagagtttacaaatttattttaattagtattcagaccttctaagttagcccaattacagccatgctgggccttttaaatactcctaactttcattccttgtgtttaagtctctcctgctttccttccattgcaagcaaatgtctgtcttgttaattccctcggacagcgtgggagacagttcacttcagtctgcagctcctgtctccattctacgtttttgcacattgtttggaattcaggaaagttgatatcttaggtcggatatgcagtggggctagaaggaaagtactaagctcaccaggagcgaggaggagaaatatccagaagtcattcgcttcaagtctatccaaatctcctaaacttgtcctggggagctttaaaaaacattgctagccaggacatcgccccggggggtgggggttctaatttaagtccggaatgccacttggccatcttttaaaaatcatcttcttttaaaatcaccactgacacgaatttctcattgttctgctctggggggcaggggggggggaacggagggggaagggctcgcgtgcaaaaggagtcagggtgagagttagcgcgcgttattcccagcgcaaggcagagagtgaagcaggaaatctggcacctgcgcttttcgcagcccaccaacgccgcaagggccggaaaaacagcgcgtgcggcgacgctacacacgcagccctgggggggcggggtggatgggcgggcccgatttgggccccgcccctgcacgcctatcggcgcgcggtgcgggccctgacgtcactcttgtcagggcagcggcacatggactgcctgatgcgctgagcccggcgctgcggggccgcggagcgcggggagcagcggccgcggcggggaggggggtggggcgggacggcacagcctccggtgctcgcgcgaggggccggggcccgcgctttgccttctgctcatctgcagccgtctacgttttcaaaatttctctctttcctttttcccccacctccttgcaattttgaacattttgcaagactgagtgttggaggcaggtgagaaagcatcctgcactgggtcggaggagtccgcggcgctagatgcgcctttccctggactgtcggcactgagaacacgaaagtttttttgtttttgtttttgttttttttgatatttgtatgctgatgtatttacaaagacagaagtgattttttttttttttcttccttgtctgcactgttttgaaagcgagtacttttggttggcaaaggacggaggaaacaaagctcatcaacatttcggggcggcgattggccttctttttaaaaagacaattgagtgcatcacgatggagaaaatgtcccgacagctccccttgaaccccacctttatcccgcctccctacggcgtgctcaggtccctgctggagaacccgctgaagctcccccttcatcctgaagacggtgagcgttgcctcggcagctgggctcagggaagggactacactcccagggacccccctagtcggctgggagggcaccagcatctttcttcccctcgccttgctttagtgaaattggggggcttactccctctttctcctcaatgcaaaggggatccctccggggcaacatttgaaatagcgctgggaacctggctcgcctgcctttctaggtctgtcctcctgcagcgcaggtgacaggtgaacttgacaggtcaggatcgctgctttgagtgacagggtgtgcgcttccctgggagactagtgtctctgggactggagaggagaaagggcgggaggtggctggttggagcctggcagagagggggggggggtcaaagtaaatgggggttctcactcggcggcagcctgaatattcggatcgtgttagtgttttgtgttgtgaactcacgcggcatgagcggagaggcgctttctcccgcagacccgcaattcacaaagcggggtgggggtggggggagtggtctgtcggcgggaagcggtgcacgcctccagcgctgacactttcccggtgctctcttcccggtgggaggggagagctgagcaggctcacgtgtaaccgcgtgcaggagcctcctctggcttgagccctttcttggtaagtctcaaaccttccctaggtaaccgtggcttggagctaaggagacgggtagggggatatggtggggagtggggggggggggctgggggtagatgcatgtgagacctagctgggaacgcaattgatgccagaacggatttgtgttttgggccggtgcagtttcttgcctttggtgttatcacagtgacagaagcgaattatgctgctcctgcataaattcttgaaaagattatttggctggaaatagcttcggggtgtttgcatcaatttccctgggagagaacgcctgttgcattgcaagagttgctggtgcttgattgcgcgtgcagaccgccccccacccccaataccctcccgcactgcttcttaaggagtagcatttgggagaaatctgcggatgcgttaggcttttgtggtcgatgtttttaagcctaactctaatgagactgcggaggatttgaagattcgaatgggtggcggtggggctacatttctctaatgagaaacaaaacaaaacaaaacaaaactcagaatcaaattctctaatccctgattccacccacacctgaatattggcaaaatgcagacagctcggtaaagaccaatccgggggtgctgtatttccaggcaggaaatagctgcattcttaccctcagagagtagaacacagcacctttgcatagtactgccttgtgatggggtacataaatgtttgctttctttttgtaaattaggtaatatttaaatgtttggggggaaaaggaaaaagaatccaccttctaaaacagacttagtcctcttgagggttctaagcaaatggatgagttcgaaaatacttcatttctaccccgtcacccggcctgaccacccctccccccacagtctccttctatggtgagagagcacccttatcttccttgtaaatgggggataattgtaggcttgcacgtttattgagataatacatggaaaggaataacgcagaaacgacgcgtagtattaagggaaggtgggggcggggactgcttactaagactaagcttgcatcccctggtttgtaagtcagaatgacctcagattcttgtggtcatcactttctaaaaggtagaatcatcccaagttatcggtggtcccctttaaaaatcccatcagttgtatatattctccggtgttattttctcagtatagatttcggtgacttagcccttcaaataacacaccggaggaaggattattctcttgttttcattccagatcagtcggtagccccgtcctgtcctacagaccagaaagctctttctttccaaagtaaataggaagatgtcgaaactctagatccaccagaggcagcagccagaggcctcggtgcccccagaagtcattttgtaaccgatggcaggaaggctggtgacagactgaccccttttcttttctgttttaaaaaaaacaaagctcacctttccctttttcttcttcttcagcatttagtaaagaaaaagacaaaggaaagaagctggacgatgagagcagcagcccgaccgtcccccagtccgccttcttgggacccaccttatgggacaaaacccttccctatgacggagatactttccagctggaatacatggacttggaggaattcctgtcagagaatggcatccccccgagtccgtcgcagcacgaccacagccctcacccccctggcttgcaaccagcttcctccacggcgccctcggtcatggatctcagcagccgggccacagcgcccctccacccgggcatcccgtctccgaactgtatgcagagccccatcaggccaggtaaattctggaaggttcacccgtgttagatgtgggggacaagacggaagtggggcgagcgaggttggcaagagttggagatcttaacacacatttctagagaggagccctctcttcctgttctgaggagccttcctccttcagagcatgcgtagctctcacctgcagagccagttagaatactctatggacctgcccttaagaagctgatgttttccgggtctggggtttgaacccagacttcattttaaccaaatcccaggggaattctgagtggttgattcgaaggctatagtttgtgatactccagcctggagttaatgaacgggctaatgggttaatgtaaaacaaacatctatcctatctcctaccgccttctcctggtccccaaacacaagggtaatagaatctcgctggataatttgggtagaccccagaaagttaactcatattcactcttctctggcctaaaggggtcactgcgagtagacatgcagggctcttctttttcttctttctttctgtctgtctgtctgtctgtctttctttctctttctttttctctctctctctctctttctctttctctcttccttcctttctttttttctttcttcctttttcatcttcttcagtcattgactcagaccaagactgtaagtaaatgcaggtcttcctattgcctgaggctaagcctcctttttcttagcaccctgtgttccgtgagccaatcttcctttatatatatggttttcagtgtcatcccatatcaaggcttgtgcccacgtaaaaagccagccatggtggcacatttgtaaccctggtgctaagaaggtggatacaagaggatctctggggttggtggacagccagcccaggccactcggacacacatgcacccacatgtacacacaccccacctcccacatttaaatgggctcacacatatacacaaataaatgacgaagaatgttgaaagagacgacacagaaacattgccgggaaaaactatgctttaaaaacccattgccaagtgggcaggggtaaggcctgactaaggcagccctggatccataccattcatacgccgtagcacaaaacaagcaggaagacagatcattgtatggacaggtagcgggaacaaagattcatacggataaattgacaggaaggtcacagatcggaaggcgcttagctgcagggaaaggcagcaaacgggacaatgagagacttgtattcgcagtttctgctgaactctgtgccctcatgcagaaatttctgtcacacacagaactgggaaggaactgagaggaggaaggaagagaacccctaccttaataggttaacctggagttcaaattcgccctttcatagatctctgggctttcaaatctattttacacaatctccaaaatccactttagttgccacaggctctattgaaatgaagctttaacctgcagatatccccggaggctacatcaccctcttgatgtgaattagatgacctgctatgaggaatgtgtagtgccaatgtctttagtttcttcacggggggaggcagctagcaaactacatagcctctccacaccagatgtaatgatgtgtcacggggagagagcagagtcccagagagtggtcactggcattcctatatcctactgcgtatctaagtgactgtagaaatgacataacctcttggagcctcactttcccctttaataggtagatatcgtttcaatttgatggggctattttggtaaagatagataatgtgccaaggtcagatggcagcttccggtggtctgttcatctgaatggttgtagctgtcactaacttttacttatatgaccatcctgtcacatgaaataacttcctgaagccactagatatggttactcagcctcccttgaagagaaacaatgggagattttgtccggtgagcattgtctagggtgttcctattgaaagtgaaaaagtaggatcttggaatttgaggctcagtcatttatcaaagctccttagaggccaaagtggtccatgactcaggtgatggtgattccccaatcagagttgctgtccgtagcaagggactccaaagtgtctggatagcattttattaagttatagaagataccaaaggatctgaaaataagccctccacttaaatatcctttcaaatgtagtagaataatattgcaacacggctttgttctttgaattgaaaaccaagtgatattcctagcaggaaaaaacaaatcaaagctcttttttcaaatgccaatagattaaaaaatttcgcattctgtcattcatacaacattgcttatgataaagattatactgagaaatgaaattttagggcccttgatggatgtgttatctcaaacaagccagaaaagggtgaaagttcttgactatgctgcatagctcacaggggtgaccacagtagaaactctcagtgaatcttgaggaaaacgagtcttcagaacgaaagagcacagatgtagccaggggcattctgggaactgtgatttcagtctcaactgaggtatctcatccttggcatgctcccttgagggtaagtcttgtggtgtatggccttgtggattaaaggaagttaagggacatgactactcttttctttagatgccagggacccccacaacccagttgtggcaaacacaaatgtattgagtcacttcacagtgtccccaggggagtaaaatcactcctagctgagaattaatgtcctggaccttcaacttggacagcaaaatctagacttaatttaggctactatcatacaaatgagtgctcttcataccctataataatctacggcaaatgttttgagacagcccagagacattgggttgccaagaaaaaaaaaagtcatatattaataagagtgttctgagcttttaggggatagaatgaagttaccagggtaaccaggggataataatgcctcccagttcaaacgtttgccctcaactgcttgctcagtatgcgacttttgagttatgctcaatagcattgtgtcaatagtgctgcctgtctgggtgaaaggtactgtgggaagccagacggagagttatgcagaatgaggtctaccttaagggtatcttggaatggcaaggtgagcatagttgtgcatcttggaaaccatgtgtcatgactgctcccagacagaccctttccctgtgttacacattcagatctgattcctccatgcaggtgtgtgatccaagaatgacccagtatctacagaaataaaaatgttcccacagacctattctagagagttgaaggctctggtggggataatgccgcgggttgtcctctccttgagggggacggtggggggtcttggatgcagggactccagggtgtctgagtgcagcaccctggctgttcccagaccagcaggaaggtaagactcattctgtaggttttggcatttgcctgtcagattgtatcagaggtcgtggggagagcatgctcctggaggtggtatgctgggtactaggaaaaataagaatctgtttgccctgagacttgagtgactgctttaaggacacgctgtccctttagggaaagtcatctatagcagacaaaggcagagatatttttaaaccctgtgcttataaagatggatttgaaaccatttcttcgtgtgtgtgtgtgtgtgtgtgtgtgtgtgtgtgtgtgtgtgtgtgtgtgtttaaatagcttttgggtgctctgccactttaaggcccagattcaactgagaattgagaagggtttctttttcagttctgagcccagggactgggctatgatggaggccgggcacacagaaaagtgaaaacctttccatgtggccacacataggaagaggaggacattgaacagatggcagtgagagatggggacaggggtacttgctgtagatttgcagcctggagtttgtgtcctctttccactcactgtccttggtggtagggcttggacatgggagggaatttccagctgtgggatctgcgtaatgatgtggggagctctgtgcaggtggattcgggaccatgggaagtcccacagaggaaaacgggtgaagctcactttaaggatctgcaggtcatttattttccctcccagcacatatccacctgctggctgagatccccatgagtcatggtgagatctataccacatcgagaatcttaggagtttctactgcatttggatcaaaggaatcctgagggaggaagagggagtggagagagagagagagagagagagagagagagagagagagagagagaacagtttattctgaatgtagtctcttagatttccttatcttgtctcccatgtcctgggaggggacaggcttcgcctgttctcatgtcctggttgctgacatatacagaatagcagtcccttgcctgtgacaagagatatttggggaggaaaatggaaagcaagacatcttggtgataggaatgtaggctttgggacaggaggctgaggtgttcatggtggactcacccttggcttgctagctcattttgtgtttgctcttatttttttttttaattaaagatttatttactttatgcatgtgagtacagtctctatcttcagacacaccagaagagggcatcggaccccattacagatggttgtgagccaccatgtggttgctgggaattgaactcaggacctctggaagagcagccagagtgctcttaactgctaagccatctctccagccccttatgcctgcttcttaacctctccaagcctcagtttacttagcaatagaatggaggctacaaatgccatcctctccgtggagtttcatcaggcttaaacaggataaaaaagtggcaagatacagtgacgcttccggtacaggaaagctcactgtccttatgagagcagtgacagggtaaaaaaaaaatggctgggttccctgtccccgttctccattttggggatttgttcatccagtcctcttccctctgcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccttctcttcccaggagaattatagcaagtgccagtgagcagttgtaatcctgaccctggcatgatgaggaagctgagctccagaggaagagacaggccagggaaacctgttctctctggcggcatccaagccagcccctaagcctggcctctggcctgcctctctgaggccccatctcctctctttcctgcactgtggctgtgggcaggattcctggaggccggctgctgccaagggtcttggcagagcattctcagttcagcgctgtgcctaccagactagaaaaatagcactagaaagacagaattaggtggaggagaggaagaggtggtgggggagtcgggagacagcctggatgacatcctaatacagaatcccagagggtgaggagacagcgatgatttattatgtgtctccgatacctctcttccaactagcgctaatcacgtctacacaggaatcattttttatgtcttagcagtgaaaacgaaggggagaaggaaggcagaggaagcaaaaagatagaaaaatgcattagcagccaccaaagggtggagagggactgtggtacagcgttgggctcagcaagatcaggcatgcaaatatttaaccattttcatttcttgtgcttgacattcataatccctgtaaacatcttcactaaaccgaagaacacctgctttggccataaacttacatttcttaagataggtgatacatacatctcgagtcccagggatgtcccgggttgataagataggtgattgatagctcaccatacatctcgcgtctcagggatgtcccgggttgagacgtgaagatctgcatacaaggcagcaatagcttctagagtctggcctcccaccaacagagccaaatgtgaatcctgataagaacactactgggctcccacttgctctcaggtaagccatttaagtgatgggagcgtctgtgttcccatctggaattctggaataattataggatcttttgtgtagagctggtaaggtcatgtgaggcagtgcgtggtagtgcataagcacagagcctcacgcacaagaagtacccctaacagccactgtgagcagtattcccaattgccaggggctgtcactctcttagagggctgagagagttttgataccattcgtcctcttgaccagagttcagggccacgactggacttgttctcagcttctctggttacctggcccccaccctagcctctgggttctatttaggtggttgcagggaattgtgacctgtccccactcactggattaaaacctgaagcaggcaaacaaaaaggcatcttgaagttcttgcttagatatatctcctgagagctattcgctagtaaacctttcaatgccgcagcctaatttttttaatagtaagttctaatacaggcgcttgaccccagcagagaggagagtcaggaggcgtcttatgatgttgggaaaggagagttttggtgattttccctggcagccagtaaaaccatttattaacatttcaaaagataagccccctctcagttttcttcgatggtgtacatccttgggcttcctgaaccttccttatgcaaggagagccccggggagaccccggcgtttcccacaagtcaactctgccacctttctctagggctaaaggattagactggaagagagaagggtgtaagatccccggagcagaatggacaggcccagaaatagcacctggctttgccttgtttccgttgtgctcatgggggaaggtagatgaggggagggaggattttggtgtctccagagggtggccatttcagagggaagttcaaacttgcaggcacacagagaagtgccaggacaaactgtgctctcagtgccaagtggccagtttattgagacctcaggtgtctattgaaaagagggaggtgacacgttcatgtcgtaggcacggataacatttgaagctacggaagggactggtgccagccctcgctcacaagacctcacaagggagcagccattgcttagggcaagggtgccccaggcctgacttcctggaattgctgaacccagtggcagagggggtgggggcaaaagaagtaagagagccaggttagagagtgggcagtggggacagagctgcagaggcgcgaagcccacagtgtgcttgggcagcttggtacagactgagtgtggctggcgcagagggttgagttccgtggtggttgaccataaaggcagcttcatgtatgccatgcttcagaggccgagctgtgttccggaggcagtggggagccattggaggttcatgaacagagaaacagcgagtgaacgattctatttgggttcaaggttagaagggaaacatttttagaaacttgacaatagtttcctctggcaaactaggatttccttattttgaaaaataaacactcttcctccaacatcaaacagatttttttaaaaaaaaaaacaacacgatgttctaattgatctagatgaagtaattgaaaacatggggtttaagtttcatttgtaaagcccataattttggtgattggggggaagcactctctggcgggggagatagatgtagggatttgaatggttagaatttaaatgtccaaaagcagagctggcctcataggagtaaaaaatagattttaataaactcggcccattagtgttcattgcttttaagtgtctctattttatacggcttactaggtttgcggaccagtatgttcaaccaatatttatgagcttatttgtgtgtgtttgtgtatgtgtgtgtgtttgtatgtgtatgtgtgtgtgtgtttgtgtgtgtgtgtgtgtgtgtgtttgtgtgtgtgtgtccatgcaagtgttggaggagcgattgcctgaacggtacaagccgtccttgatcataaggattaactgtagcagtagtttcaagctaaaaatacttattcaagtttctggccaggttattaattttacttcagaactgaagggatcatcagtacttcatgcttgctcccttctctgaaaccagaatgagtgcacctcctgcttaaagcctgcatatgtatgagggaggtggggtagggatggctagagaaggaggcttggtgggaggggagaggcgaggagatgggggatagctgctgaatggtacgtacatgaaatgactctgcacactagtgtggcattccgggagactggaagatttacgataaccccaaaaccaatttccttaaataaaaaatcaactaatgaaaggcagttgtacagtttcccttcctgctgcatacactggacagtctcagggatgttggcagaatccagtctctaccagagaagaagtcatatagcacatacttctccactggcatgctgtgggcacaagttctgcgactgactgtagatatgaaattttccaagatgttcacgttccttctccgactttaacagatatcattgccatctgagaacgccagctccccagcctcatgttcttacctgaaaaaataatgactggtcacaccaagtccctaaagggtttatttttaaaagttgaatctgggatgtttcttattgttattattgatgcaagaatgcttcggaatttgcaggtcttctaatgaggtatggtccgtgtctaatggaaaccccttggcattccactctcccctcatagaccctagattcctaaaaaacagtgagtacgtgctccagagagatgctcgtgggacctgcaccactaaatcttctgtgacagaatgttcttgcaaagagaggaattgcataaatgaatcggcagaaataagtgctttggcagaactccttgagtggggaagagagatgtttgctcttctaattagctctgggtagcagtctgccttgatgtctttgctgaggaacctaggcagaggtctccttacaggtctgtttgagctgccacacttttaaaatgtgtatgtgtgtgtgtgtgtgtgtatgtgtgtgtgtgtgtgtgtgcgcgcgcgcgcatggaagtcagcccagaagtcatcctcatgaatatagtccacctcctctgagacagtctcctgttggctgtccagtcatgcacaccgaatggctcttgagttgaactgagtgatcaaggaaagcagaaaatttgccagtaagggaaaggatgccatggggctctgaccaataggaagcccattgtaaaccagatgagcaagatcacccaggtacaccatagttagtttacccaagatagagatcaccatagcccaaggtattatagaactctcttaaggacgcgggcaaagaaagccctgttcttggcaatgaagactcagttcaccttattcattatgacaagggcttaagaccattccttgtcttttgctccagagaactatgaatcagaggaagaagtgctgtctaagtcaataacagtagtattgctctgcgttcattaaaggtttaaaaaaattacattttcttatttaattgtgcgtgcgcacgtgtgtgagtgtgtgtgcatgtgtgtgcgcacgcgtgtgctgcatgcatgcccgtgagtacttactgtgtgtcacagtttgcacatggaggtcagaggttggctttccttttaccgtgtacgccctaggaacacactcctgttgtcagacttggcaagtgcctttacacagtgagctctcctgctgctgaaaagccctggaaagatcccagggggagaaggtagaaaagtaagaaagaggagactgtggggagaaacaaggcctgggtagactcgctgcagatgctggctccgcagtgtggacttcatacaaactgcataggtttggtttcattacaataaaggtctttatactaacccacattttcagggaagatgagtgtcatgtttcttcatagaatccagggtatgtttaaatagccagcaacatgcatgggaatgaatcctttttagaaaggttttttgtttttttgggtttttttgtttgtttgtttgttttgtttttgtttttcgagacagggtttctctgtatggccctggctgtcctggaactcactttgtagaccaggctggcctcgaactcagaaatccacctgcctctgcctcccgagtgctgggattaaaggcgtgcaccaccacgcccggcaagaaagttttgatcaatataaaagtacatttcgttattagcttatgaatgaaactcacccagctagagaaggccagctaatagtatccagttttattcgatcccttggatgttttgggtatactgtagctgtgggtattttataaactaggcacagggaaatgtttcagcctgcttatgtctgtttcattttttgacttccggtttatctggctgtagcatctcattgacttagattttatgatcatttgctctccgaccaatgatactgaaagaatttacattctttgttttcgtatgtgtgtagtatgtacatgtgtccatgtctctctgtgtgcacatacccacgtatgtgtgtgtaccttcctctgttgctctctacattataacttgaggccgggtctctcagtgacggtggaggtcactgattctgccagagttgctgagcgctgagtcccaggatcttcctgtttctgcatttccggtgtccgttacacgcctcacttctcctgtgggtactgggattactcgcttggtaccttgtgctggcatagcaaaggctttacccactgagccatctcctttgctattttataaagaaaggtactatgaaaacataatttgggggccacatttgacttgccagagcaggaagtagcctttaaggactgtaagcactagcatctacattgatgttcttaacctcacgtatgtgttagtcgggtcaaagaccgccggacacagctgtttctgtgattgcactcaccccattgcccgttatgatctccagctgcccctccaatgccattgtctgcttctattccaaaatgccaagtaaggacattaaaacgaaataggtgatttgtcatcagagaggacgccgtagacaatttccagagacagtggtttgtttgtttgcttttgtcttgaattttgctaatgaaaactcatcagtcagagcacctgctccatcttcccctttgaatgaagaagtgattgttgaccttctgcccttgcctccactgctccccaacagcgtaaggcttctgccttttatttcctgcattgtaagggaatggaaatagctactcccagaactcctgatttgtgctctacaatccccgtctctcttcccccctccccatcattacctatggattctcatggcagaacgcagctgttcaggagagacgctggctggatactattccacaccagttgggccaatatgtggaggaaaggcttatgaaggggctgcgagtgaccatgagtgcatttgcacctgtggaaagatgcacacgttcgcagttctagcccttcacagacaccaccagctttcctgagtagttcctctaatcagcacagttggcagctggaactttcctctgcgtcctctaccctgccatccgacagagtgtagacgggagagaggtccggtctcttcactctcgagcctttcagagtgatggaagataatgggatactctcttctgccttccttttaggggcaccttggagtcacaaaggagagagatggttgctctcttgttgggggctgtggcactcttaatgggaataccaagtagaaccagggtttccaatgccagcatctccactgatcccatgctccctttcttgggaacctctcaaatactattggggagcacccagacagacagaaatgtgactaggagaactcacccaggaaaagcactgtctttgttttcccaccgcagtagagatgagagggtcttgtcatatttcttggcttctgtcatgtgctatacatgtggataagtagggtgaggtaaggctaacaagcaagtcacatggtattgcggcatcaaacctaacacggtgctcccctcttaagattgatgtttcgtcccagctaaagtgcccagagcttgtctctcttcctcttcttttataaaagaataggtacaaggctcctaaatttaaatcaactaaacacagtatggaatcgtcgccatgtgcataaggccttttcttcctcctctctctctctctctctctctctctgtgtgtgtgtctctctctctctctctctctctctctctctttcttccctcatatattacatccactctcccccatctcttccccagatccatccccctatccctactccatctcctgggacatcaaccaaacacagcataacaagctataatttgaccaggcatataatgtcacatcaagactggttgaggcaactccgtagagggaataaggtcccacagcaggcaaaagagtcaggaacagccccaccccaccccctacccccgcttgcagttaggatttccttgggatcgttgagctactcagccataacctaggccacacccctacaggttccttgatttcccaggttcctctgagtcccagtcagttgatcctgtgttctggtgtgtccctgacccctctggttcttccaatcctcagcaggactcctgagctccatctaatgtttggttgtggtgccctgcatctgctcccatcagccactggttgaattctctctggtctctttgatggtgaatctgctaaggccccactttgctgaggcagggtctcttctgagcctggagctccccagcttggctactttaggtaatcaacttgcccagtgggtcccatttcaagaggagctgatgtgcctctcaggatttttttttttatggggtcactactgatctgaacttgggtcctcaggcttgaagactaagtgcttcatccactaagccatgtagtccagtagctctccatgacacacttaagctggggtgtgtgtgggggtgggggaggagtgctaaggacttcatgtaaaaggttggtgcagtgattctcaaccctccaatgctgtgatcttccaatacagttccccgtgttgtagtggccttcaatcatacaactatctttgttgctgctttataactgtaacatttgctacggttatgaattgcaatgtaaatagctgcatttccatgctcttctgggggttcaccaaccataggttgagagccactgttgtagagaattcactcatactaagcataatagtggttcttagaagttagtctgttcctaagagggttgaatgatgggatggcattaccaaaatatgtcttcttttattctccatcagcccttccatcttgactacaggcagcttaaaaatgagttgggcatatcttagtggccagaaaccgtggcaatcaggatgaaatcactatcaaagcagaaataacaagctttgataaagccatccagggaaacacagtcctgagagcgtccacacactcgtctggacccttatgccaccaaattagactgggtttgaaatgagagctcttgccggaagccgtgaaatgttgatcccattctaagccccgggcttctcatctagacatggtggcctgctcacagatcgccatgagggttgctggggctgtgtctacttaggacttgcaactgtcattttaagtcagagtcagagtctgttgtttaaatgagactctcgaccatgcatttgtggttccttgctttggagtatccgctgcaggctgctaaggctgagtcttcacaacttccccagtacttgcttgggtacaatgaagagatggcatgtgtacttttccggtgtgactagttcacaagtatcctctcatgctagctacttgtcttagttagggttttattgctgtgaagagacaacatgaccacggcaactctaataaaggacagcgtttaattggggctggcttacagcgtcagaggcctagtccattatcatcatggcaagaagcatggcggcagtgtccaggcagacagggtgcaggagaaggagatgagaattctccatcttgatccaaaggcagcagaaagggactgtgtgcatgtgtgtagcttgagcatatataacctcaaaacccacctccacagtgacccacttcctccagcaaggccatacctcctaatagcgccagtccccatgggccaagcattcaaacacaggagcctgtgaggcccaaacctattcaaaccaccacagcacctctctgggttttgcttctacgtctataaaatgagaacaatgtctgttgtcctcgtggatgtgtcacagatgttagatagtcagttaaaaagtggacccaacaaaactcaatgcaaagttcaaattgggttggctttattattgccacgggatctgaaacagcaacaggggaaacatgtgacaaaaccacttcaaaggtagccttagccatgaagaacgaagaacttggaatcagccaatctaggcttggcagggactgtggcaggatgagggtgtgtgtttttggacaggtgaccgctatactcaaggtccccactgttgttgtctgtgaaatgaaggtactggttgtagctttatgactctgtgtgttaagactcctaggaacttttaacactatttttttcaaacatggggctagaaaaaaaaaatccttgttttaaagcctcctggagtcatggtgccgaggaggtggactgagaagctgaccacttgccattcagaagagattatggtggttaaaacgaaagcgtcagtgccaggtgtttgacaccatttgaggtaggcagacaattaaaacgggttgaaagcaacgattcttgattctgcatatgagaaccactggttccttcaacattccagagcgactccgaaccccacttatctgtctggaattactgctccgagggttggctatgtgagcagtggtttgtcagccagacagcatacaaggcaggggtgtgtgtgtgtgaaacacctccaaggccacagctacctcttttgacggcaagtttttccatctgggctttagctccttggtgtgtctgaatgccggcttctgggactgctcatgatgtaagtttcagctcatagtctagaatgtcatcctgaaagatgatgaggctcagccctgatccatggaaagagttctgggactaattagtaatgtctgccatgcttaggtgtggtaggaccagtgtcacataagtgctgtcccttcaaggcatgttggaagctcctttagggatggatatgtaccctccaccaggcagcagatcaaggattggggccagtcttgtttccggtgtcctggaaaaatgtttttccagccctctggcaggttctgttttattctcttgggggaaggctcattctagttaagtgagcagacagaatggaagaaaggaagtctgttgatcctgctccacagtcacaagacaggagctgcaagatcaagaaagctgggaattctacatgtaattccacagaaactccaatgacgaccaggcaaggtgccccctggcccagcagaggcaaccacaaaccacagaccttgccgggctgtggccagaggtcgtgactccaaattccctggacacaagttccttggtaggcgtccagggatggctctggagactttgccagtctgtttaaaattggggctgcctctcagttatccgtgccgaggagcagagcatctgaggtctgtttctctccagctctggaatgcgatttatgcttttgtactgttgatctgctttctccagtgatgttgagcggttcagatttaaaaaaaaaaaaagtggagggggtgaggagtgctttttgcagctcttaatgtgtttttcatagccagccaaatgtctcagagccatcttcctttaagcctgtgaatgggtaccaataggatgtctacacctgtgttctattgtgcttttactacgtgctctgtgggctcctggtcgctgtgtcacaaggggtggattcggaagtgtgctgggcagtgttgggagaaggggccagaggccacacactgtctatgaagaaccacgaaaagaatccacgaaggacctcacccacccacggagtaacccctgacttcctttgttccttctgcttcctgtgttttccagtggctgcacttgagctttacatacaattaactttcaattaccccgaggctgattagtccgtttgcagattaacccaggtgaaggctcacctgggtcttcgaggtgctcttcaactcagtcgatcttgctgattaattagttggttatggctgattgcctgctcagggagcctgaagccctgggactgggctactcagaagaggggaggctgatggagggacagctttgtctgagtgtgttgactctctttagccagaggattttcacagacagtcatagaaagctccaaattctctagccacagcccgagaggttcagacgtaccctggggtcccgctgccgatcgctcgctcgctccaccttttgtttcaaccaacacactttgcaaattgggggatttaagttgaccgcagggtgctgtgaaatttgaaaggcattgcaattaaaaatctaatctgttgaaattagtagacccagtgtacagcaaagggggctgctgtcccccctccctcctcagtctgttaactccctccaaacgtgtagactgacagccccccccccaacaccaagcactcgatcccgtctgaggtctgtagaggtcaaagccatggtgataactgggggnnnnnnnnnnnnnnnnnnnnnnnnnnnnnnnnnnnnnnnnnnnnnnnnnnnntgaaagagcagagagatatttactggccataccatacacaaggtcagaataaattctgtaacctgcagtcaatctttcaccatgtttgggaccagttcagtttgggcaacagataactccagtcttatggataaacttcgagaaagtgtccattgaggacttgggtgtggggatcacggtgggggggtgggcacatgaacaccatatttcatggggttctgtaggtgacccccttactgcttcagtaacactctctggagtccccgacgtgtctttctttccctctgggttctcatttcaaaattcccagaccttcatgtcatggcttagttagcatcgccgcctcttgctagccagggccctgggtttctttggtccttcgtgttttcccagggcagtcagtgtgtatgtacagtctagagatcacattctattaacacaaagaaatctgcttgggctgcctggttttgcagtcacgtggagagcaatgtgtttctttggtccgccagcctgcagctctctgtgcaaaatacagcagagggctgggcactgggccaagcttacatttcacttaggaacacactttcgaatcactccttggcagaacatccccggtggtgtctatttggggagtaagttagagaagtgttgtttttctctcatgagtgtcaggagataggaccttcagaacatgttttcctttccctgccctcgcatcttcagggtgcccagatagcagtgggatccaggaaaaggcagcaacagccgcagagagaaagcccccttttgtcccgagctgccctgcaaaagcagggagcacagccctgggctgccagggatagagaaacttaaggccagggtaataacatcaaaagcaaatttctgcatctcaggggcaaaggagctactctcccagataaagcaacattgttgtccaaatctttctttccaaaagatctgagactttcctaaggttgggcctcagccagccagcgaaggaagttactccagcgagcctttggaatggcaaatgctagaaaaataaacaaacagacctcttccattcccttctctctcccttgtgtatttttgtagccccctccctcaacgccccccaccgctccaaccccggtgttctttagccctctgcagcaccctgcctgctccttccagaccgttcccttccccacctccatcttctccggaaccacgttcactagtcggctttctgtaaaacaaaatgcctaacttcaaaatgagggctcaggagacaggaagtctaattcaatctccccctgttgcctcctcttgttctcttcttgtaaagtcgacttgaagcctaccatgaggttgaacaatgaggttgctttgggaatttcgaacctccttgagaaagatcagaatggttaaagaaacatttgctggcgtagtcaggacttctcttttcctaatgagctagacccctctcgtgaaaagaaactttgtacttatcaacatccctctgtcccataatcaagctttgctctcattctaatatttgacatttgggaaggctgggctttccgtcaatactgtgtggccaagcggcaactgatgggggcatagagacccttctccggctgctgcctcctggaccaaatagacactggggaccccccccccccccgcccccttggagaggatgcctagaccctcagagccaggctgcagcttcctaccggtcagctcctgctgaaacctttccttaatttgtagaatgcaggtgacagggacccatccaccgcctggaaacctgttggtaatttgctttaaaaataatgccatgttctcacactggctgctgggtgcgctaactcagcagggagggaagagagcgttacttcacaggatagcaccatagggaggttaggtaaggttaccagagagatgaagtcaccttgcaccttccaagagatctgcaagtcttgaggaatagctagcgggagtgcagagccacacccccttccctttctatatcccactgggatagtttgaagtcctgttttctttttggaggaggctggcgattaagcacacagcaccatacatcgcaagcatacacgttgccactgtgagctccaactgcaaaaccatcacttattttattttattttatttttttggtggaggactggaggttgggggttgggggtgggagcttggcaaagtctctgaaggagtgagtaagtcggtcaccttcatcaacatcaggtgtcgatttttccactgtgactgtgtggattcatttctcagtgtcttaggcatggtgaatgaatacctggctagttactgtttgacacctagggaaagactctggacttctaccccccacttaaggagtgttttccgtatgtaatttcattttacaaataacagcgtatatctttgtaacattaggacaattattattcaagactatgcctagactgagagaatcagtcttcaaggttgtaagacctgattgttgagcctttcctctcataggttgggaaactaagctcacggggatttttgccttttgcataaggaaggatttgtggaagttgatccaggctcccacagctctggacacttcctaaggagacactgtcaattcttcgtcactaagactccctcgcttgttttccaccagaataagtagccaggaaacattagttgaatgaatgaatgatgtatcaaagattcgactttgtcagaatgactttaaaaagatgcttgggctggcaggatttcttttctgacgtagtgggtacagcttagccagtggatcttggaggaggccaagtgtagcctcccccagctgatgctgtgacaggctctaggattcttcgctcgcattacttcacaggttgcttttcttacgtgtcattttcatgtgattggttgtataaacgagcaagaatgaagagacctttcagagtagaggatttagatgctttcaaagccacttggcaaagtgcttttgtatcagaagcataagaactcagtaccccctaatatccatataaaaagctggtgcaatcatacatgcttgcacacacacacacacacaccatcaagttacatttctttgattaatagatgaaggtaagcatgtctctacagacatgttagttgcagcttctttgtgtgtgagatttgactgtttacaaactggtgagtctccccacaccagtcaccagttgccactgaaccagaatcgctgaagagaacacatcacaatcagaccaggcactactgcagcgttgccctaggtaagagagctacctgcatcttcccagtgccctacactctatctatccattctgagccttccatcccatcccgtgcatgcatgccagagttgttagtctttcccatacgcaccatgcctcagtttctctgtgtgttaaagagaggaatagccctcttacttctagctagaagtgaatcataacattatccaatcgatattgcagacccgtgtgaaccaaactacaggcccagccttaagaactttagtttttatatatatttaaaaaacatatttcattttgaagaccaaactgtgatgactccacctctattttcctgagttttaatctatcctataccggcccttccattttatcaataaacaagcctggttttagccaaatttgtggaagtctacatgccctttgtttatactgtgtgaaagggcaagaggcggattggcctggaattcttctgtgtttcactctgggatgcagaaagactcttgtcttgagccatatgtagagatgctcttctcagtgagccagaggagcggatatgtaaagaagcagagccaacttcacagaagggcccagtgcagactcgagacacaagagcagcttttgcccaagtgtccttaggatggcagtggaaggaccagtgggcatgatgactacactggataatagctggtcatcattgtgctccgaagccagcggacagagctttccttcccccgaggcatccccccaccgcctgggaaagccttactctggcaagaaactctgatctgaatgttgcccttctatcaggcagcaggaagaaaagcaacagctccttagttaccatcccttcctttcatgcttatggtagttcgggcgctaggctacccagcttccatgtgttatctcattaaactccaaagccaccccagggcaccagtagcattagtattagattggtactgttatcactgtccttttacagatgatgcccagagaaggggggcacaaatggtacagacagcagttagctggcagggctgggataggacacaacaccaccatctggtactgcggctctatggtaggtcaccgcagcctcctccactcttcaggagaggactctttgcctgcagaacatagcagaatgtcaggagccatcaatgcccctgtgcccatgggatgggatggtggctactagcatctgggagcccgaatgtggagggacagaaaggaaggtactttttgatctggctgcatctctagggtcccaggctctctttaaccagctcccagggtatctaattttaaaggacagccagaccagcttgcaaaacacaaggtttatgtttaaatcatgaagatttagtttaaaagtgaattctgtgctttggtatgactctcaaagcctccgttccttctgacatacgagcagcagagaagcccttggaatgcagaagtcagcaaacaagcaacgagcaggagtcagggacacggatgaggctgtgtctctgaggctgcttgtgtcccgctcccagcaaagtcaaacaagtctcaggccccactgcctggtgcggcagtggatacctgcatatgggcataagatcctccagctttcatgaatacattccccttgtatagacacacgcatgtatgtctttagggagccacacacatgaatatctgactatgctgggagtcatctgtgggtttagctctcagtaacctatcgggagacgatggaagcacttccttagtatccctgcccatctgtttccccaaggcacacctaggttctttcttcccagatacacacgaatgaagtagtctcttccgagatgcttacgggaggaggcacaaggcatcagagccttcattggtaaatattagtttccttcccctccctgtgtctaaggcgagttgtactgagtgaatgaggcttcggcagctcagagtgcaaaaatagccctgcctgtgaggatgtggtctctttccccccaagtgtggaccagatgtcaggctgccgggtgaggactcaaggaatgtgacagcttccttctgcagggcttcgctgcttctctccagatggaagcctctagtcccatgtgagtttttggatctgaaaaacaagtacaaaaaaaaagatggttcacgagccttgttctccaccaaaagcacatgtgtgtgtgtgcattataggtattactctcaagtcagagacatggccaccatgccatctcccctggggcttagtgacaatgaaaaggaatggaaacctatagcctgtgagtgttcatttttgagttgctcatattcgttttttgacctcacatttactcagagccaactttttaccgtgcaccgagctacgtgtcgacagtcacaagagatgggaaagatgtcatcctttgaactgataaagcccatgatggggcaaaggagataagttattgtaaatggagtctgaccagtggtagaaagaagctatgcaaagagggacttagcagagtcgattcctagtcccacccccaactgcatcttgaggaataagcaaaaatggtagcagtagacaggaaggatttcatatgtgacttaatgaatttttctcaactggtattagcagtatgccagtcatttgtagggaagataccaaatctgcaccaggggatcataggcaaggggcgttcagggtgttataggacagaagaattgggtagtggtagtggggggaaccaacccaaatactgaagtgatggttagtacgcaacctgactgaacccccttatccagatgaggaaagaatttgtggtacagtgtaggacctgtgtgagcacgctcagggtggcaaacgaggtgtctcaaatgtggtgtgtttaaagaagatgttaggaggttaggggcggcataattgatatgatttagaagttgctgtggcaacacacctacctctagagagtcagtgtctgtgggaaggcaggcaagctcatggcttttgccctggactatcccgtgccttgctatcgcctgctgtgggccaaaggtctggacaaattcaaaagaacaaatgccccacgtggtttgttgcagccagtctttgtgaaattggccctggaatcagataaagaggtggttagtaagtcagctacaaggttacggggaaagagtaagggagagagaacctgggctggcttgccaactcttcaggaagcatctccccatgttgggaagcatggaatcgcttgtagatttccatgaaaaaagtaaatgcatatggcctatgtgcatgtaaactgcctgtgttgtaatgcccatgttataatgcccgtgttataagcagtagcacagaatgctttggggacataaagtaatgcagacttcagaatggcagaaagatttgggttaatgaaaaattggccataacaagttttaaaagacctcagtgactgcctcggtggtgccaccttcaggcaaatcactgtataacgtggttggaagcaggctttgtttggtgtgtgagcccttgatgcagaggaatctttggccactttagtaattcttaactttggctctacactaggatgactagtggcaattcttgacatttttgttttaaaatattccattacaaaagaatgaagcatcattgttaaagtcagaagtgtatgacaatatagcttgagttcttacagtcttatttccagactggtttcctacagtctcttgcattctcttccagagagttcctttgattctgtaagcatatatatatatatgggtgtgggtgtatattgtgtgtttggaatatgaaaatatatgtatgtatatttgcatgtacctggcacatgctgtggtacaacttgcctctttaatatctgttggagaactatccatattagcacatacagatctgccagcggcatggaatcccgtggtttgggtgttctacggtttgtccttgctcctaggcatttagattggtttcttccacagatgctgtcgttcacgtttgtagtagacctaaaatttaattcctagatgtggaaaggctggatcaaaatgtgtaggctccagaggaacggaactaattcacactcccaccagagaagcatgtagggaagctatttcctctttcattgagtaaaagaaattggagagcccaggccacgttttcagatcctctgattgggcagggagaggtgctggatataggggtgacctcagtgttcttaagagccttgcaggtcaatctctaacaaggtggagactatgagccatgggtagttacttgatcctgccctttgagatccaagcagcaagacctcatgcatggttgtgaactgggcaaaacagaaagatgtgtatcttccgaaattcctagtaagctggacactcccatttagatagacatggaattaaatgagtctctatccataaacatggtatattgaaacatcaaaagccagagaagtcccaccaaggttctgtttgatgctttcccctctcctttctaattattttgtcagaatgcttttcttgtataaggaaaagttatggtctcagattccttagaagcagtttgtagatattagtagttagcaattgttttggtagtggtttgcaatgtcccagatgggtgccaaccttggcagcttcagaaactcaaggtatcctctttctcttgcttaggtaactcagatgactgagagacagagaaaacaccagccaccttaacaatcacaagccactgccacatcacatcaccaatcacataacaatcacatcaccagttttcagttccttgaccctgtccttttaggctgtgccattccattttctcctgggagtctgtcctcagagctgctggaaagccccttgctttgcagcctgcagctccccggcccccccttttctccctggcagttcgcatttaacacatacctagcacacacacatagagagacagacagacagacaggcagacagacagacaagacacacttaacacacaaacactcagagacagacacacagacacacgctcccagaagtgggcaaaggagaagcagagacagaccatttgtcttcaccttaaggcagatcttctcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattccaagttttaggccatcactgcagggaagtcagggctgaaacttaaaccatcaaatccacagccaggaacacagagaaaataaatatgtgcatccttgcttgttgcattctcctgtcttccatagttcaggatcccctgcctagagaatgtgcttcccacaactcagggtgggtcttcttatattagttaacagtgaagacaccccccttaacccacagacatgtccacagggcccgatctcggccattccttagtaagattgtgttcctaggtgattctgggttctgccaggttggtagtaaagtaagccgccagcctagcatcttcttacaattggttttcttttccattcactccttcccatgattaggtaaggattgattttgatgcaggttttgtgtaggaagttctaagcccaatagaatgttactgttgactgtcaacactgacaatgacagacagtgtctttcaacacaccggaatgacaaagggatctggggagtctgtgggatgctcttagtccatggaaatgggacttcatttgatgcacagtcccaatgggcatgggctagaggagctgaaagggagccacagcattggtgacccaatagccgctgatgactttctgtctgtcaaggcgcacatagacctcacctcatacccgcaaaagaggagagcagatttttgtcccatgaggatttctgcatagactgcatcatgcagaagccagatgggttcagcttggctaatcttagtgcaagctgggaaatttcaactgaaataacacatttctaagaaactgtctggtgtggaatattatgtatgtataagagagcggcatacctatagcacaaagtcgaactacttattgtatgctcaggtatatgtaggatttgtctgtacccctctttccagtgtagtaagaaaaagatttgacaagtcccctcattttctcttgcttgctatatcaatagctattaaacagtttttctgtcacacagacttgaatttatttagaaagtcccaagtaggcctttccccaaatctcggcttgcatctgaatgtaaaactcaggtgtatcctcatgactgttgatttaggtaaaagctgtctgtgatggacaggaggccctccagtcttccctttcctactgcctcagggactgatgatggagctatcgctttttcgtgctgtcctacctgctatgaagaaagcatataccgagatccataaccaggtagcacaagaagacttgagcactgaacacatgcacaaatgagacactaacgtgcccatcactgagagccaccaatactggtagcctcagagattgtttaccttgagatcctggacacatggaaaccattttgttcaggtactccacagaatgaactcagtttgtcctctgagatctgtacgcctgactaagcataccgtctaacaatctaacaatacatgtttcataatccatcagaagtacccataacaaataggtagagggagaatggccattattctgtggtatttccacagcctacgggatagtggaccatagagggtgtctctgtaggcatttggcttgccattctctcttcttccgtaaaatcactttctagacctagatacaatacaaaggaaaaaatgagatcattaggacataggtttaataggcagtataaggatacaggtttaatagacagtataaggatacctttatcaaagtaggatttttcagcccaagaaggtgttcttgtgagcacgtcttggaattttcccatagagatgcggatatctaacatcacaagacacatgtgagagccccagcggtcctgccttatgcaggagccctgtgagtgctgcttgaagggaattgtctgacattagctgttggtgttagggagatctctgatgggcttctctgtcagggcgtggaggtatggaaagaaaggagtgtagagttagccttagtttcaaatataccctctttcaactcaccatttaagctcctgcaaagtacttaatctgttcagttgtattgtttgtctgtttgtttggttggcttcttttttctttcttttttttttttttttttttttttgagacagactctggctcctagcccggaatggtcttaaactcccccaccttcttgtctttacttcccagttctgggttaggaggctgaatctccatactcagcctgtactgtttcccacatttgtttgtttgtttggttggttggtttttggtttttcaaggcagggtttctctgtgtagccctggctgtcctggaactcactctgtagaccaggctggcctcgaactcagaaatccacctgcctctgctgagattaaagccaccactgcccggctcccacttgtttaatggcggtaatatcataggtgcttggttaggaggcatgctaactgctcattcgtgagcaacagggttgtcaggtggatctctctttggtcagttccatttatgtcttgttaaaaagctggtggctgtttctaagcacttcacactgaggcttctccgctgccagagcctaaagggtccccgttccttccccaggatatttgcattgatttcctcgttgtcgtgttctcttccgggagaggccctgaagtcagcacatctctaactggttaacattgctcttcagatgtctaaatctccctagaaacctgaggtgcgtgtccgggaggcttctccatcggggatccatgggcacatggggtcactagaggcctctccctctggatgtgttcattctgcctatctcccctgtcagtgactgataacacctatccaggtatccacgctaaaactcacactcatcccatatcagtaacgagtctcacccgttctggtcctcggctaaccccacctccgtgccacagccatgttcgtcttccagaaaagagccacgcacgtgacattcttgctccgatctcccccgctggctggcatttcctgactggggaaatctgaacatctctaactatatcttctgctctcaatccacactccttgcccctcgactccagctgttccttgcctggagtatgacttcgcctgtgtctggaggcttcctgtgttctgttccctctccccgcttaatcttcatgtttttactttctggccggtttccagacttggcctagaaccgatgccagctctctttgaagagccttcctgaatgtcctgtactccctccaaagacatagattaacaatcaacttttcaactgcaacctttggctctttggacaaagttctttcaatcacttcacagcccggacactaatcatctgtgtacttacgagtctccacagccaaactgcatgttttctagagtcccctcttctgctttcagagccccgtctacagtaggcacccaataaaaggttttaaagtaaatatttttatcatcaagcatgtgtgactctcctatataagttatggctgtggtcttgcctggaaagatttacaatcaagtttgaggactggtagttattttaaaagtcaagagtcatttacagtgatacaaactccaggttgtatgtgcaaaatgacttagctagtattccgagagaaatcagcgtgccctactactatctactaaagttgccttaaggggaaacagaggcctgggatcagggcttcttagtggtaggacaaagagagatggcaagacgtgaaagccaaaaggtttgcctcgggtagattgtacatggcaggggccatgtgcctcaccacggaggtcaccaaccaccaagggcctggggctgagaggcactggaaaattatgggctgcttttgatcatggtaaagatatcctgaagggagtacgctggcagttctgtgggtggatgggagagcttctggcagaaagacatagtacaaacacagcttgattgtccaagtcttatgtgaacgggcctgcatccagcccatgaccagagccccaagcacggaagagaagctacccagagcttgctattagttactagacctaggaggagcatgtctaacctctcaatctttaatctcgatatttcatatgagtgcatcccaaggatcagggagtcacccccaagggtcctgtgactgagagggtcttccgagtccagaccatggctcttttcaccattctgcctaagagtagatgttaaactttaaagccagacagcattgagaaattctttcaggcatgaggagccatgcaggaagggtgaatgaaggtcaacaggaggtggggctggtctgggctcgaacacatctaggctgagatgccagtgagactggagagcctgactggcaacctgcaccttggttatcactctctgtgaacttcagggtgggagaggtgcagagagctcttggacagaaaccaagaaaccaaggagattggggcagcagggctgggtgttcacttctgggtgccaaacttggaaccttgtgcaggggaaaatgtgtggctctccttgagatgccacagatgcacctgaatgcgagtcatgttatccagaagttgagttttcaaacaaccctgtttgccttcctctgttttattgaatttgggccaggggtcggcaggggcaaggttgtcgctgtgaagagcactaggccctttgtttgcacttaggtcctaggttaagagtgcatgagagcaaacagcgtctcttcctttggtctcctcttttacggccccctttctaaatccaacccaaaggagagccttcagtgtaataactaatcctggcagcactttgtaaactgcgggtttcaaatgactaggcctgcacatttccaccaactccagcaattaaagagtctctggggacctaggcagtgctgatgctagtggtgggtactgctgttgaaaaaaaaaaaaaaaaaaaaaaaaaaacgggaagagccgctttctgaaaatagactgcaggtatgggacagctcatttcccggctcgataaagaggtcgcccgtcctagggggagtcaggtagattgcttactggttcgattttttttcccaccagtaaaatgtacccacttagccttacccatttcacagggttggcagggtgggcagaatgaggtcatcaatgggcagcgggtacccaaggaggtctagctgttcatgctgagagcagaagccttcccctccccctctatggagatatggtggcactgacagccttcggcactttgcataccacagggggcctctctagtgggttgactgtggtctgtctgtctttcttttcactccattggcccctttggtttgtcctttattatgtgcagttgtggaaaggcagtctggactggcagccttgggaagagggaactggctggtcctgttcagaggaactgctttaaggccactttgcaaagtttaagccagccagcaatctgaattcaccttttattccccaggataacctcaccctcgccctacctcgtctctacgtagttccagatattggagtggagtgtgggacagggaaatggtgcttgacagggacagagagagcaagccatcttgtttcccacccatggcatctggcatctgtatccacctccaaggctttgaagctgcaagatcccaagcgcaactcacgctggcgctcagtgctgttggcaccatgagttcatttgtggcctcctgagtgttattactgcttagagaagccacagtcatacatgctggcttctgccactctgtgacaccctcaccccaacctccaaccgggcctgggtgaggttttcagcttagtgaagagcagttagagggtgctttgttgtcctctcctcggggacaaaagtgggaaggcctagggccacacacactgtgacctctagttcaaacatctgttccttccccacccgactggcttctgccaggctgtggttgtgagctctggtcccaccacgcagcgggttcaagaaggcagattttgctgacagctctggcaagaggcctgatgacaaatacccttggaacgggaggccttgctaatcctctgggccaagctcctgccaagttagaagctgccaagtcaagtcagggccactctgagttctgatccacggccccagggcaaagtgcttgtcctaggcacggggtcacactcagcagtgtctaacaggcttagcaaggctagcactagaggaaatgggagccaagggcatggcaggagagaggttcagactccagacctacccagggccttccctcttgctgtgtcccatggttccaggggaggtgagcagcattgtctgtcccccaggctgcaggtgaggggacgggactcttgattatagagggactggcctgaagctttagagctctgtgggtgaaaagccccgatctgtctgtatttttgatgggcaatgttctctcctctagaagaggtcccagaaaagggtcctagttgggaacgagagtcgcagaatggccatctacccacagggaacacagtcatgctactcataaggactatagatataaaacacctctcccccatgaagtgacctgtaagccaacttctttccatccagaaggtgtgtgatgcctgttgagaaaccctgtcttctcagggggtggggagggaggagtgtctggatgcatagaggttctctacataagcttgtatgtgagggaccacagtgatgcggtgctggcccggcgcctcagtggttctcttgtcaaatgtggtcctgctctctgcacgagcttactcttctgggtctagagcaaggaggagctgaagcagagacacagagggagagaggaacaaaaggctgtccttgcccctttgtatgaccagctcttgtcttacctgttgggtcccgagatgtgcggatctgaagagggctccctttgctcccctgctgccagggtgagagagggtaaggtaaaggagaaagcgtgcatttagggtctggctggctagtgcctgagttcccgctgacttgagtgacttaatgttcagaggacccttagcctactcatgatacagggctactcctggctcgccctggaggcaggactaggctccatggccccagcagtggtgtatctgctggttgcagagtgaggaagaggaggcgaatctgactctgttgttgggcatgcctggcaaatgatgcagcatttcagagctgattccgcacctctgcttttccatccctttatttccacatctggagactgaggatgctagtaagtccaccctcggagagctgatgtggggattaaacaaaggagcgaacctttctgagaagcccgagggaagcaagggttccacctggttacccttcggttaggaacagtggtcggtactcactactcatgggagggaacaccgcgaatctgcttgcccccaggcaccccttagaagcaatttgaaggccaaagtaggaaaaacgagtccccgtttcagtgctacgggaggtaatagtgtggatgaatagtaagaggaaacccaagggttagatgggcagtgggtaagcctgaagtccatcagaggactggagcgggaacaaaaatcatgcaagggagcaggcagggagtggagggggagaatgttgtagctagggattgtactaaatacccaggccggaggcagctagtacatgggtgtgtgaatggacaggaagggctagtgtgggaggggagtctccaatgttgtcacaaggtgatggagtgattctggaagcttcgagagcagacctgcctgaatgtctgcttgcagagtgtcttctggctgtcatattacatgattagtcaagggtggaaggacagagagagaatagacaggacgacagaggttgcaatagttcaggagagggatggtgatggcttaaaattagggacaaacctgcaagtgagtgagtgggtctctgtgatcctggaacgtatcttttacattttgtggttatagatggaccactccccaagttctctccaggtcctgtgctaaacattttacctgcgtacattgtcgaattcattgtcactctcttttctccctggctgttcagccaacactctgacatccttttgtatacaaggagaccagaactcacaaagaacaataagatcatctctgtctctctccatctctttgtctgtctctgtctctctgcctctctgccacccccacccatgtgtgtgtgtgtgtgtgtgtgtgtgtgtgtgtgtgtgtgtgtgtgtgtgtgtgtgtgtttgggtgagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaattagaaagagcttagtcatgtctccattctcacttcaatgttagctacttaacccccaattcaatgggactgggaccataaacatccccacatgaagtagtttggttcttggaacagttatctgctgcctcaagaatgctaaccagtcacaaaaacccaggaacatacgcaagtaaggatttatggttcacgcaagtgcaactcctctgagtcaggcagtggctgttctggccttagctggacccacactttccaggggagcaggtgattgagctgactccctggcctctccagtgcccgtccttccagcaggctcgcccaaacgcgttatggcaatgacacacacgctactgacagagacaggctccttcatggtgcctttaggctcagatgcagaaagccaaagcgctcttcccatactctctgggccaatgcaagacaggagacaagcccagattagagaggcttggaaatagatcatgcctgaaattgcaaagccacatggaaatgttgtgggccggggagggatgggacctcgggccactggaatgtacccgcacttgtaaggtgtttgttaaaggagatagtgtcctttgccatcagaacagacaccagctgacctggactcaaagtctgggaagaaccacacttttaggatacactcaggaggcttttatttaatctctgtacatattgcagactttccttattgatccagaaatatcatgatagtcccccagtggacctcttatatgctaaagggattttcaggaacaagggtgttttatattgaagcaggcaggctatgaaccctgaatgtggttttctcttgaaatctgggaggttccaagagaggaaacgatgctattaggaccatctgggatccaggagatgataacaaacaaacagacctcaaactaatgaaggagagggaagaagcaggcaagagagaaagacctgagaccaggctctggatcagaaggcttttcaccggttggatggaaaggggtcccttttgaccaatgtacaaatcacatcctcttttcccagcctttctttccttgttaaattttgtttacttttatttcatgtgcattggtgttttgcccgaattgtacatctgtatctgggtgtcagatcccatcgaaatggagttagaggcagctgtgacctaccatgtgggtgctgggaatcgaacagaggtcctttagaagagcaaccagggctcttaacaactgagtcatctctgtagacccctcttggccttttttgatagaggatgatttccctcagcctgctcatgctcttgagggactaacactgagcgatgacgatgtctttgtctctttttacatggctgctttaaatctaatgcctgtccaccggaatgggagcacatcagaagggttgcagttcctgtaactagctttggggactaaataataaataaaatggttatttgttactttaatgcagctgtagtttaagaacacaaaccaatgacctgagcagactgctgctatccccattcactgaggccagataatcagctaattggacagggactgacacgttcttatgaaagaagaggaacgaggaggtttcggcaggcctgcaaggtgaccaaagtggagcccaactttgggtctgaggtgactttgaatctcttcccagatttccataggatctctgttctaccttttcctctggaatcctccttggctcttctgtaaatgagggtcatcatgaggccagtagaagaaaaacacaatgcccagcagacactgaaccctcttagtggggttgaacctgcagggtttaaatcaaacctcagagaaacgttaagcttaaacataacaaatacagggtcggggtggggggcacacaattatcttaacatcttttaaagtggtgaggcctcttctggttccatatccccagtgcactgagtcacagctaaggtcacccctattgattcttgggcgcctccctcgtcccaggccatgtctcatcctggagatgcccccaccaccacctccacacccccataagttgcagatttccattcattttcatggtcatctagccatctttcatgtccttctgcacacctgatcttggatcccccatttccctcccttcccagctcccaccctccatctgccccttatgactattttattctcccttctaaatgagattcagccttcctcaattgggccttcttagagaacaaagggagggagaatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttgtgggatggggttgaccaggagggagtggtcagtgagcaggatgcaaagtgaataagttaaaaacgatttaagaaaaataaagagggtgaagcatttgaggaaatttaatgttcttatttctgatttgaaaaacaactgccattacaataggggtggaagtccctaactctgagactgtgaccctctggggttttacggtgtgaggtttccacagcgtcttccactgacgtctggacagtgggattacccattttacctcattccacctcgtgttgctgatgcagatgatgctgatacggtgagattaaagctcttctcttcgagaggaagaagcaggaattataagcatttgaagcgagctggaactagccctagaggtggctgataaaagtacttactaaaaagttaagaaaaatcagacttgctaaaactgttagaagcaggatgggggtgggggaagtcgatggctatgagcctggcatctcaaaacctgtcacttcctacataccagcaaaaaccagttaggaaacagaggaaccagtaacagcttctatagagcatttaaatttaacaaacacagcaaaaatgtgacaagttaaggccactgtaagaactggacttttctttttaagatcccccatataaaagtaggatattcaatgtgtaaagataaatctgcctgcatggctcacttgcagtctttacccaaaactcccaatgaagattttaaacaaaactcaacaaaggcattctgaaactcccccaaaaggtggtgtgtgtaggagcaaccacagacatccgttagaagtactatagtgggactggagagatggctcagtggttaagagcactgactgtttttccagaggtcccgagttcaattcccaacaaccacatggtggctcacaaccatctgtaataggatctgaagaccccttctggtgtgtctaaagacagcgatgtactcacataaaataaataaatcttttttttttaaagaagtactctaatgaagacatatcttgttctgtcaaatgttaagccttaccaatattagtcattagagccagtcatttggaaaacgttagttagcagcttttttttttttttttaatgttgtacaggaaaggaaattctgagtgagtcaaataaacccattatagttgtaatacaggattatataccgatatgtgaacatattgtgtacatatgccagatatacagttacaatggaaactctcttagtagtgaagctctacaccatcctaaacagggtgggaaaacctgttcggtgtaagctggataaggaggcaatgaagtttagttttagaattggataaacactgggttcatgagatagctcagggagctaaaaagtgcttgccactgagtctgatgggctgagtttgatatccaagacccacacggtagaagggaagaaccaacccacacaagttgccctccaacctcaacgaatgtgcacaaatgagctcccacaaataactctcaaaggctcacaaaatagataaaatataataaaattacctttaaagtacaaaacaaatgcctatcttttttaaatctgagaatttcatatatatatatacacacacacatacatactgcttatattatcatttctacacatccctcttttcatcccacttctcctgtgcccctcactcctcaaatttatgatctcatacttaattatatgtgtaatatttatatttaattatgtttgattatagcatatattataataataaaataattattggaaatattacatatatgtatatcctgctgaggctgtttaatgttgttccaatgtatatgtggttaagactgaccccttaagatcggataaactgctagtccctggagaagattgattcactgtctctcagcagccagtaagagctaacctgtagctcttcatctagaggtagagccttttaaaattcccccatccacattggtatatcagctggtggtgtcactgtcagatgagatctcctaagcgtagcttccctaccgtttatagaagaccctatctcacagcagatgttttgatcctcttgtcctcttgctcttacaatctttctgcacccaccccccacccccaactcctccgtgttccctgagcctgtggtgtaagagctgtgttgtagataaaactatgaagggtacacagcacccagagaggaattgactcctgcaagttctccctcccccccttacacacacacacacacacacacacacacacacacacacacacacctaacaaacttatgtaaaaaggtaggagaagagagggagggatgcctacaaactggtcggggaagtggtgataggacattgggtagtattgttatccagttcaaagatacttccttcatgaaaaataacatccctatttgatggacaagaggttccaggatgaaattgtattatcgccctctagtacagagctcagcagtccttagaagctggagctatgcagcagcttggctaatgagagaaaccccatcacctgccaatgcctggggtttgggggggggcttcctcgttggcaggcagtgcacaaagagagctcaaagcagagaagggacctagaaggtcatctgggtcatttatttttcaagctccctcccaggccttttcagaaacaggcttgcagggtttcagtttcgctacaatataagcaatgggtagcatggttcaccctggggtatatttttaatgaaacctacaggtttcttcctacacgggggcctagctctagcaaagaggaagaagaggagccgggccaaatgcagccgagctaaatgcagccgagctgcgtcctctcatttattctccgggcatgaaaggagcaattgtacaactcagatgaaaccagaagttaagctgcagaactcccggcataaacatttggtctgttattaagttcactctcaccagcaagacaaagaaacacaagccacccattgttccggggatgtttgtgcagtccagtggcttagtctgtgagggttcaagtagaagttaggttgtctccattatgccctttctgatctgctcaatgctttagtcgaatgtgccccttctcagcatccatatagccactcttacttgtgggcgtggtacaccgaaactgctttgtatctgacctgtctccacccgtggccccttcagtccatcttacccccaagagtcttgttctaaactagctgtttgccacttcactcctcaaaattctcctgtgacattcagtgtcatttggtttgttatatgcccacacccctcttacctgtggccaacagctccagtagttttacccaaactcgttctgggttccaacaactgatgactcttcgtagcagagtctggatgggtggggatgtaacacagtggtggagcacctgcctgcagtgctcaggatcccaggttctatcccctggagaaaacaaaaggaagccaacctagagctgaggagatggcaaagtatctgccacaaaagcattaaggacctgaatttagatccctagcgttcatgtaaaaacccaagagggagagaggggtgaagacgggcagatccccaaagctcactggccagccagcgtaactacatttaccagtgtcaggttcaatgagagataccatcttgaaaaatgaaggtggagcgcagttgagaaatggcacctagtgtctaccccctgccacgtaggcatctctgtacacacacatgtgcacgtgcacatacctacgctgacaggtatacacacaacaacccaacacgcacagacactggcatacttgtgtctatctgcatgttgtgcctagcgtgcccttttgtgggtgactgtctcagggtgcagctctaccaatgccatcggtcaccagtgccatcggtgggataccctccaccaccacccccaccaacctcttttgtgttatgtatgggtttctgtactgtggatgcacccgagattgacctccatcctataaccactacaccctaccctaactggctaattctaggtctgtctctgtgacttaccggggaagcaacctgaagtgacaaccttccattacatcatctcgatccattacatcatccagcatgctgggcgcgaagctgatgctccgtgtgtatcttagagttacaaactgctgtgacaaagcagttcctcattgaaagacgtcagggaaggaacttaaatagagcaggaacctaggggcaggagttgatgaagaccacagaggaatactgcttactggattgctccttaatccttgctcagcctgctttcttaaaccacccagcatcactagctcaggggcggcaccagccacagtgatctgagtcctcccacatctatggtcgatttaaaaaaatgtcccacagtcttgccctaggccaacctggtggacacatctctgttgaggttccttctccccaattgactctaacttgtgtcaaattgacgtacaactagtcataacaatgcatatgataggaaagtgggaatgtgtgtgtttgtatgtgtgtgtgtgttttaaactttcttgatcctgtttgtgaacaagtacgtatgtgtctttgttttgcccgataataacacgagtcgatcatgttctgccttgttcttggaaaaacagtgaagatgaataaggaccaaaggcagcaaggtcagagcaagtagagtgaagactccgaacagtcctagagaattgccaagtggctctgacctgggtggccttagagttgaccataagttaatactcccgtgtttttccaggccagctgttgccagcaaaccgcaatacaccgagtcccattgaccctgacaccatccaggtaccagtcgggtatgaaccagacccggcagaccttgccctctccagcatcccggggcaggaaatgtttgaccctcgcaaacggaagttctctgaggaagaactgaagccacagcccatgattaagaaagctcgcaaagtcttcattcccgatgatttgaaggtaaattggaactggtaatcaggccatgggcaaatggagagtgggatcatgggaaactaaacaggtggtttttggaagtctgtatgcacacagaacaaaagatctgagagttccgagtatatttgttggcacgtgacttcctggcacagtacgtcctctctaggagttttctgaaatacgctttcatgtcttgatactaatcagacttaaggagaagcagtcaaagatcccggcaatgttgagtccccgaaagaagcaaattggctcgtctctacaagggatcccatgggaacccatgcatcaagctcaactctcttaatgttgcaaggggatggagggtggggagatgttttgagaagggcgcttggactggactgcagttttttgaggcttacatccagtgttcattgttgcttgttagtaagctctactgtttttccctgggtgccttggggacctaacaagtctgaatttccccttgcatattactgactctgggtgaccaagatgacatattgtgggtagagatgatggatccattgctactatctgacattcactaaataggcagttcagggtgttttttttcctggactgtgttgaaggggatatgtcatttatcaggaaacagaatcacctgttttgtttattctgagtcatttgccttaggatgcagaatatgcccgaaactctgccagcagagaagtacttatggttagccatttcataggactttttctatttatgcttctttccaatcatgagaacaatagacgagtgcacatagtcaaccacagttagccctttcctaacacctggtccccattgcccatcccccagtaggcctcatgtgtagacacactccatagggaaatgagagttggggacaccgtgtaagctaacataggccagtctttcctcctttttatatctagaaagaatacaagaggcaagtgtacccagaggatctaaagcatgcctgttatcctcacctctgagaactcctgaattgctacaaaatgggcaagagtcatgactgaactccaaagttatcactttacagttgagggtatggagaagcaggaaggggaacggaggtgaactttacttttagaggaagataggttctagacaggtcgctgtagcatgacaaatccagacaaggggccctggcataacaaatcaaaagctgccactcttaaaaatcaaacccaacaaagtctacaggagatgtaccagaaaaccctaacttctcggggcttcgatggttagactctaaggggccccagggtcaggtttaacctgaataaagtaccttcttgccgttggatgccttccagggtcttgagttcttcgcagtctaagtctgtgtatttcagagttttatctcttcacccaaaccatgaagcctgttcagcatgggcctcttcctgactgggatgcggtttgacaggatactaccaaggagtagattaaacttgtagccagaccttcagagaatctccaagtttgcacgtttgaagagtgagcgtacttaatggcccgtgtactcttggcagcaaagaggccgtgatgaaccatctgggctggaatcatatgtattgctgctgtcatggctaagcctaccctttccccatggtgggtagggagctggcaggaaccttctcctgcaatgtgcctgccctcagaggtggttttcaattgcaggtgaaatctcaaagcacaagtcgggagctgctgagatgcaggaagaagagctgtgagggtctctcccttcagtagagaggactgagcccggggtgggtgggagacaaggtgtgtgtggctctcagcactgaaggacaagttaaccagaaatagagtggggaggaacgtaccaagaatgctgttgaacacaagtgcttagctttttctccgaagctggccttctgggttagcatctatactgagggagacctgaatgaggacatactgggattccttgctgatagtgcacatcacatttatttcttaccactcttaatgaatgacccattcattcacttggcaaacatctttcagaggctcaggggactctagtgtttgccagcattagcagcacactcgatctcatagaaattctagtctgtagagaaaagagcagtgtcatctgttagaggtaggtgatgagtgggtccctgagtgaaggtcactgggaagccagagggcgtcagctctgagcaggtacaggatgggccaggggatccagtgtcaattccatcattcccactagagttcttgcctccctgtctccaatcaaaaaagaaagaaaaaaaaaaaaaaaaaaagaaaggaggcaagctggtgcttctagaccaggatatcccttctcccatcattcccattttttccatcctttcttacagctctgttctttgcttccctcctactgaagagtcttttgctagctcatctgcacatacgagcaggtgaggctggggaggaaggcactttacaagtgataagaatgctaagaagcctgagccagaactcccaatgagaactgagtgtgaagagttagttggtgattcattggcccttaaagacatggtcagaattgtcacagaacactagagccattctaccacttcccaaggctgtgctcatgtatagcctcacctcctgccctcgtgtgccctgagcgttggctctgatccattcggactcagccgttcagcagaacgttcttggaaaccatactcctgggcatattgacaagtgtggtagacttcctgatactaactataaagggggacagaatggaggaggacacccaagtcccaccaagagcctccatcagagctgggtgcttcactgttgtgcagatacctccattatgtgatgtcactgggtttcccaggacctcccagccatcctccctttctgccctttccaccagctttgagaagcacaaacagcaaattctatcaacaaccacagcaagctcatccaggcattctcccaagggctccctcctccctaagaagaatttgcaaaccagctgttacaaagatgcccttttgatcccgttacacattataaaatgtatagaaatctcgaggcaatttatgaacaaaggatagtcttgtgaccagcaggcaggaagtgccttcacacactttccatctcacacatggtctccacacaaggtgcatgtctgctgaggagagtggactggtaggcagaggcacaggcagagccagagagagtggacagagacagaccactgatcctgacctttgttttgcaacctttgagcttcacccatgtgagtgacttcctccagtgccaactgcccttggcgtcttgagagagggcaggaattagcctcgcctaccaattctaggcgatatgaactaaagtatcagctttgctaagacagagatatttgctggagcaagttgatgatacaaaaggagttgcaaaaattccatttggcaccgtcccctctgtggattaagaagatccaaactatcccccaccgtccacctagggagctttcctttcttttggtagggggagcaatgatggagaaagatatgagaattccggattgggtaattgaaacccagcaagtagttacgcaggaaattagaatacattatttaaatgttagccattggtaggagtacattgagtaatgaaagtcaatatatttttttaatttctgttttcaattactgaagtgcacatagcccttatgtgacattctgatagctcaggatataaactaaaagggtgggtgagcctcctcatgtgtgttgcctccctgatttcgtcccccttatagtgggacctatattagccactataaatcgatctggccatgtctgtattagtaaagcataatgttagtcaaactgtgatgaacatgcatgctctccagcagattgctgtcgtttctacacatatcacaggtcatcacacacatctttgcagtccccaccccatctcaggtctttatttttaaaatctgtagagtatatctttatgtgactatgatgatgtagttatcaaccctactatagatgattcgtttttttcacatttttgacttttgcaaataattttataaccaagaatgcatctgtgtctatgaacatggagaatgctagatgaaatcatagaggtggagtggctggctatagcaacattatattcattaagatagattgtagagagacttggcatggtggtgctaaggagtcaatggcaggaggatcaggagttcaaaaccacccttggttacatagtaagttcaagaccagcctgggatatgtaagactttatcttaaaaagggggcgttagttaatttaaaatttacatgtgtctacctttgagagatagcaccatattgccttccagtgacacagtcccaacttagagaagcctacatgtgtactcataggattaaagtaagttaaaaaagaaaagttcaacaaagaaagtgaagaaaattggaatggaatttagggagtgtggtgagcctttggcattcagctgaactctccgctctcctgtactggcacacaactgcattgggcaaagcctgttgcgacaggttggtcctttctctaggaccaaagccatggctggcagatcataccctcagacatgtagaagctgaaaaggaaggagacagaaatgaagaaacccaggctggtatctcagcacacccctggctgccacccagtgctgctgaaacctaatatcttgtttctttttccttctgtaactaatgagcaggatgacaagtactgggcgaggcgcagaaagaacaacatggcggccaagcgctcccgtgatgcccggcggctgaaggagaaccagatcgcaatccgggcctcattcctggagaaggagaactcggccctccgccaggaggtggctgatttaaggaaggagctgggcaaatgcaagaacatacttgccaagtacgaggccaggcacgggcccctgtaagatggcatttttgtgggctggcttttgaatagatggacagcttgtttcctgtctggtagccccacacccaaaccaacctttctgacatcagcactttaccagaggcataaacgcaactgactcatattttggtgtgcatctatgcgtatgtatgtatgtttgtgtgtgtgtatatgtgcttatggtcccatgtgtggtcagcggtgtgcatgtgtgagcgtgtatatgtgtgtattccttcacacttatcgtttaaagatagtcctcttgttgtcttttagttccaaacaagaaaggtgccatgttttttattccaccctggagactcccatggggtttcctccccttccttctcccttcctgcccctttctgccttgctctgtgttctagcgatctcacttggccagggtctgtgttgcttcaggaagcagggccctggatctcagtgatcaagaccataagctcttgtttctgtttcagccatgaattaccatgctggaaaggtgcatagcataccctagcactgcgcgcagctgaattccttcataggttgccccacttcccttccctttttcctccccaccctttctcgttttttcctttcagttttggtgacacttgtcttcaaatttaaagtgctgtttagatttagtagagtcccatatttacttactgctacctactaagtttccttttaattccaccaaccccagataagtaagtaccattccttatagaacacagagtgtgttttgcactgtctgtacctaaagcaataatcctagtgtacgctagagcatgctgcctgagtattaactagtggacgtaggaaaaaaaattccctacctaggaatttcactgtcttttaaaaaaaaaactcaaaaatcaagtaatgcatttgtgcatgaccagaatattctcaggacagggaagcagagggcaagggaaggcctaagaatgaggggttaatttatcagtatgtatgccaaaaacataataataatgcatcttggagaagcctttgccacggtgtgcttcgtcgtgcgtctccccttcccacacccagcccattcccacttttctagcccattcactttctccatttccctcttgatattcaaaacgattgacttaagattcagtttacccactttgttttataatatatatatttggggggggggacgatattttgctgtttttagaaatcagttaattaagtgaaaaagttgatgttttgaaaagccctcccttgacccccacccccaccccccgtggtgtccttttgaatgcctcacaaatgaatgattccggagcccgtgtttctcatcctctgtttgcttttgaacatatgtgcgcctatcaagtggacttctgaaaaaaaaaatgaatgtaaaagacactggtgtatctcagaatgggatggtgttgtcacaaactgtggtttctccgatcaatttaaatgtttactatagaccaaaaggagagattattaaatcgtttaatgtttatacagagtaattataggaagttctttttttgtacagtatttttcagatataaatactgacaatgtattttggaagacatatattatatatagaaaagagaaaaaaaggaaaactattccgtgttttaaaattatatagcaaagatatatattcaccaatgctgttcagaggagtgcttgggggcttttgaaatctttaatattttaaacctattactgacacatcagcatgttttctgcttaaaattaaaattttatgacaatactgaggcttgctgtgacgactcctgctccaacgctttcttgtttcttattaggtctcagaaggaagtcagttaacgtcacccaaaagcacaaaacgggttttagtcaaatatttattggatgatccagtgttttttaggaaaagcatctgccacataaatgttcacttcaggattctgagtcgttggaatggagtatggctgccagagccccagatgattttgttcgctttcggcctgtgtatctatctcacgcagtgtaaggttgacctcggtgctatgtgtacggcttagagtttgatagctgttttgactttaaagatggctgttattttgtttcactgagttgtataatgtcaagagagtctgctgtttcttcaaaagcacatttttgtgctcgattaaaatccccttccatccatggatgttttccggtctcctgcctccacagtatctgacttctctgcggatccagtgatgccctcccccctccctcagccactccgctgtccagtgtcacagatctggaaaacgagacctgtaggtttcttcccaggttcctgttgtattccacggtgagagatgagagagtgagagaaataaaatacattttgcaagcaaattactgattaaaaaaaatgtttcaaccatgttgtatagaactgaataagagataattcagtaatagccatgggacaccaaaaagttggtccttttgaagatagagaaagagagggattgcagaactgttcaatgacagtgcttgccagggcacagatgagtacttaaggagagaagtgttcaagggttgcactgtggcccacccagacacatggaaccatccagtactcgatgaagaaaagcatgcctggcctttcttggaattgtttttaccaaataaacatcacaaatgttttctgcagaagatataaaaagatcataataaaacttattcttttgtataccaggaaaggtttgtagaaaacctacctcattcaaaacaaaacaaaacaaaaaactcaagagtttggaatctccacaggtgccttatctgtaggtaattatcagtcccccacccccaggctgacttctctttgcccctggatattaactagatgagaaaatgccattcaatgccctgagaagctagaacctagggtcagataactgcagcagaccatagccattaggaagtcccattgtcaactgtcaccatttcaaggtaggcatctttccatggttaattatttggtcattccaaatgcatctgaaatgttgcatgccctgccattcagatgcaaagcacttcctggtcaggtcatatcttttcattagtcacatggattctcgaagaaagttttaaaaaaaaaggaatcagggtttctctctgctgatgctcccctgaggggatgggggggctttggatgacagtccccaactatagagggactggtgctttgggtcattcacaaaccacatcaggcatgacttggccaggcctttgtctctaaatagaacaggccttgaagggaccatcctttgtagaagaagaagaatgggcctatgtttgagaatagcatgatgggactcagtcactgggtgagggggaaaccagataaaagaacccagaggctctttctaacccattatcttaccgtgggaatttacactgagtctaaacataccttcgaaagggctacagcctcaggtctggatgacctgccgtgagttgtaagtggcaatgtctctcctgtccagggatgaaacaactgatgatgtgtaaaatacaaggaatactttgctctttctaaaagtttgttcagtttggcccttagcattcctttagaaaaaactcaaaacttcctcagagttaattagtgagatcctcaggcatcgatgcctgtggatctcagacagctctgtgtgtggcttgtccccaccggctgggattggcttcctgcagctgactaggctgaggtgtgatgccctccctccctgggtacataccttcttctctggctctgattgcacttgcttcctactgagggctcctgagtacaaccctctggggaagccaaattcaactccaggtgttcggtaaaaatcagtgtcaataataaatgaacaaaacttgtaggtcttgatggactgaattttcaataactactgttaatgcatttttgccaaaatctgtgttggggaatgtgtgtttgtgtgtggatgtttaagtggagacagaaaatctgtaattttttttttagcacctcaccagacataacaattaggtattatcctttcgacaacaccacaaagattgcatctgtcaaacaggctcaagttaacaagaggttagtgtaattgtataccatgatattgctggtatttatgctgtcaagtccaaaacttcatttgttcttctaaatgtttaataaactaatttttttccttttttcatgtatttttttttttttgtgaccagctggctaccaattgattttgtttctatcaccacaaccgagagaccatttacagaggtttgcatagatgataattatgctgtctaattagtaataaagtatcatttattgataatttacatactaagtacttcactatacacatggaatattgtagtcccaaaataatagaaagcatacaatgaggttacaatttttatacaacaggaaatgacaggaattgccaactaggcaagttaagaaacttacctaaggggtggagaactgactcagaggtgaagagctctggctgcttttccagaagacccaggttcgattcccaaaacccaccatggcagcccgcaactgcctacaactccagttccaggggatctgctaccctcttctgacctttatgggtacagacatttatacaaccaaaacttaccagtacatataaaatttaaaaattaaaaataaaaaagtgctcttaaagatggaagtgacagagatcactactgatctgttaaatatgtgccatatagacacagagctcagaagctagtctgggtctatgttcttgttgggtaaacaaaaataacccaaggacttattataggggcacagatcaatcaattagaagctgatttgagttgggacccagaaacctgaatattcttaatactcccagctaactcccacatatgaataagctcagatgattctcaagatctgaagggggatggttccagagcctcagcagtgaccaaaaatctgtgacactcaagttctttatataaaacggtgcggtgttgccttgtagcctattgagtctaactgatgctataagtcacctctgaggtgcctctacctactacagtgtaaaatgttatgtaagtagatctataggcaatgatgaagatgggaaagtctgtacgcatgcagtgaggacacaactgtcccagagccaacaacacagcacacaagagcaacattcaacttgagacttcgtccaggacttcctcaagcaggtccatttacaggaaagagattgcgtataaaggctgcaagaacgtctttaaattgggtccttgtacatgcactccttagaaattctttgttctccaacaggtctaccaatttgacagctggtttaagtaagctaatctctgtgcacactctggtttgccaagtgttcctcgaatgctgagccgaccaaccagtgtaggagcaaacggcagatgcctgaaggcctttgtgttccttctaagtcctcagacttcccaggtcttcaccttcccactgcctcaaagttcaaattcccagaaagtctatacataaacacttagcttcataattaccctctccagccccaccttttggacagcagctaatttgacagggcttcatttccttacaaccagttctggctagctggtcacacacacacacacacacacacacacacacacacacacacacacacagagcacttggcagatcctggctagctggtaacacacacacacacacagagcacttggcagatctataaatccccagccaagatgcgttactcactcatactgtccatcccccacccctcttcttggacatttcacttgataagtaagaagcctctagaatgacctggctcaggattagtgtcctctatctggcctttgaaaatcaaatgactagcaggaaggatacaaggaaacagagagcccatttagccactctgtccctcaggctaagtccccttgtaaggcttctctctcagctgtaacagagaacaggacgtggattaatagcccagctggtatccatacctgttttgattcgaccatgtaatgtccatcacgggctaatggtttgaatttggtcaccagctagtgatgctacgcttggaggtttcaaaacctctgggtgatgagacctagaggggggatatacaaccctggaatggatgcttgggagttctgtttccacctcagtatcatcccccaaccccgccttacctgtgtaagcttccctctgccacgtgctcctcctgccatatcacaaggaccaaatgaccatgggctaaatgttctgcagccatcagccaaaataattgctaccttgtaagcataacatacatacatatgtaagtatgtgtgtgcgtgtgtatgtaaatgtatgtgtgtgtgtgtgtgtgtgtgtgtgtgtgtgcgtgtgtatgtatgtatgtggtgtgtgtgtgtgtgtgtgtgtgcgcgcgctatctatctggccacctcaatgagaaaagaaacccagcatacctctgtgatggttaatgtcaaccccgatttgatgacttagaatcatctgggaggtgagtctctgggcatacctgtgagggataccttaattgggttagttgagatggaagactcatctaaggtagcagcattccatgggaggggattctggactatgggctgaataagcatgtaccactctccatttcttgactatggatacaatgtggccagttgccccacgctccagtgaatatcctaccactgtagactgaacgctgaccttgtgatagtaataaacccttcctgcctaagtggcaattgaccaaatattttgttgtaacaactggcaaaataatgaagatggcttcccaatgatcatcaccttcccccaagacaaagtggcaatgagagcactgtggacattcctaccccaccatccacaaaggcaccccgatttatatagtgcaagtaagcagaatgtggattttggctttggggtttttatttgtttgtttgttttattttatttttgctaacatagcttcatttcacctctgtaacctctccattcagagtacaggccccaaagcctcttctaggaagatccccccaaaccactactggaactgaatttccagatataaaagactggataccagcgccctatgtttgaacctcctcgccaattgggacctgtgcagttttccttggaagtagagggtggactcggagcatgagtcacaaggcacagatacaattcagtttcattccccagaaatcatttgtctcttatctttttagggtctcatgccttgggaaagggtgggagaagagacggggagtagaagatcttcccatgaacctctagcaaggaagcagccctggggggagggggagggagattgcttgctactttccccatgatgaagaccccaccatgtctgaacagacctgtgcatgatgaacaatctctcacctggttttctgcacagccctcccaggacccctggccagtaagcagagcagaacaaagaaagaggtttcatgacggcaggcaagccttgaccggagggtctgaggactgggatggatttgtgtggcaatgcgacctgacatctctttattcctaaaggggtgcaccctgatccagcctcatcccctgtggcttgaaggaaggcacttgtcattcccagccctctgatgtcctcagccataactaaataatctacagaacgaatgcctgaagcagtttgccagttccctagcctgcaccccagagctttttccacccactatccctgaaatgggagagtatgatttgccaaggagatgtcagtttggggctgactccatctgagacaggcctacctttcccaaaatgaacctccttcacctggcatctagttctccctaattttttttttctgctcagaactttgcaggcaaaatgaatgtgctttggtaaagcttcctgacaacacccctcggcgtctgcagctgcctgcctcttcaccgggcagcactggagaaccctgagacccttcttccaggtcaccttctcccacagctacagacggaccgaagcacaagaggagacacagaagagcctcatgaaagagctcttagaagaccaaagccttttcatccttttgaatgaagatgactcttagaagtagcaggatataatttgaaagaggagacaagtgggtgtatagaaagaagaggcgccgttccttggcctctcagctcctggtgggagccttggatctgagatatttgtgtgctgagagtccttctccctcttaatatcatggtctttcatctccctttttttcctttctcctccgctccctggctttcatacttccctccctctgtgtgcaggggaataactgcccagggacaagaggtggggatggtcccagggaaagtgaggatgggattcagggccccaggcagaggacggggaagagcaaagtccagatggcagctgagaccttctggccctctggcagtaatcttaaacacgcgccatggttttgagacccattcaccgataagtcagtatcatttcccagtttcaaagactgatcccaaacctctcctggcatccttaaataatgtttgaaccagaaggtgcactttctgtgttccagttagcaattttcctcactctcttcataagaagtctgtgggcttgtgaagaaagacgacttgcagaatgctgcgcactgctccacacaatcacagttacaacaggccgcagggtttcatgcagcacccttcctttcctttggctggtttcccatactagacccaaagcacaacggtgacctgattattgttctatagattgagaaatgagcacaggaagaccttcatctctgtctcctctcttctaggacggagtgtatgctctgagtatctaagtcctgcccactcttcattataaattgaaattactttctgtgaactgtcctgaagtgtcacaggttggcagcagttgctcccaccttagaatttcaccccatgtccgctcaaggctgcttatggtggtctcctgtggtcgctaccctcctcgagtatggagttaattgcatccgttcacagtgtagcatggcccaaaatatgccaggcatctttgatgacagagcctccatacctgagactgtgatttcatcctaaccctaactacttcattgtgctatcatttggaggggggggggacccagccataacaacaacaaacccgtgtttctgtcttttcacagatttgatttgctaagattttttttaagatgcacaacaaatctccttgtttttttgactaagattaagtaaagagacacagccaaggatggggtgggggtgtgtggcttagacagtaaagtgtttttcttgcaagactgatgacctgtgttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactcaaaaaccaaccagccaaacaaacaaacaaacaaacaaacaaacacaaagtagattagacttaaggatcagcagctgacattgcttactgatcgctaaatccattcatacacatgtgtttgtacacatgcaaacacacacacacacacacacacacacacacacacacacacacgaaacacaacaacaaacttggaaaacaatcttatcttggagcactgttatttattgatgccttcttggcatggatagcctaaccctaataaaacatctcctcaagagatcacacttagtaggtgcacaccaaggatcaccctagtaggtgcacaccaaaggctggtggcaagatgggtcagccttaagtctaggtagtaagaggcctgttattcagaagtgatttgtggtttgttctgtcttgttgaaataggatttcatatatcccagtctggctcttaattaattatgtagctcatgatgacactgaagtcttcatagtcctgcctccacgttccaagtgtcggggagtaaaggattgtgtcacgatgcctaactggaagtaatccgaaatgagataatgttactattctttattatccaaccacgtcgtcttttctcagaataaattcatccaagtatttgcagaatacaattggaattatgcaatgtctgctgaaggtatgttagtggaaaattttagttgttgaaacttggaacactgctagactagaccccaaaggaaaacaaagacatcaggagtgttgtaatttggaggaacctattgggaaatgggattttaaaaaatgaatcactgcccatcttacagacacatgattattcgaattctttttggaaaattcctatttgtaaacctgttgctttaagtgaaagaaagttttagaaattcgattgttgaacgttctccacttgcccacacatgaggaaatcttgctgtgaaaaagagtcatcttggccattgactgaataccctaaaaagtgtgattctgacagccagtagttaacaaatttaccaatattaaggtataaacacaaatctatagcgatgtgcatgctgtgcaaacgccaggacctgggttcttttccggcgcccatagaaagctcaagtgtgggggtgggcatttgtaatctcagcactggagaagcagacgggagaatccctgggcacgatggccagtcagcttcctcagtgagccttgggtaccagtgagaggctgtctctaaagacaaagtagaggttcctggagaaaggtactgaagattggcctctggcctctacacacaagtacatccgtatggacccacatgttacaaacatagtaacacacaaacatgcaaaatacactaacaagaaagctctggtagtgttacatgcctgtaatctctgttccctgagagtctgaggcagaaggatcacgatgagttccaaccagcatctgctacacagtgaggcagtactgccttaaaaacaatgaacaaacaaaaattaatagaaatgtaaaaacacaatattaactattcttttttctgatttattaaatttatttattttaatgccctgattttttttagatgacattggatagaagaagcaaatcaaggctttctagacaataataaaaaaaattttaaaagttgcatcattactagaactacttccaccagacagaggagaggagggtcagagctagctgctccccatgcagtgctggctactcccctgccgtggggacccattctttgacaagatctccaacacccccacagaagtttggaaacaaagttcca

SEQ ID NO: 410 - DNA, 1222 bp, Mus musculus
tttttgtttttgttttttttgatatttgtatgctgatgtatttacaaagacagaagtgattttttttttttttcttccttgtctgcactgttttgaaagcgagtacttttggttggcaaaggacggaggaaacaaagctcatcaacatttcggggcggcgattggccttctttttaaaaagacaattgagtgcatcacgatggagaaaatgtcccgacagctccccttgaaccccacctttatcccgcctccctacggcgtgctcaggtccctgctggagaacccgctgaagctcccccttcatcctgaagacgcatttagtaaagaaaaagacaaaggaaagaagctggacgatgagagcagcagcccgaccgtcccccagtccgccttcttgggacccaccttatgggacaaaacccttccctatgacggagatactttccagctggaatacatggacttggaggaattcctgtcagagaatggcatccccccgagtccgtcgcagcacgaccacagccctcacccccctggcttgcaaccagcttcctccacggcgccctcggtcatggatctcagcagccgggccacagcgcccctccacccgggcatcccgtctccgaactgtatgcagagccccatcaggccaggccagctgttgccagcaaaccgcaatacaccgagtcccattgaccctgacaccatccaggtaccagtcgggtatgaaccagacccggcagaccttgccctctccagcatcccggggcaggaaatgtttgaccctcgcaaacggaagttctctgaggaagaactgaagccacagcccatgattaagaaagctcgcaaagtcttcattcccgatgatttgaaggatgacaagtactgggcgaggcgcagaaagaacaacatggcggccaagcgctcccgtgatgcccggcggctgaaggagaaccagatcgcaatccgggcctcattcctggagaaggagaactcggccctccgccaggaggtggctgatttaaggaaggagctgggcaaatgcaagaacatacttgccaagtacgaggccaggcacgggcccctgtaagatggcatttttgtgggctggcttttgaatagatggacagcttgtttcctgtctggtagccccacacccaaaccaacctttctgacatcagcactttaccagaggcataaacgcaactgattctgaaaaaaaaaa

SEQ ID NO: 411 - protein, 354 aa, Mus musculus
YLYADVFTKTEVIFFFFLPCLHCFESEYFWLAKDGGNKAHQHFGAAIGLLFKKTIECITMEKMSRQLPLNPTFIPPPYGVLRSLLENPLKLPLHPEDAFSKEKDKGKKLDDESSSPTVPQSAFLGPTLWDKTLPYDGDTFQLEYMDLEEFLSENGIPPSPSQHDHSPHPPGLQPASSTAPSVMDLSSRATAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 412 - DNA, 79860 bp, Homo sapiens
  misc_feature (1)...(79860): n = A,T,C or G
gaggagcagtcagggagatggacatgaaagcaaaagtgttttgctttgtgctcctgagagcacaaaggaggactaactttttctgggggcatcaggaagatttcaccaaggaaggcagctgagcggagccctgaagattgaaacagccattcatctgaccaggacaggaaagctagcatgaagcatgagagcacgccaactcatatttattgagcttgtcctttgtgccaggcactagtctaagttttccctaggtattaatgcatctaatcctcatctgtgagcttggtacaattattctgctcacttcacagttgggaaaactgaagcacccagaagctcagtgacttacccaaagtcacccacccagctaattcatggtggaaccagcattgagctccagtggtcttgttccagagctcctttttgagaaccactgagatagacttagactgaattttagtttctgctccttactagctgtgtgacctcaacatgttactcaacctctcaaagcttcaatatcctcatctacaaaatgaagaattcagtgggcatatgtacttctgtctgcctggggttcgttcctcttggaaattgctcctcctttccctctaaccatcagtgccagttggaatggtcatgttcttaacagccccattactaattaatccaagaatagacagctgatctaagctgggcctatctaaactcttctctgagaattttttttctcctaggctgaagtgcagtggtgcaatcttggctcactgcaacctccgcctcccaggttcaagcgattctcgtgccttagcctcctgagtagctgggattacaggtgcgaaccattacagttggataattttggtattttcagtagagacaggagtttgccatgttggccagactggtctcaaactgggcctcaagtgatctgcccacttcggcctcccaaagtgctgggattacaggtgtcagtcaccgtgcctggcctctctgggattttttaaactaaaactgagaaagaaaattagtccctctctggtggaggaaaggcaaatatgtaaaactcctgagctactggaagtcacatgctccagtgtgtggtagaggttaagtttgcagagaataaaaacaacacaaaaagagaaggaagagactgaaaaggctttcaaaactcctgcatttgcctaagccagttcgacttgggtttatgacataggaaagaattttcatcagtaagaaatagtagtacctgtttcctagggttgttttaaagatgggttaccatgatgcatgcaaagaatttagcacagtgcctagcccagtcagtagtcagcaaataatagttcttactgttacaataatcagtggcattcttcctctagtaagctttgcattccagaaaactggacagcttgtattcagactgtggtattcctgcctgtgtagaccgtactggcattcctcgcccactccctgcctccctgatgtactcttattctgtctacagaaccttacttgaagctcatctataaagacttctttgagccctttggacagagttaatcactttcccactcatactccctttttccttatttatcaatgatacctatcacactgagataggtatttggttaagttgctatatccccacctgactgtaaggcctttgtgaccatatttctcctccttgctttagtcctcagtgcccagcacagtgcctggcctaagaaagccctcccatcagtgttgtgtgcattgaggagcagaggactaagttgtcgtctcaggaaagcagacctgctgaaagctcatcaatcttaatgttccctgcctgacaccaaaaatgcattaacagatggggaatggtgtgcttggaacctagtaaaagtgaagtcgaaagagtcaggaatgctgcctccagtgctgtacaaagaccagcagatgcaatgcctttgaggcaataataagtaggaagaaagtaaccctagaatgtgtctattgatgtgtaagatctaaaaccacagcgggccaagcaagacccttcaggatgcttcctcctgcttctctcaccctggctgcaagtccctgggatggaaacattcacatccacatgctcaattggaaagaagtactcggcaaggctatgcgcacccggctggcactgcctgatgtcattaaagtcatgcgattcactccccttgctctgattccacgctcagcaagaaagctcccatggagagtatccctacagggcagggaacacattgtccagctgacacaaatttttaagtattgcttgaagttcaacacgcctggcatgctccttagaaagacctcctttttaaaggaaagctatgccgggctaatctggttgcacatggtacatgccagtgtctgagtcaaaccagttgccttgggctctataattggatcaattaccaatgttccaacaaagatactcatttacaggtataaggttagccaatcacttatgagatggctcctgtgagactccacccaatgcagaaacttcaaagaaaatggtgacaatgtctatgaatcagaacctttgttttgggattaagacacaataaagggagggaagttggtcctgatgccctacatgatgacaggccattgttcaagttctccccaggttttcaggatgcattggtcatgaaaatacttggtccaccagagcatgcatataccctcagcatggttttgtggtcttgctctccacttgcttagcttaaaaataaactctgatcacctgaggatacctggtcttatatttcccatgcacataaaagagcctgaagtgcagcttagaaattatatataatttttaattttgattttcaagttatattttagaatgtggttgatgtcagtcagtttcactcagcctaattgacattggatcctaagcaaattaaagactagattctgagtcatggtgattttctgcctctacagctcaactgtctctaccttcagttgcatttactagacttgaaataattttaaagtgttagttaatccacaaacttctattccttcaccctttatgaagatataggaaatatctattctttcctgactctggctgagtggctatttggaatctgctatatttgattttttttattgaacttcaaacttgtgttttttggttttttttaaattatactttaagttttagggtacatgtgcacaacgtgcaggttagttacatatgtatacatgtgccatgttggtgtgctgcacccagtaactcgtcatttaacattaggtatatctccaaatgctatccctcccccctccccccaccccgcaacaggccccggtgtgtgatgttccccttcctgtgtccatgtgttctcattgttcaattccccttttggagactgggagcaatagaatgtagctgcccctggtgagagaaaagggtgagaagaaaaaaggatgtgtgtttggatgaaaagtagcttctaatatcatggactacatcaacagttttgcagattcataagtgggagcatctctgcaaaggagcagagaaaccagaaaatgcaaaaaagccccaaatagcaagccctcacatttgtttagcgcttcacaatgtaccaagcacctccacatgagttatctcatttaatcctcctagcaactctgcaagctgggaagcacaggcattagtttatatttcacacaaagaaacttgagatcagagaggttatccaaggtcacgggacagaagcaggatttgaaccagttacaaacggagtaagcttattgaatgaatgtttgtccttcatttactggagcaaggttaagagtgcaagcactggagtcaagcagacctgttttcaactcatagcttctccatgtattagctagccataggatcatgacaagtcactaatttctctgggcctcactgtcctcatctgaaaaatgggaataatgaaatataccctatatcattgtcccaagtaatacataagataatatatttaacaggtctaatgttgctccagaacacagttaaacacacaataatttatgccttcttcatgctgttgttggcatttgttgtagtagtagaagtagtaatagtggcaggtgtcaatgtatatctggccccaaatcctgcgttcattctatgcaacacactgcactgatttttttttcttctccttttgccacgcgtattttttctttctcttttatacagttttctttcatcctccttcctatcacatgtatagaaatcctaccatcctctgatttgaaacacacatacagacacatgcctgatttagtacctcttctaccgatctacctgtcttagtctttcccactcatttacccaaacaatacagggctcagggaaaggacggggaagcctcaaggaaagcacagggaaggactcatgctcctttacataagtcagtctcagaggagggcttggcattcccaacaaatgttttattgttttggtttccatgatcctacaccaagtgaagagatttgagggtctccagtagttaagctaattagatataattttcctttttggtgctttagctgagttagaggtttcaggaaggagagaaggaagaagcctgggttaggcatatctagcctaactcccacgtgatgcctttcacttctgaattaattccctggataaagtaccctttctgacaacgagataaacaggttcatccagaggtttggctcactagactataaagcccttcataaccacagtgctcgtctccatccaccccaggctcctagccccaagtaggctacagtggcaggcattgtgtgctcaacaaggcttcacacccactgggaatctgaaacataaacactgcttacgctgcaaagttctctctgcagacctgcaaggctggtgccaaaatggctgcctcacgtctgcccccaccgggctgcacaaaggactccccacccaatctcactatcaaaacctctgaaatgacaggacaggtggcaaccactggctgggcaaaaggctgatttccagaacttcagaggagagctgtgctggcatcctttaagaagttgattctggggaacgtttcttctatggtcattcctatttttaggacagttttaaacctccagagcttctgctattcctttctccttgaagggccaactgaagggtttttcagtggcttgtcaaatgttctttatctagtatttgtttgttcgaatttctctaacaaagaggtttagttttgacttactgtttaagcacatgcaggttaagacaggagcactgaggcattactagttgtaaccaaagacatccaataggcttaattatttgctcatacacaaaaaagcaaattggataatgcctctgcttttggctcttatctaacttaatgtggacaactttgtagaggtcttgtcaacaaactgaatgagccactgaaagtgaggcattcattttagccgtaaactttggtgaacttttttctgttgctggatatgaatcagatcccaggaaacttagaaagaacatagaaatagcattattctgtccttagtgataaaatacccatttttcctcgggatcaaaagtttgggtcacccacaaatacacagtcaaataattgtcagcaataacatcaaaagaattcaagggggggccgggcgcggtggctcacgcctgtaatcccagcactctgggaagccaaggtccacggatcacctgaggtcgggagttcgagaccagcctggccaacatggagaaccccgtcgctactaaaaatattaatactaaatactaataccccatcgctactaaaaatactaataaaaattgccggatgtggcggctggtgcctgtaatcccagctactcaggaggctgaggcgggagaattgcttgaacctaggaggcggaggttgcggtgagctgagatcacgccattgcactccagtctgggcaacaagagcgagactccatctcaaaacaaaacaaaacaaacaacaacaacaaacaattcaagggggaaatgaaagtctaaaacaattggatatccccatgagtaaaaccaaccttaatccttacctcatagtatacacaaaaattaatttgaaatgggtcataaggctaaatgaaaaagcttaaactatgaaagttataaaggaaagtataggagaatatctccagaactcaggagtagtcaaaagtttcctagttcatagcaagcaataatcatgaaaaacaaattgataaattgaactttgtcaaaattaaaaactgctcatggaaagacgttattataaaaactaatcagcaagccacagattggaagaaaatattcacaacacacaaacatctgacaaagagactatccaaagtatataaaagaactcctaaaattcagtaatcaaaagataaccaaattcaaaaatgggcaagagacttgaacaggaagatgtacaagctactaagaagcacatgaagtagcacatgccatcatttttcatcaggaaaattcagatgaaaggtccattgagaactgactatccacccactagaatggctacaagttttaagagaaactgacaccactaaatattggtgaggcgctagaacaaccagaactctcatatactgctgctggaaatgcaggacaatttacctgcttcagaagactatagaagagcttcttctaaagtaaaacacacatcttttctatgatccagtaatcctactcctatttgtttatccaagagaaaggaaagcatgtgttcacaaaagaactcagacaagaattctcataaacattttattcatgcctaaaaactggaaacaacccaaatgtccaccaatacaacagataaacttttgtatattcatagagcggaatactactcactaatataaagaaatgaactatatgcaacattggtgaatgtctaaaatactgtgcagagtgaaagaagctacacacaagagagtatatacagtatgatttcacttgtatgaaattataaaacaagcaaaatgaatctatggtgtaaggaggccatgtaaagagaaagagaaggccagccagcccagtatcccagctgagcctaacctagattgcagaataatgagaaataataaaatgattgttgttttaagccactaggttttggagtgatctgttacacagcaatcaataatcagcatcattgctttcctcatggaattgtcagaagtatgtgatatgacacatatggaagggctctgtaagtggacaagtgctaagcacttgtgagcggcagttatctctgggcatatgtgcagattggggttagtgctcattagggatatgtccatttgagaattaacctgtggaattcagagggtcttactacccaaccaatataacctttggtttcttctatccctctccttcctcttgagcagccatccacaactgcttctggggaagagagagagagaaagagaaagaaagatgttcatggtttgttaaaaaaataaaagaaaataacatttacaaatggccagagtagaaaagatgtaccaatttcatttatcttgttaaggaatggggctagattgaagattagccaatgcttataatttttgaggctctaagaaatacctttgaagttagagaaggatggagagaagtgagagggagtcaccatggtctaaggggctggtcctcaatctggtccgtgacatgttgatcaggctcagggaaattaaattaaatgaaccaaattcccaagaaactgcttgatcaaccagaacgccagtttatccacttgcaatgagaaatgcaatttccaagccacagtatttggttctgtcaggtggtaaggagaagattaccctgggaaaccagattacttgacctggtaagagtttcatgtctggaaacatggggaagtgaggacatgcggagaatcatgagcaggtggagcactttgggcgtgctgagtaatgtcagtggactgttacacaaagcttaggtaacgcatctttcatgcacctggaatctgcaatctaacagatttctaaccaggctgagaggatgctctcagtcctgccagtttatggacttacagggatgtaaggaactcaagacagggaaatagcctctgtctccaaaaggatagcggagatgaggtcccttttttattttttaaaaaaacaatataatataattgatggattcagaccgttcacgagagactattacctccacgcccagctcaggcaccttctctagaatccctttcctaataatgtaagtgcccctgtcacctccatctatccatttttgttcttttaagcctattttatattatttgcttatatgccaaaccctaaacgatgagttcttgaaggttaaaattatgttttattcatcttttttcactagcccccgcatagtcgctggcatacataccgtggtgctcaataaatgcatgtggcattaactaaaagtttgctgtttctggaattcgtctgaaacctgaaacactgcaacaacatctcacttagaatgttgccttacccttttgccataattttagagtgaggaagtagaggtcactagattacgtgtcccttttatgaagaacctacagctcagggcagaaaggcacttgccggaatcaccctgccagggaactctgaaccccgctgcgccgccgctcctgatctctggggtttcaggcgcctcctctcttacaaccctctcctggggaagtaaaccccatcaagacaccaccacatccttccccagcgactcagcctggggtcacaaaggcctttacgtcccactgaaaaacggttttctttcatttgtgcccattcgttcttgcagccccttccccagatcgaagactagggtcttagtaaggagaggtaaggagggaggggaagaacctgcctggccccccgcggagctctgcagggggcgtcgcggctgcacgccagcgcccgcaccaccccaggcgggaagggagttatcacacagggggtcgcacgcagatctcggggaccgtgggtgccacgaggtcaaactggcagagggagacgctgcagctgctgtaacagcaaggaaagccgaagcccccttaggggatactttacaaaattattttaatcaccgtgcaaacctaataacttgacccaagcgcaatcacctgtattcacccagagtaaatattcctaaaatcccgttcagtgtgtctgtgtctctcccgcctctttccgtttcaggcaaatgtctaccccccctctccccccaccgttaacacctctctgcagcgtgggaaacagtgcccagcagctcagtcctccgcttcccgctctgctttttgcatcccattcggacttataggaagtagttattttttggtggtggtggaaactgggcaagaaagaagacgctaagcttggccggggccaggagaaatattgagaagggtcgttaccttccatccgatctaaaccaatcatctcaaacttggctactctttggaaccacctggggagctttaaaaattatggacgccctgatagcaccgcagaggttctgatctaattgatctgggatgcggcctgggtatcgcgatttttttaaaactcctcaggttattcccagcttgaaaactatggatataaatttctcattcctcttcccacccagaccaaaaaaaaaaaaaaaaatctaagcctaagttgatggcccagggaatctggcacctgctcccctgcaaccagccagtgctgcaaggtccccgaaaatcggcgcgagcggcgacgctaaacacgcggcggcggggcgagcgggccaggcgggcggtgccgcgcgtggccccgcccccgcacgcctatgggcgcgaggtgcgggccctgacgtcactcttgtcagggccgcggcacatgggnnnnnnnnnnnnnnnnnnnngggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacggtgagcgctgccgcggccccgctccgggaagggacgacgctccgggggtccccctccgcggccgggcacgcccgctggagcatcccccaaccccgctcccgccctgtcccgcggcgccccggccccgcgctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcaggagcctcctctggcttgagccctttcttggtaagtcccaaaccttcccaagacaaccttggccttagcagtagaggaggggtacgtgtgatgaggccccaaacccggctaagtgatgccacggatttgggttgatgcgatttcatgccttcggtatcacagtagcaaatgcgaaccgtgcggctcacagtgtaaagttctgaaaggttatttggctacaaatagcttgggagtacttgcaccttcttttctaggagaggacaacctgttgcattgcaagagtttgcaatctgcagatgatagccagggacccctccctaactatcctttaaggaagagcatttgggaggaaggggctgcctgcaggcttttgcatctgtgggtgttttaagtcagattttcagatgagatggtagagggttagaatggatggcagtggaggctgtgtttctctgaagatgaaactcagaagcaaattccttaatcccagattccacccacgactgaatactagaattggcaagatccggaatgcttgttaaagacctaatgggcgagcagtacttccaggtagcaaatagctgcatacttccaacataaatgtatagaataactcaccttttccaatagctctgcttttgaaaggttttgtaaatgcatactctttgtaaattggatcatactcaaatgtttggagaagagaaggaagaaaacactttgtatttttttaaactccttttgtaaaaatcagtgtgccccagtggctttagaagcaaacacatgtgagctcagaaagttctcattctctgccaacatgaggcattggtcaagttccctcaagtctcagagcctccgagtctttgttgtaaatggaggtaattgttattttgcaagtttattgtgagatttttgagataatatatggaaagaaccaggtatccagtaggtactctaaacatgatgttaaagaagggtggaaggtccctgctttaccaaaattaagaccactaactcactggctttgtaagtctgaatgacctcctattgctgctgtgatgaattcctggaagataattcaagcctggttattggctgttgttttcttaaaaatgacagcagttgtatataatcacagatgttatattcctattttaggtttaagttattactcttctcaaataatgtgctgagactgttctctggtttttatcctagatcagcctgtagccctgccccaaggactagtgccttctttccaaagtaaataggaagatgttgaaaaacaggcagagatccacgtcctgcctgaacttttaactctagatctacaaaagacagcagccagagaaggaccctgccattcgtgagaaatagtcttataacaggccaggaaaagtgataaaagagcggtattgtttttcttttctttctttttttttaagtccagctttcccttcttctgcagcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtaagtgccctgaagattctcccttcagaaagggaggaggagggtgaatgggacaggcaaggtagagttagcataaacatcttaacactcaggttttagcaaagatcctaagagaggtaccttcttctgctccactcctggcagaggctctcccactttaatgagcatccatatcactcatctggagagtccggtaaatacagactctttgtatctacccctagaaattctgattttgcaagtctggaatgagggcccaggaatatgcattttaaccagctcccccatgggattctaatgcagctgatccaagggctgcagtttaagaaataacttacagttaatgatttggataatttaagcctccatcgcatcttgtatctcttttcctcattccctaaacacgtagataacaggtagactctcaatagggtttggtttacctatattcactcttgtctgtcctgaaggaaaaaaaatgtgagtagggatatggggcaggtatttttttttccatccttttcatcttgttttgtcattagctgagaagtagaatctaaaagcaggctctcatattgtgtttctgagccttcttcaggaccagactccatctctctcgttgctattcccataaacccaactgttcttatctttttttttttttcattttcatctgtctatcacactcagtccacctgtatcaaagcccacaaggctgcaaggtcagctgtaaatgatcttgaaatagtacacaaaaatatcacctgaaatgaccagtacttcaaaacccactgctaatgctcagatataaacacagattgaaggagctttgaattcatgcctttagcaccctgtagtaccaaatgaacaggaagaaagacgatttcatgtgcacaggtaaccaggaacaaagattcagccagataaatcatccggaaggtcacagagctgagggccttagctgtgggggaagacagaaagcaggacaatgcgaaacttgtgctagagattgttactgaactccgtgtcctcgactcttgtagaaatttctgtggcacatggagcaagatttaaatggaaggaaatgatgtaaaggaggaagagaatacccctgcctcgatatattcatattgaagttcctcctttcagacctctgtgtgctggccccttctccaaaattcactttgaattataactcaaggccactggctggaatggaattaattcttagcctccagccacccctggaggctgtgggagcttgggaaaacatgcctttatgtgatcctgatcccctgctacttagaatgtgcggtaccactatcttcaatttttttgtaggaacaagcaacaaaatgaataacccttcaaagtgggaaaacagccaggagagaagggaacagagccccagtgagagacacagttatgcctcggtcattgtgctctgtagactgagaatcaccactttgtagctgtgtgaccttagaaagcaacatcatttcttggagcctcagtttccttttttgtagaaggatacaatttctatttgattgagttattgtgaaaattagagataatacgtataaagggtcaactgattagcaatgagtcttctatttgtggaagcaattgtgatcattgttgtatgtgtcaacttttattacttatttcaatccctgtcttctgaaatatcttcgtaaggtaactaggtactgtatataacccttcctctggagagaaatgtcaggagattttgcccagtagttactggattggggtattttgaccaacacttgtaatcaactgacaagtatttcttagtcccctaccaaatttaggatgtgtaccatgttaggaatactatattttttcccaggagacctgcacatattgggtgttcacaccttggttcctactgagagtcaaaaattggggttttgggatttgaagcagcttgaaaactcatttgtcagagctcattagagtcagtattgatcagtgactctcagaaggcttggaatgcccaatcagagttgcaatgcatagcaaagaactcctgagtttcaggggatgtcattttgtaaggttctggtggaaagacactgggatcaaagggaacactgagggtctagaaataagttctccatttaaatgtcttattttaaataatggaaacacacttcaacatagtttccttcttggagttgaaaactcgatagtcctcatagaaaaggaaaaaagttaaacctcgtcttcaaataccaaactcaggtaaaataacactctgctgttcatagattgttgatcattataaagatgcaaaataaaattctaagagatgttggcctgatggatggatattgcaagcaaacctgaaaaaggagaaagttcttgattattctgtgtggctcacaggagtgaccagaatagaagtaccaagttaatcttgaggaaaataagtcctcagaagggaagagcacagatgtagccttggtcattctgggagctgtataatttcagtcttgattggtgtttctcaaccttggcactgttaatgttttgggtaaatctttttttttttttttttttttgagacggagtctcgctctgtcgcccaggctggagtgcagtggcgcgatctcagctcactgcaagctccgcctcccgggttcacgccattctcctgtctcagcctcccgtgtagcgccaccacgcccggctaatttttgtatttttagtagagacggggtttcaccgttttagccgggatggtctcgatcgcctgacctcgtgatccgcccgcctcggcctcccaaagtgctggaattacaggcgtgagccaccgcgcccggccttgggtaaatcttgtgtcttacgctttataggatgcttagcagcatcgcggcccctacctcctagttgcaagtaggacccccagtgccccagatgtgacaagtaaaaatgtcttcagtcactaccaaatgtcccctgggcataatacagtcactcccggtggagaaccactggtctagaacttcaatttggacagcaaaatctggacttactttaggaccctgtcacacgcatggataaactacctgcaatgctttatggcaaaacttttaagaaggtcaggggacattgggttgccaagaagaaatagaatattaataagagcataattatacactttagttaataaaactaagccatcaggctaatcaggagataattgcagagtagtttaccaaacaattgtttttggctattcactcagcatgcatcttttgagctatgctccgttgtggtgttagtgcttcttgtttggttgaagggcaatgaaaccatgagctgataaagtatgcatttctaggtctaccccaaggatgtcttggaatgacaaggtgagcattcttgtgaatatttatttatttatttacttatttgtttatttatttttgagatggagtctagctccatcacccaggctggagtgcagtgacacaatcttggctcgctgcaacctccacctccggggtccaagctattttcctgcttcagcctctctagtagctgggattacaggcattcaccaccatgcccggctaatttttgtatttttagtagagacggggtttcaccatgttggccaggctggtctcaaactcttgacctcaagtgatccgcaccccctcggcctcccaaagtgctgggattacaggcgtgagccaccacaacctggcccatttttgtgaattctcatactatttaccatgactgccccaacccctttcttatcttgagcaccccatccctattcctctaactgtctgatcaaagaatgaatcaaatatctgaagaaatccagttttctttcaagaaacaatccagggattcattaaaacctgttgtggctattgtgggatcaccaagctttctgggctgacatcttaatgaagggaagagtagtggttcttggaggccagagctaactgcaggggctcctcggtcatccaaggtgcagtgtcctgaatgttcctaggccagcagagatgacaggagtcattctgatgacttcaatgtttgcattttagatactgtcagaggtgggatgtgggggtgctctcctggagggacgaatatgtgctgggtactggaaaaagaagaatctgtttgccatgagaattgagcgattgctttaaggacagccatccctttagggaaagtcatctatagcagacaaaggcagagttatttttatattacatgcttgtaaagccagatttgaaattatttcctctggtggtttttctttgaatagctggggggtgtcctaccactgttaggcccatattccgctgagaattaagaaggctgtctttctagttctgagcacggagactgggttatgatgaaggctggttacagagtaaagtgaaaacccttccatgtggttgtgtgtgggaaaaggatggcataagtgggtggcacaaaaggagcgggggtgggggagaacccattgtacctttgcaatatggagtttgtattctgtttctgccgaccttccttgtgagaaggtttgggtatggaaggaaaacgctggcctgggaatctgagtaatgatggagggaagttctgtgcaggtgattctgggtttatggaaggtcagaggattctcttacttttcccaatattatgaggtgaagcttcgcttaagggcgtgcagttcgtgtatctttccagtccagcagactgataatgtctgcaggttgggagcgccatgactgatagtagctgtgcccggtgtctcaagcatcttggaagtgctgttcattcatcaggggctaggagatcctgaaggggagggagtctgcatggttctggagacaggtagacatttttctgtttcttgtagagtttatcttctccacggatccctgtagaggacaggcttgctgacattcacaggatagtagtcccaagcctgtggcaaaaggtatttttgggtatgtctggaaagcaaggcaacttggtggttaggattgtaggctctgggctcaggggcttgggtttacatcctggacccacccctggcttgccgtgtaactttgtgtcaatttcttaaccctttaagcctcagtttactcgtcaatacaatggaaattataaatggtccctctcccttggggttttggcagggttaaataagatcgcatgtgacaagtctggccagtgtgtattgcacgagtactgggtgcattcagctgttatggtgtcagtggcatgaggtacagaaaggaatgactggattcccaatccctgttttctatttagggatttatttatccagtccccttccctctgcaaaaataggacatgctttcatgcattttttttctttcccatcatgtccaacacttacagcctgacctttctcttccttctgggttgggacgaatcggttccctgatgttaaccccgcagcatggcttctgggttaccaactcctgttttgccaatgtggaaacagccactgtctgggtgcccagtcccccagctctcgtgtgagccctggcaaccctggctgcctgcctgcatgaccgtgtgctccaggcacgtggctgtgccctgtggagcttgcccaacgctgtgtggtgtgctggcttgcttttttttttttttttccctcctccccctcgcttcccttcccaggagaatgacagcaagtgccagcaagcaattgtaatcctgaccctggcatgagaaagctgagctctggagggcagttcagatgccagggaaacctgttctgtccaacattctagccagaccccaaacctggccctctctcctgcctgtctgcccagaggccctgtcttctctgcactgctgcggtgggcaggattcctggaggccagctcctgccaagggtcttggcagagtctttccagttcagcactgtgcctaccagactagaaaaatagcaatataaagacagaattaggtggaggagaaggaaagggggtgggggaggtgggaagaaaaaaacccttgataacatcctaatgtagaaagccagaggaggggaagacagccgtgatttattaggtttctcagaaacctctcttccaattagcactaatcacttttacccaggaatcattttttatgtctcagcaatgaaaatggaggtaagagggaaggtagtagagaaagtaataagatgaaaaaaagtagaaaataacatattagagaggtacagggcctgtgtttgattctgtaatgggtgtgggtgagaatattggtcacagctaatattgattatagtatttggccctcccccagcaaatgtcttgtcctaaagctactaaaccactgtttttctataaatttaaatttccctcagacttaggtgcctctgtctcaccatgcacaatgtctgtcagaatgtcctgtgtttgagacaccagtctatacgggcaatatagcagtaatgttttttagagcacagaattgaataaacaaaacagcctgagtgtgaatcctgactttgccactcattagctgctcacgatctcaggcaagtcatttaaatgctctgagctttcagtttctcatccggaactttggaataatcattggacctgcctcataggactgttgaaggtcatatgagccaatgcatgcagagtaattgtcacagtgcctcgcacacagcaagtgcttaataacagctgctgcaagcagcaccttcaccaccatctaatctcatttcccatgggaggaccaagcgtggggctcagaaagagtcttgatacttttcccttcctagctaattaagaacactggtcaagaaatttggatttctctcctgcttctctgccaagtcttgcttgcccttctcttagcctttgaattttaggtgaccttgagtagctaactgtaccctttactcattcttcctggctcatgggattaaataaacaaaatgcattttgaagaagtttttttgtttgtttgttttttgagacagggtcatgctctgtggcccaggctagagagcagtggcgcgatcatggttcaccacaacctcaacctcccaggctcaatagatcctcccacctcagcctcccaagtagctgggactacaggcatgcaccaccacacctggctaatttttgtattttctatagatacagggttttgttatgtttcccaggctggtcttgagctcctgagctcaagcaatccaccgaccttggcctcccaaagtgctgggattacaggtggaaaccactgtgccctgcccaaagaagttcttgattagatttcttccatgtcatatttgctaatagatcagtcagttactgctaccattgaatttttaacaatagacattaataattatatttaaaggcaatatagtgaccttgggggtaaggaaaccataaaggtatgttatggtgtttcagaaggagaaggttcagtttatcctccggcttgcaagcaagactttacataagcattccagaataataattcctcctctccccaaggggttctttaatgagtaaatccttaatctttctgaaccttgattgtctcttctgcaaagcaacatccttgttgggtttttgtgagctttctaaagctactgtgcaagaaagatccagcttggtgccctgtacatagtagccaagcctttaccataagtcagttcagttacttttctctaagaaatgataccatgattagaaaacaacagaggactttgggaggctgatgtgggaggattacttgaaaccaggagtttgagagcagcctgggcaacatagcaagacccatctctacaaaatatttttttaaaaatattagctggatatggtggcacgtgcctgtagtcttggctacttgggaggctgaggcaagaggatcgcctgagcccaggagttcgaggctgcagtgagccttgattgcatcattacactccagcctgggtaacagagtgcaaccctgtatctaaaattaaaaattaaagagaaagcaacagaggaggttttaggaggcgaagagcaaggtgtatggtcccagaaatagcatctgtttttgctctgtgctttggtgttttgatttgtgcaccctgaggaagagagacaagagtacaatttggctgctagtttcaagagacagtgatttagtagggaagataagacttttaggcaaagtgatgagtgacaggacaaactagcatgttctcagtgtcaaatgacgggtatatagaggcctccaatatctgctgaaaagaggaggttgaaagattaatcaagaaaatgaatataaataagggagcagtatagccaataagagctgccagacctcacaggaagaagcctttgctcaaggcaaaggtgcctggggcgaggcttcttggaagagttgtagcctgtgatgggcccggaaggaggggtgagagagccagattggagaggttaatgccccacaaagttatagaggcaggaatgcccacagggtgttttaggcaacagggtgtagatccaatttggctggtgcagaaaattcatatgaaggagtcagggagatgagtcagagaggttggtgccagtcaggctgacaacttcatgagtaccaggctgcagagcttgaactttatccagtaggcaatagggagccattgaaggtttttcagcaggaaagtgcatgtgaacatttccacttgagttcaaggttggatttgaaacatttttagaaacttgacaatagtttcctctggcaagccaggatttccttatttttattattttgaaaataaatactctcccttgaacatcaaacagcttttcaaaacacgatgttctaatgatctagagaaagtaattcaaaaacacagggtttaggtttcatttataaaacccataattttggtgattgggggaaacactctttggcaaggaaatagtttgagggatttgactggttcagaatttaaaagtccaaaagcaggcctggtctcataggagtagaaaaatagattttaataaacccaactcattaacgttcatcacttttaaatgcctctattttatacagcttactaggtttgcaaataagtatattgaaccagatgttgtgtgtgtgtgtgtgtgtgtgtgtgtgtgtgtgtgtgtgtgcgcgcgcgcatgtgtacgtgggcatgcgtgcatttgggtttgtgggtgggggtgggaaggttaatgtctcagtgatacaaatagtacctgattgtaaggattacctggggcagtaatatcaagctaaaaatacttagccaagtttctggctagcttaaataagttttactcctgggaaacaaaggagtcattattacagttttgcattcttgagtcctgaccttgtatttgtggctcccttcttccctgaaaacagaactgtacatcatgcttagatatgggatgtgtgtgtgtgtgtttcatattgggagtactagtaaaggaaagggacattgtgggaggggatcggattggggggggttggactgctgaatgtcaagtgcatgaaatgacttgctcaagcaccccctgaagtgtgctctgatatcaagccaagatttcagaaggctgaaagagttgccataacccaatctagttcacttaaatagaaaatagctgtcaaggtgggcaatttcacctccagctacatagagtagacaattacaggagtgttggcagaatcgagtgtctgctgggggagaaactatagtatttgtttctgttaaattggcttgtggtgggtacagactccatgaccgaatgtggaaattcctaaaatgttggttttccttcttttctgacttttacaaactaatgttactctcttaactcactacccatccaatctcattttctttcctgaaaaactacacagctcccctgtcacacagggttcgtaaaagtttcgtttttagaagtttaatctgggatttgtttccttaatgatctttggaagaatgctttggaatttgaggtcttataatgagacatggcttgtggctattaaaccctgttgcctctcaaattttgcctgggagaccctagattcctaaaaacaatgagtgcatgctacagaaagatgcttcagggagctacaacactaaatcatctgtgacaaaatgttctcttagaaagtggaattgcataaatggatcagcagaaataaatgctttggcagaaattccttgagtggggaagagcaatgctttcttttctaattagctctgggtaacagtctgctgtggtgtctttgctgtggaacccaggcatggacagtagagcaggaaagtctcatcactgctctctaagtgcttctgcacttaatggaaagagttaagcacgcctgtccatttgtacccaataaatgcctcttgaattgatttgagtgggaaaagcgaaggtttgtttgggggaaggatgccaccaggccctgaccaatgggaatcaatgcagcaaaccagatgaacaagatcatctagatatgcagtaatcagattacccagaacagaaatctcaataccccaagatatgaggggttattttaaggatagtggcaaacagttaaactcagcctgccctgaggattgagcagaagactgaattcaccttagtcattatgatgtgggctgagttagtaacactgaaggagaccatgcaggcttttactagagaactatgaaaacaggacagagatctcagatccaattagtactggatcaaaatagtattgtttttaaaaggccaaaggccattgaaagatttatagaggaaagagtaagtaatataaaatgtaaagatggaaataaagccttgaaagagttcctgaagacaagaagagagaaatttgcagaactgaccttgtaagaatttcataaaattcatttcattatgattgatttctttgtattagtacaccttcctggggaagtgagtatcttttttcctcataaaatctaaagcatgtttatttcaaatgggcagtgacaactaaatgatttaaaaataatatttatattcatgtcaaaaaagttatttttaacattataagtgaaatttacccaaacatagtaggccagataatgatatttagttattggcttcctggaagactgatgacaggaagattcagtattacacaaactaggtataaagaagcaatttaggtctacttattttatttctcctttgaacctctcacttgcctgacagtagcattgcattgattgagattttatgatcattttatcttgaattggttaaactaaaatttatatctttgtcttctttataaagaaagatattactagctgggcacagtggctcacacctgtaatcccagtgctttgggtggccaaggtgggaagatcacttgaggccaagagttcaagaccaacctgggtaaccgagtgagaccccatctctacattatatatatatatttttaatttaaaaagaaaaaatattaccaaacagattaattatgcaaacataattttgggacacagagttaacttgaggacaaaatagtttttaaagattttaactgtgtatatataaattaatatcctgaaccacaagtgcgtattagtgaatagcaaaagaatttttttcattctgacatttcagtaattcagattagcattcccaccaaattgttgccagttatctccatctgtccccttctccattcccccccaccactcaattttcatatctttaaaattaaattttcatataagtatatggaaccaaaatattattttcattcatttacctgccaccagagaggatgtcatcggccaacccgcaaaggtggtgggatctaccagccatataactcttctgcatttgttccctccattgtaagtgagggtgctgatacctgcttcagaggattcctggagaagtaaatgagatgatacatgtacagcacttagaacagtgctcagtatataaatggcagctttcagcagttttatttttattctacaattactattccttctcttcttccacctccatggctattttatggacacttaagtaggaacacatcttgtgttacagtaatgctatagcagtgatggcctggaaactgcttttgagttattgcagggaagaaaggatcaggaagagatacagcaggtgagcaccctgtgtttttacacctgtgagaagatacatcccacctcaaacaccatttgtggtcctatcaccctagcatgtcacagtgtaattgcctgctttcttggatagctctttgaatagatgtatgctctgtgagccctggctgtgtcttccatctccatatgccctgctgtgcctgcatatgtcttctggtgctatgcctggaagatcttgagtgggtaagggtgaaagggaatttagaatacatttcctttggtgctctagagcctttccaacatactgccagatttgtgttttaggtttcttctttttacccttggtgacacttctgggccataaagtagtgaactggctgtcctctagttgttgttgatgggctcttgagtgatgtggaggcaggataatgggttttcaatggtcacaaaactccctggccttctgctctccttagtgtgagtctctcaaatacataattcttaactctcctttctctgtaccagagggaaacgtggcagagaggggtccagataggaaagaatggactcttctgctgaagtgaaatggaaatacaaggaaattgtaaaaacaaaaatagattatttggaagaaatgtctaaaaacggtttttacacaaaggggacaactagaagttgatcgatttaagaattgagattaacctggtatgactttggtttccagctagattacagctgtggggttcttggcccttggcatgggtcacgcttgatacagtatgttgtgcactgtacatgtggatgtggcagggtaaggcttttaaaggtacagcagtcttgagggattacaaagtacatcagcatgaaactaggcaagattttagcctcttgtgagggatgttgaatttcagctaaagctccctcagcatatttttgtatcccatcaaatatctctgagtcgcggccaggcgcagtggctcatgcctgtaatcccagcattttgggaggctgaggagggtggatcacttgaggtcaggagctcgagaccagcctgaccaacatggtgaaaccccgtctctacaaaaaatacaaaattagccaggcgtggtagcaggtccctgtaatcccagatactcaggaggctgaggcaggagaatcgcttaaacccgggaggcggagattgcagtgagccaagatcgtgccattgcgctccagcctgggcaacaagagcaaaactccatctcaaacaaaacaaacaaaacaaaaaatatctctgagtctgtctccccttttataaaagagtgaacacaatgctcctaagtttaaatcagataaattcagtatgaaatcatagcaatagccattatgtgttaaaaccagcattgtcctaaacactgactgtaagtagttgtagcaaatcaactcatattagaaatgatattggtccctggaatttagtctgttcccaagaggactgaatgttgtgaatacattgccaaagtatgttttctttttttctccatcagcccttccattctgactacaggcagcttaaaaataaatttgggcatatctcagtggccaaaaaccatggagatcaggatgaaatcattttcaaggcagaaataacaggcgttgataaagatattcagagaaacacagtcctaatagcatcggcacgtgattgtggggccctttagtcaccaagctaaattgaatttggaatcaggggtctactgaaaagccaggaaacttttgagcaagtcacttgaattctgagcccccatttcctcatccagaacatgatggcctattttgcaggattgtcatgcaagttaaattacattaaacaagctatcagtaaaaaggatgtgggactgtgcctactcggattgtcacccagtgagttttaattcggagtccgaatctggtatttaaaggccacgttctaaaatgcacttgtagttaatatctttggagtcttgcttccaggtttttgagttgctggactgggtctttgtaagctccgtgatgctgctttgggaacacaagagatctaatctgtagtcctggctatgctattaattgcaagtataaccttaggtgttcagcttctctggcttttacttcttcatctgtaaaatgggaataatctacgtccttctaacttacaagtatgtcataatagaaaactgaccaaacagtttacatcaatgtccattattatttccattggcttttaggcggcaagagatggaaaacacatagcaacaatttcaaaggtaggccagttccaaagagcactgaacttggagtcagccaatctaggttctaaagccagtttgtcagcattagatgtctctggacaggacaggtcaccaaatctctcaaagcctaatttttcttgtctataaaatgtaggtgctgtttctagctctacgactctgtgttcaaagactactatgtgctggaagacgactaacattcacattttggtgaatgtctaaaaaaatttaaagcctcttgggggtaatggagctgctcccaagccaagtagtagatggattaagaatctgacattcttccactcataaaggatgacagagtttaaaaactaacgctgaaaagcaaaaaacatttgacaccttttggaataaaaaaatcaacaataatcaagctagttacttccttaaaaaatggtcttcatgccgaatggaaaccaccagattctctctggtgttcagcattccagaacaaccctgaaaataaattatctggctggaatcattgctccaacggttggatttcttagtggtcgtttactagccagacaaaataatttttttataaagaaaagaaaaaaaaaaggaaagcccacagaaggaaacaccccagggcccactgctggctcttttgatggcaacttttctaggaggacagtggccagagggggcctttggctgctcctctaggtggctggagtcaggtttgtaggacctgcctgtgatagtaggtttcatcttgcaactggctctgatggattagtaggtgcctgagaagtcattttgaaagggtctgaggctcggtctgggctcagtgaagagttctgtgattaattagtgatgtctgcccttggcttgggtggggcagtactggtgcctggtgtttgctgtcctgccagagcaggtttggaagatcctttagtagttgtccttctactgggcagcagatcaaggactcaggccggtgttgcttccgatgtcctggaaaagtgttttctgagcctccagcacataatgttttactctctgaaggaggcttattctgattagcttaacagagggtatggaagaaaggaagtctattgattcagctccttggtcacgagacaggaattgcaaggtggagggaagctgtaattccaacacgtaagtccatggatactccagtaaagcacaggcataggtgccactgatccagcagaggcagccacaaaccacaggccctggtaagctgcctgtggccagaggtcatggctgcagattccagggaaactgcgtcctcggtaggcagtcagccgtacactccatacttgcgattcttgatatttgaaatcaaaatcaaagtgcagccactttctttaaggaagctttggagaacttgccagtctgtttaggattgaaggtgattctcagttatccatgctaaaggaacagataatctgaagtttatttctcctcagctgtggaacgtgctttgcgtttttgtgctgttgatctgctttcctggtaaggtttgaactcttcagatttttctttctataaagaacggttgagggggagtgtagtgctttttgcagctcccccagtatgtttctaacatagccagccaaatgtctctgagcccttccagcctcctaactttaaatccatgaactgcaccagggaaataatcaaccagttgcaatttgttgagcacttactgtgtgctccctgggatccaggtaactgtgtgacaaggacttgatccaagagtgtgttgggcaatagggtgaagtgggctccaggttaaacattggctatagggatttacaaaagagttcactgagagtgggcctgacttcctctgctactgctgtttcctgttgtttccagtaactgcacttgagctctgcatacggttaactttcaattatcctgaggctgattaactggtttgcagattaaccaaggtgaaggctcacctgggcctgggagtcgctcatcaactcagctgctccataattagctggtgatggctgattgcctgccccatggttgggaagcctgggcactgggcgactgcaggggagggggaccaagggatgacttcttccaggaccttctactctctccaaccagaggtgccctctagccctgtaaacttctgcattctccagcacagttcctgagaggttcagaagttacctgggtcctggtgctctgctcctgctacctttcagctcctgcccccaacaccctgttcaaattgggaacaagttgaccacagggcacagtgaatttgaaagtccggagattaagtcatatgttgaaagagggcccagtgagcaggggccactaatcccctttcttcctcaacctaggaacctcctcccttcccaagatatagatatatatagattgagaccctgagcaatggatctcttttgaggccagtggagaccaagaccactgaagcaaggagtcagggactgcccacaacagcaaagctccccagagtccaggccaccccatggtgattgtttgggttccctgtgattgcctcccatggctgccctcgttcatagagagttgactgcatttgcctgggtccctgtggggtgagagtatggaagtatgtgtattagtcacaccttacaccagaccagaagatatacagtttaacctaggagtcaagctcctgctatatttggaatggtctcagttttgagacgtggtaccttggatcccaggtatatccaaagtcttgagagtgtccattgaggactttggtctgtagccaccaagaaagagtaaacatttgtgcaggatcatgtttgatgggattccatggattgttttcatttcttaagcagcattcccctgagcctttgacatgtctttccatctctggctgtgttctcacttgcatttgccaggcctgcaatgcctctgccttgatacaacacagtgtgccagcagctgcagtcccttttcagccagggccatgggtttccttgggtccttctctctggctcacgttttccagggctgttggtgtgtacagtctagagatcacattttattaacacaaagaaatctgcttgggctgcctggctcttgcagtcacgtggagagaaatgtgttcctttggtccttcagcctgcagcactctgtgcaaaatacagcagagagctgggcactgggccaagcttacatttcacttcggaacacactttcgcatcactccttggcagaacatccacggtggtgtctatttggggagtaagttagagaagtgttgtttgcctcttatgagtgtcgagagataggacctttagaaaatgttttacttttgcgcctgtcttcatcttcttcgcggtgcccaggtactgaggtgatccagctaaatgtggcagtgatgcctgagagaagccccttccttcctcgggccacccttttctcttgcaaaatcagtaaacagagccaggactgcctgggacagggaaacttaggccaaggtaataacatcaaaaccaaagtcctggaactcttgagtaagctagttaccctcccagataaaacaactttgttgtccaaatcttctttccaaagatctaagacctttctaatgttggtccaaggccagccatggaaggaaggaacttcagcaagccgcctggaatggcaaacactgttaaaataaacaaatggacctttgccatttggttttccctgacttgtctatttttatttcttttctccccccacccttgtactttacctctcgatagtacccccctttctccacccctactcccattctcatctcacttttctcaggggccaagctggctgttttgccttcagtaaaacaaatatctaatttcaaaaagaggaattaggagaaagaggtggtgtaattcatttcttggggtaatctcgcttctctcagctcctctattgtctgttcttgtaggtggccacctgaagcttgacttgcttttgaaaataaagttggttttggaattttaaaccttccttaggaaagacttgaatggttagaaaacaaagatttattggaataataatgacgtttcttttctcaatgaaatagacccctctcataacaaacggttgaaaataaactctttttccccatcacaccaagccataaattccataaggatttcccagcgccaagccttattcagagtcttatatttactgctttggaatgttacttttgccatcagtatcatccagccaagcaacaaccaatcaagacttacagaaacttttccagctagatgcatgtgccaggctgcttcttccttccatgatggaaggcctcccttgtcatagaggatgcccaaaatctcagggactgggatacagcctcctgccagtctgtgggtacagtctttgcttactctgcagaagggaggtgacagaaacccattccacctgtctcagaaacctgctggtaattaactttaaaaataatgccaagttctcacgtggctggtagatgcattagctcaatcaggggggaggcaggggagaagcatgctgcttcaaagagtaatactgttgcaatcacattagtcattccaggggaggttagataaggttattgaaaaggtgaagtcaccctgtacattgaaagaggtcttctgaaagtgttgagaaatagttgaagttcagaagttttatttggagctttgctcccccttccccttgtaaataagaccagtattttttaaaagccacattttctttgtttgatcgatgaacactctcatagttgatgattgagagtcatctacagccagtatcaagggtcagttctgcattactcatgtgtagattatctctttggtatactagccatggtcaatgtgtaagccctggccagttgccacccagcataacaacaccataaggcatctaccccctgcctgcacttgggaagtgttcagggaatgtaatttcattttataattaagtgaaacaatgcacagtgcatttccttggtggattctaacagcaggacagttattattcagaaaggactgtgtctggactactttgagaatcagtagtttaagttgttgcacctgtgtttggcctatcctcataccagtgtaaatacttcaatcctgcaagattttctcattttgcataaaacaggtgaaggtttgttgaagtccatcttccaaactcccaaagtactctggataccttggtaggtccttgtggactccctgttgttgacttgcaagtttcccagaggtggggactggcttttatctccagcacctaggcagctgctttgtaccagagttgatatacaggaaacatttgttgagtgaatgaagtaacaaagatactaatttcattagaaatggtttgaaatgagtgcttgtgttggcagaattttgtccaacatggttggtctttgcaaagggttatgatagtatgatgcacgcctttgggccagatgtgagtcaggatggtcttggaggaggcgaagtgcagatatacccctgctgataggctcctcataatacttcagtgagctgtttttctcgtgactgtttcactattttctttttttcttttttctttttcttttgagatggagtcttactctttcacccaggctggagtgcagtggcgcaatctcagctcatggtaacctctgcctcctgggcccaagtgattctcctgcctcagcctcccgagtagctgggattacaggcatgcaccaccatgcccagctaatttttgtatttttagtagagagggagtttcaccatggtggccagggtggtctctaactcctgacctcaagtgatccgccctccttggcttcccaaagtgctgggattgcaggtgtgagccaccacgcccggccagtttcactgttttctgattggtaaacattcaaggctggatgccatggctcacgcctataatcccggcactttgggaggccaaggcaggtggatcacttgagctcaggagtttgagaccagcctgggcaatgtaatgaaaccccatctctaccaaaaacagaaaaaaattagccaggtgtggtgtggtgtcccaactactagggaggctgaagtgggaggatcgcttgagcccaggaggcagaggttgcagtgagctgagattgcgccactgtactccagcctgggcaacagaaccacaccctgtctcaaaaaaaaaaaaagttaaattaaaaaaaatattcaagaatgaagagtgttttcagagaagaggatttagatgcttacaaataaaagtggatattgaccccccaattttccaccctttaatcacagagacatgattggaagtcagcagctccagcctgcatgttcccagatcacctgtaagagttcttaaaactcatcccacaggttcttaattgggatttttaactgggtaagtagagaagctccatgttgggtgtggggaagggaggatgcagatggatataaatttttttaaaaaaacatcaacttatgtttctttggttaatagatgcaggagaatgcctcttctctccatgtggcatgtcagggtatagcttctttgagcacaggatttggtttacagaatggcatgtctccccatgccagccagtgataaggggcactaaaacagacttggccttgctaaaggcttccaagcaccaggccatgagcagttgaccccaccacagaggtatgtacagctggcaggaagctgcccttctggttcactgactcaagagttggagcagattgatccctggatttgcagtgccctcaatatcgctgcacagaattcattctatgtaccccaggccctatgtgcccacagcaggaaatatagtgtgagcctctggcaatatccagagttgcttgagcctcctcacatttgcttctcctattcagtttagtgtgcctcagtttactaatatgctggggaaaataacacccctcttgccaaggtgagatagcagagttctctgcataaaatagtgcataaaattattcctatgacaaggcatttgaaaaattactttgagaatgacttaaaatacagaacaatttttttaaatgtggcaaacatccttattcttatcacccagaattaacaattcagtacagttgccatatattcatatataaatttacctatatattcatatgtgaatctagacattgcagattcacttgggggtctcagggaactttttataaaaagaaatgcatttagttcgtaaggcctgattgagataattccaagtctgttttctcagctcttaatccttcctagcactttgcattcattgtattaataaataagcctgttttcagcctagttagaaaaaaaaaggccagcctcattcattagaattctgcgttccctttggttattctttgttggagagaagggggctcactggtacagaattccaagatatttcgctttggaatgtgaaaggagtctctcttgacaacccaaggagaacctgcctcagaatgatctttcttcctcagtgctgaaaaagaaaaccagacaaataagcacaaccaacattaacagaaggccttggtacagcctcaagaattaaagtgctgtactctatggaaaacagtgtggaggttcctcagaaaactagaaatagatctaccatatgacccagcagtgccactgctgggtgtacagctgtacttcgttttatcggacttcaccatattacactttgccgatagtgtgtttattaaaaattgaaggtttgtggtaaccctgcattgcacaagccttttggcactatttttccaacagtatgtgttcacttggtgtctctgtcatattgtggtggttctagcaatatttcaagtttttcattattattatatgtgctatgttgatctatgatcagtgatctttgatgttactattgttattgtttgggggcaccatgagccacacccatataagatggtgaacttcataaatgttacgtatgttcttctgactgcttcaccaactggccgttctcccatttctctccctctccttgggattcctgttccctgagacacaacaatattgaaagtaggccaattaataaccctataatggcctctaagcactcaagtgaacagaagagtcgcaggtctctcactttaagtcaaaagctagaaatgagtaagcttaattttgaaggtaggtcgaaagccaagacaggccaaaagctaggcttcttgagccaaacagttagctgcattgtgaatgcaaaggaaaagttcttgaaggaaattcaaagcactactccagtgaacacacaaatgattagaaagtgaaacagccgtattgctgatatgaagaaagtttgagtgtcctggatagaagattaaaccatccacaacattcccttaagccaaagcctaatccagagccagggcctaactctcttcaattctgtgaaggctgagagaggtaaggaagctacagaagaaaggtttgagctagcagaggttggttcatgaggtttaaggaaagaagccatctctataacaaaaaggtgcaaggtgaagcaccaagaaatgatgtagacactgcagcaaattttccaaaagatctagctaagatcattgatgaaggtggctatactaaacaacagagtttcaatatagactacacagccttatattggaagaagacaccatgtaaaagttatagctggagataaatccatgcctggcatcgaaggacaggctgacttttgttagtgggcaatgtagtgggtgactttaagttgaagccagtgctcattcactgttccaaaaatcctagggtctttgagaattatactaaatctactcttcctgtgctctgtaaatggaacagcaaagcctggataacagcacatctgtttacagcatggtttgctgaatattttgagcccactgttaagacctactgctcaggaaaaaaaatcctttcaaaatattactgcttattggcagtgtacctgttatccaaaaactctgatggagatgtacaagaagattaatgttattttcatgcctgctaacacatttattcttcagcctatggatcaaggaataattttgactgtcaaatctcattacttaagaaatttactttttaagacaatagctgccattgatagtgattcctttgatagatctaggcaaagtaaatcaaaagccttctgaaaggattcaccactctagaagccgttaaaaacattcatgattcatgggaagggacattaattaactccaacataaactgaagttagtaggagttgattgcaacccttatagtggatgactttgaggacttcaaggtttcagtggaggaaataactttagatgtggcggaaatagcaagagatctagaattagaagtagaacttgaagatgtgactgaattgctgcaatctcatgataaaacttgaatggatgaggaattgtttcttgcagatgaacaaaggaagtgctttcctgagatggaatctactcctagtgatgatgctgtgaacattgttgaaatgccagcaaaggatttagaatattacataaacttagttggtatagcagtggcagggtttgagaggatcgactccaattttgaaagaggttctactgtgagtaaaatgctatcaaataacaccgcgtgctacagaaaaatgtttcctgaaaggaagagtcaattgatgcagcaaacttcattgtcgtgttattttaagaaactgccacaaccaccccaaccttcagcaaacaccaccctgatcgattagtagccaccaacattaaggcaagacccatcataagtaaaaatggcccactaaaggctcaggtgatctttaccattgtttagcaatatagtattcttaaggcatgtacattgtttttagtcataatggtattacacacttaatagattacagtatagcataaacataaattttatatgcactgggaaaccaaaaaaaaaatgatgtgacttgctttattggattcttagctttattgcagtggtctagaaccggtcctgcaatatctgtgaggtatgcctttatatccaaaggaatagaaatcagtctttcaaagagataccggcattccatgtttattgcagcactattcacagtagccaaggaatggaatcaacctaagtgtccatcagtgggtgaatggacaaagaaaatatggcatacatacacaatggaatactattccaccataaaaaagaatgaaattctatcacttgcagcaacatagatggaattggaggtcatttatgttaagtgaaataagccattcacaggaagacaaatattgtatgttcttattcaaattgggagctaaaaaggttgatctcatggaggtagacagtagaatgatggttaccagaggctgggaaggttagcgggggctgggatgtgggatttagagaggttagttaagaggtacaaaaacacagacgaaataagttcaagtgttcaatagctacagtagggtgactatagttaacaaggatttattgtatatttcagaatacatagaagatttgaaatggtcccttcacaaagaaatgatcaatgatcccagttactctgatttgatcattacacattatatgcatgtatcaaaatatcccatgtactatattaatatatacatttttttaattaagatttgaggtgctatatgtgcctgaggagttataggggatgccggtggaacgaccattacatgtggcagctggactgggcaacggccgatcgccactgtgctctgaggagagaaggcagagcttccccctttatctgctggctggtgaagtcctgagaaccgggcagtcagctaagcaccaagttttctctgactacagagctcctatcaaacggatgggtagaaaaggaatgttgtcataatagctaacccttctttagtgcttcttatagtctgggcactggactgaggtttatatgtgttatatcattaaaactcaatctctgggaatgactgttagtacttggtaggtatactattattattgtcgttttacagatgagaaaactgaggcccagagaaagtgagcaaaatggtgctgggggcgattaataggtggcagggctggaacatgaagccacagtctggcaccaaagcccattcatggagccccaactcaatgggctgcttctcagtagaaggctttgccttgtggaaggtagtagaatgtctaaaatcatcagaacacctgtgtggatggtacaacacggtgacagatatgtaccagggacctagatgtggagggagtgaggaggaaaggagcaacatatgcacctctggggaggccctaaggtctcctcagccaattcctagggaatttaattttaaaggacacagagagggtagtttttaacacaggttttacttttaagtcatgagggatgactttctaagccacagttccttctgatacggtcttaaaagagaagcaccatgaagtgataaacacatcagtccaggaagatttagagacagcctagtagaggaggattggaaacagtgtggctgtgtccctgagggtgctggtgctaaacccacggcacagtccatatcagtcaaagcttcattctccttgtgcccacactatgctgatctgccccagtgcaacagggagacgcatatggtcaagagaatgtgtctttcacgaatagattttctccttcgaccatggtgagaagtccttgtaaagaagcatacatgaatatatggatgtgttgggcatcagctgtgcgtgtggccctcagccaggtgagtggaggaagttggaggcattcagtgttcacctccatgtgcttttcagagacatacctggtgagctgtctgcagatacacagcgtagtgggagagatacgcacgtgaaagcagcacagggcatgtagctagcacttggtaaatattagtttccttcccctttctgtgtgtaaggcaagttgtacgagcaaagcatccgcagctcagaatgcaaaaatagatctccatgtggggatgtggcctcttttccccaagtgtggaccagatgtcaggccgccttgtgagtactcaaggaatgttacggcttccttcttcaggacttcactgcttctctccatatggagaaggctccctttccatgcacttcctggatctgaaaaacaagaacaagaaagaggatggctctaaagtctcaggaaatggacctttctatatcctcccttttaaaaagcatttgtatgtaggttttttaggtcttgctgtcaagtcggatacacagctgtcatctgttatatcggtgatttaataacataataaaaatttatagagaaccacaagctcatggatgtttgttttggagtgcatttattcatcattagtatgggtatttttaatcatttactgagggcctagcaaggtgctggtaattcagagataaggaagatgtcatcctttaaacttgagaagcttatgaatggcgaagagatataattaattgtgaatggagtgtggtagatagcatcaggttgtatatgaggtagaatcaggaaagcaagaatggccagctctgaatagagtgaggagggaagatcggagatgatccttgagttgtgtcttgaagaatgagcaaaaattatattcatggaaagaaaggatacaatataagtgacttgttgagtttttcttggctgatactaagaatgaattttcattaaatatgcaccagtaattcacaggaaatgatcaggtcagaatgttatgggacattggtctgaaatataatgagaggggaaaaaaacagaaaatttaaaacgtttatttatgatggctaatattcagaggggctaactccctcctgcccagataaggagaactttgccgcctggcaagggacctgcggctctgcactgccagggcaacagaaccacacgtctcaaacgtggtgtttaaagaagatgttggaaggttagaggcggtgtaatggatgggatttgacagttgctgtggcaacacacccacttccagaacattagtgttagtgggagggcaggcaaactcgtggtacttgccctgggctgccctatgtcccgtaccacctgttctatgccaaaggtatgaacaaattcaaaaggacaaatgcctcacatggctgatggctgcctgcctttgtagaactgaccctggaataagataagaagatgagtaaatcagagaaaagacaacagggaaatagcgtggaggaggagggggaggccagagcaagcagtgttaactcctttcaggtcaacatttcccagggttatattagaatgtattgactaactggtagatttttatggggaaaaaatgcatatggcatctgtgtgtctaaaatgcccttgatagaagcagtagtgtagaatgctttggggcataaatagtccttagagtagcaaaaagacaggttaatgcaaaattggttggacaggttttggttggaggcctgagtgattgcctccggagcaccaccttctggggagtcatgggtatgacatggtgtgaatattcctgaggtgtgggtggttggtttccttacaaggtagggtttgcaagctccttacatccacaggggctgtttcctctggaccagtcgttctcaatcttggcctcacatgagaattaccagtgatttttttaaaagaaatttaaacattttattacaaaattaatatacgattgttgtaaaataggactgtataaagagtaacttgagttcccatattccatttccagatttaactgtccacagtttctgcgtactcttccagacgttccctttgtgtttataagcatttatatacatatatatgggggtgggtgtgtatatattgtgtgtatggaaatatggaaatatatgtatatgcatacaatacatagtgttatgcatcttgcctttttcattcaatattttttggagatttttccatattaatacatatagatctgccggctgcatagaacctatgatctggatatgctataatttacttaacaatgcctctagggatttagattgttttcatcgttggattccattctttgtacacttgtgtggtatatctaaagttttcattcctagatgtggaattgctggatcaaagtgtgtaggctccaaaagaattgaactagttcacactcccactaaaagtgtgtgagaaagctgtttcctcttccattcaaaaaaatttttttttttttttacagagcccaggccccattttcagatcttctgggtgaggttggaggggagctaagtatctgtacttttacagagctccacaggtgaggctgatctgtaaccagggttgagaacttacatatgttcttatctatggccttagatagagggtgtaaaattaggagacgcagctcccactgatgatgcctgggtcatgtcctttcagatccaaattgcaagatctcctttaatgtggttaattgggagaaattgaatgacccatttcttctgaaatttctgttaaactggaggtctttatttagacaaatgtaaacattaatccatctttattaagataatgtatgattaaagcaacaaggtaccatctaggttctgtttgatacttttcttgttattccgtagttatttgttcataaaccattttttcttcttataggctttcaaggaagaattatctaattccttttggtgtggcctcagatttcattagcagtaggtagagtttgtagttattgaaagtctttctcttatttcagtttgaaatgttcccaggttggcacatagctttgggaactggaagtgtctcttttcccttgcttaggtagcctcaatagattgaaagaaaatggacatctcttcttcagaaaacctgttctaagaattatccatcttaggaaattagggtggttattgctcttctttactgcctgcctgaaaaaaatttcccagccctcatttctttcatcctttcctttgaggccatgacttgtcaccctctgctgtgttcctctgtcccctgagcagctgtaaggggtgagagtcacctaccctcaccccttacactcccaccaacctgaggaccacgtgtcttcatctaacagcatttctttttttttttttttttttttttttgagatggagtctcgctctgtcacccaaccaagctggagtgcaatggcgcgacctcagctcactgcaacctctgcctcccgggttcaagcagttctcctgtctcaacctcccaagtagttaagattacaggtgcccaccaccatgcccagctaatctttgtatttttagtagagacggagtttcgccatgttggttgggctggtctcgaactcctgacctcaggttatgtgcctgcctcggcctcccagagtgctgggattacaggtatgagccaccgcgcccagccagcatttctttcttttcctgtttgaagaaactgagtcctgtctactcccacccagcatttgcctggcatatcttcacagttggtctccttatcaaccaactgactcccatgattaggtcagattagatcccctgttcaggggatttatgtggggaactacacactgattgggacaggattttgtcaatgtactcaaatgacaaaggacttcagagatgttggaatattcttggtctacccaaaggttgcagaccacggtggcatttccttcttatataggtcctggtgggcatgggcttgagaagctgaaagaagacgcatggaactcagaatctgatcttttgatgatgacttcatatatatggtctgtttacccacgaggcacacaaaccttaccttatgcctgtgaaatataaaggcagatttttgtcccatgaaggtttctccatagactacattaagcaggagacagatgggtttagcttggctaatcttagtgcaagctggaaaatttcagtttttctgaaacaacatatttctaagaaattgtctggtctagaatgttattctagtgtatgttagggatctgtatgactgtaaagcaaggctgaattactgcaggcctataaatatgtgtgaaaatttacctacttctccctaccaacatggaggtggaaagaagtaggtttaataaaccccatttttattacgtgtgtaaatcagtggctgtttggccatttttctcctatgtaggacttgaatttatatgagaaaacttgagtgtatgccttttcccaagtcttggcttgcatctgaatgtaaaaatcagatgcatgctcaatgaatgttaattcagattatagatagctataaactatataggctgctctgtggtctttcctttccctctgcctgcatgactgaagaccaaactgtcacttccttataatctagttcttcccatgatacctcatcacaaaggtatatatcagttggtcaataacaggacttgtgcagtgaatacttacatgaagcagacactgaagtgcccagcaagaactgcaaaggctggcagtattaggagattgctcaccgtaccccaaatgagatgccagaggcataaagtccattttgtttaggtaccagatgactctgtggaattaacttgatttgtccccagtaatccatattctttagcatacacttccaggcaacacttattgcttagcaacacttacttagtaacctttcagaatgatcattaactaatagggagacagcctgtggtgccgatcgtaggctgttgaggctatctctacgggcattttcacctatcctgcctacttccgtaacctatgccccacaaaacatacactctccagacatgaaatttaaaaataatgaaagatgatgcaggaacttcagacactagatgcaatagacagcaaaaggaagcacctatgttagccttggttctcaacataccaagatgctcttatgaacacttctaacaaaatgttcccaaggagaacacaaagcaggcacctaacatccaagaagcatgtcatcacctcagcatgcctgccacacgtctagcgcactgcagccttcaactcctggtctcaagcgatcttcccaccttagcctcccaagtagctaggactacaagcacgtgccaccatgcctcgctaattttttgaaaaatattttttagagatgagttcttgctacgttgcccaggctggttttgaactcccagtcatattgttcctcatttgctttttttccttcttctttgttaagagacagggtcttgtcctgttgcctaggctggagtgcagtgccaccatctagctgactgcagccttgaactcctgggctcaagcgatcctcccacctcagtctcccaagtagctaggactacggacacatgccaccaccaggcccagctaatttttgaaaaatatgttttagagataagatcttgctacattgcccagactggtcttgaagtccaagcctcaggttatcctccctcctcagcctcccaaagtgctggaactacaggtgtgagtgcttggccttcctcatttgtttaacagatatagtaatgcagccacttgattaggaggcacagtgaccgctcttgagggatcaacagtgtaaccagggaaacatctctttggtcagtcccgtttcactagcctgttcaagaactggtttacctcctacctttctggcttttcctaagtaccttttacagagtcctcctcttcagctgtgcctaaactgtcagtgttccccaggactttttctttggttttcttgttctgtgtgctctcctggggagataatcagattataacatctgcatctccagtttacattgcccttctatagcctacattggtatatgaagctgagatccacatgctctaggcttcttcatctgggcatctgaaactcaatggatccacaatgagacattttattttcccttaaatgtgctcactccacaatattccctatttcagtgaatgtcaacacctcctttgcaggtgtccaggccagaaacctaaaagtgaatcttgctctctcctcctctttccccatgttcagttggcaacaattcatgttgcccccatctcattaataactcttgaatccacctagtcctctgctgttgatgtaggtgagctcttaccattcctggttcccctgtaagccaagctctgcctggttgccacaacaatctttctgaaacgagtcatctgatcaagtgagtcctttgctctaattgcatcgatagttccccgttctcttgaggatagaacctgaacatctaagacccttctgtgtctgtctcaatgcttaccactcttcttacccgccgtgagctccagttacaccagctactctcagttccccgactggcccatgaattctctcatatcttcatgccttcacatattttgttccctctgccttggttaccctttatcccatttacttttctggccaatttcaagacttggccaggatggcaactccctctgagggacatttcctgttgtccctgcactccctccaaagatagggatttgtgatcaacctttcaactccaacctgtgactccctgggcaaagcccttttatagcacatattattctgcaatctaataacctttttacttacctgtctgcacctccagactgcatgcttttaaagtttgggttttatttatatattctcagagcctggctcatagtaggggctcaataaaagtgtttaagcaaatgaatgtcttaatcaacaaagacatagtttatcattttctgtgtaaggcagtggcatggcctttgcctggaaagatttgcaatctcgttgattaaaaattatagagttacttaatctgataaaaaaattatcagtatagacattgtgagagaagttaggaggaattgtcgccaacattggtatagtcaggagtcggagggcttgaattagaccttgatatggatgttaggacaaatagaagtggcgaagacgcaaagcaagattgtctagaaacaaagcagaccattggcttaagcagagagcatgagataggaacaatatgcctccctgtggaggtctctccccagtagacaaagatttcagaccaggaggcaatgggaagccattggcttcctttgatcatggtggcgatactctaggaagagtaatctggtggctgtgttggcagatgggattgcaggtggcagagaccagttaggaagatcttgcagttgtccaagttcctcatgactgcacctgtcttgtgacagggatctgaaacacaaaggaaagcctccactgcactccaagaataatttattgctagatctggaaggagcctttgctatcatcccaaacatctcatcctattatttaacagtggtgggcaaactgaggactaatctcaaggttcccataactgatggggtctttggattccaatccttgtctcattttcccaacctgcctgggaagtgggtggttaaagtttaaagcctggaagaatgggggaaatagttcacaggcatgaggtgacctgcaggagaggctgatggtctataggagattggaggatgagtttggcttaaacatgttgatttagaaatgacagagggattggaggcaatgaccagcagtccacagatcagtttaggactctgtgaacgttagtggaagagattacagagaacactggctaggagccaaggcaagaaggctttggaaaggcatgtttgcctttgagtgcttaacttagagactcatgcgggaaagaatctgtggatctctttgagaagctgcagaacagcagatacacctgaatcctattcatgttcatccagaaacgcagactttaaaacaaccttgttattcttcctttgttttgtttcgtttggttttagggggttggaggggagggaagggtgtcaccgggggagcatatgggtcatttgtttgcagttcacaggggttcttagtgaacatcagcgaatattgtcgctgatttcgtctcctgcttcactctcttttctaaaaacaaaatatttaatgtagcccaaaggagaatagtcagtttaataactagccatggcagctctttgaaaactgcaggtttcaaataactaggcctgcacattttcaccaactcagacaattaaaaagactccagggacctaggtggtgctgattcaagtggcgcatattgtcatttaaaatggaaagtctatttctgaaaatagactccaggtatgggagaacttgtttctctgctggagaaggtagcccatcctagggggaccgaggtaaattgcttagtggctcaacatctacatagttaaaatgggcccatttggccctacctacttcgcagagttgttaggagggcagaatgaggctatagataggcagcatgtcattggactaggtccgccagatgcagaatgttgacaaaagcagaagtcccctcccctcagactcctctggggaaagctggcagccttgaccaccatcaccgctctgcacaccatagcagggatatgagaaggggctgaggtgagcattggactggaggctcctccagctgtctcttgttgcctgtcctctagtgtgtagagttgcagtgtggcttgaaatggtcatcacacccaccatcaccatggcagccctgggaggagggactggctgctactctctcaagaagggataactgttgcacaaaacactgcagactttgagctggccagcagttgaccagctgacctaacctcccgttttccaggtcttaacctaccatccattccctgcaagtacagaggaaactagaaagctacccttctcccaccatagttctgtaactttgggatggagtgagaagcatggcattgttaccaggtgatagggctcattgtccagtgcactagaagccagtattatggcactgggtctttaagaaaagaaaagcttttatttcatgtcagccaacaaggagacaggatccagctcaaatctgtctccctgtgcttgctggctttcaggcagcatttgtattagaaaaggtttaaggggtggattttgggattagcaggtgattggtggcaggaagggtgaggtctggaaagtccttgggcatgcacggttatctctctctgcatcctcatggatggtttgtgcaaattcagcgaggggggtgaatgtgaaacgtgtggcggaagttctggctgtgacgtcagtaagctcgttctgcacagactccagttggccatattggtcccaaacaattttagccagccttatctttccagtagagggagttttagtgtttccacaagcttttatttaattttttttttcttatctgccatcctgtaagctcaagaatttctgttagtcactggtttaagtctttggggcatggtttcaatatgagtgtgggaaaggggaagccattgcctcttgtttcccattcgtgaccatccctacccacttcagtgggcccagtgttgccagacctgaaatatacctcatgtgggtgtttgtctctggtactctgggttcatttctggtcaccctatgatatttccttgccctaaggtactggcacagctatcgggtaggaggaggccaaggtagaaggcacagagccattcttgcctcaccttctgccacacggtgaccccacatgtctggggagaggctcccggcccagggaggaggaggtggaaggtgcactgtcataaccatcacagggggcaatggcgagaaggctcatgggccacgtgcctcggccattagttgtcatgtctgttgtaccccaacttaactgacttctaacaggctgtggttatgagttccgctggtctcacctttcagtgggttcaagggggcagattttgctgacaccataggcaaggaagcatgatggtaaacaccactggaatgagaggccttgttaatccagcccaagctcctgccaagttagaagctgaggagtctagtctgggccactttgagtactgatgcatgatcccagggcgatgtgctgttctgggcacagggtcacactgggtgacatctaacaggctttgcttgggctgtagctagagggaaatgggagctggggagtgtgacaggagggaagtgtggactctccacctaccaaggggccttcccacatactgtccatcccattcagcgccctgaggtgggcgtcatttctcccacttgacagataagggaatcagaccatgaggcagagtaactggccccaggccacacacaactacgtagtgtcagagtcatgatgaatcctgtttgtctacaccttctgatgaactgagctacctcgtgcaggacaggcccaaggaaaggggctcaggccagagtgggagcattgaaacagggttcaaaatgtctgtctgcccaaaccaaacgttaatttgcatactaatagtttaagggcatagatataatacagacctcccccaagaagtgacctttgaagccaacttcttcttcatgtgacggaatacatcagacaccctgtctgccgggaatccttacccttctcctagtgagccgtggtctctggcctatccagaagctccttaaaaatactagtgcatgagatgtagcattgacaggagccctggcctgtgggtcaacagttgctttgtcaaatgcaatcttgcccttggcacagctcgccattcaggaggatggaggaagtggacgagagagagggaggtaaaagaagggagggaaaggaagcaggatgcctggctgcctggagcttccttgggctcttgtccatgagaggaagccatacctacctctctggggtttgccaactcttgtccaggaacctactgggctagagtggaggggaactgcagagtctccccttcctttctcttctgcccccatgaggaggaagtgaagtggagcagaaagagcgtgggctatggttgagcccactggagtctgcactccacccagcctccccctggctttctagctgtatgactttaagcaggtggtttcaccccctctccctctccactttttcctctttaaaatgtgggatacagtgcccgcctcgcagaggctgatggttctgtggagtgttgtgcacaaggctccagcccaggtcctgatgcaggactctcattctggaaggctgggtgcctggctctccttggggcacaattaggcttcctggctgcattcctggggcattcgcatgaaaaagaacatgggctttagagtgagaaggatggggagatgagtctctgtttttccatctgcgtgggcaaattatttagcatatctgagcttgtcttaagctttctgttttctattcctttatttccacatatggaaaatgggtatatgaactattctgccttcatatagctattgtgacaattaaatgaagtaatctctgaagaaccttactatcagtattactgatattaccagagaggtggctcatgtttgtaatcccagcattttgggaggccaaggtgggagcattgtttgagcccaggagttcaaggtttcagtgaactatgatcacgccactacactgcagcctggagacagagcaagatcctgtttaaaaaaaaaattgctgatattgattattcagtaggccagggaagcccgtctaccagcctacaggacgtcattgcattcaccttctcagtaaatggcaacagactcttttcctaatgtttacacgtaatggattgaactggcttagcatcatgctttacccatatttctgttgacagcctgttactgtgtggagagaattgctggataagagccactgagatcaaagggatctttacaatgggcctttcagtatatttgttctgtaatcatggactgaaaacttactgagcacttgccatctgaatgaggcaaaaaggaagtgtgtgtgtgtgtgtgtgtgtgtgtgtgtgtgtgtgtatgcatgtgtatgtgtatgcatgatttgtttttgccttaaaattagtacatcaaccgtgtaatgtgcaggacatttaaaatatgtcagagctatgacaggttcccagctactgggatccaggacaccttccaatttcatctttggctaagactttctatctcttttttcttcttctttctttctccccctcccttttgatgcctttctttccttccataatacctttctttattctttctttatttcttctttgattcattcttgtatttcttcttggtttcttaattcctctttctttctcttcctttcctccctgctgcccaatacacttctgacctcagggcatagatgcattgaagggcatctgctgctgtggccttttggatgggaaccctgtagatctcagctaggttggtttatcagctataatgtattccttgatttggtaaaacagccagcagcagagcaacatgcttttacctcctctttttttttttcctcatcccatttcctccctctctttggtttcttcttcctttcaagggggttgaatggtctcctctcagcggccttttttttttttttttttttttttgagacggagtctggttctgtcacccaggctggagtgcagtggcgcaatcttggctcactgtagcctccacctcacaggttcaggtgattctcctgcctcagcctcccaagtagctggaattacaagcgtgcgccaccatgcccagctaattatttattattattattattattttttaatagagacagggattcaccgtgttacccagggtggtctcgaactcctggcctcaagtgatctgcctgccttggcctcccaaagtgctggcattacaagcatgagccaccatgcccagccttctctcagtagcatttaacacagactcctggaacatacatgcacaaagtgaaaaaaataacatttttaatttctgattttgaaagtgaagatcctcattatagacaatttgcaaaatattgaaaataagaattaaaatttgcccctgttcctcccaaaagtccctgttaggatctggggggtgttatgtccagctgctcagtagctcgtgctgtcccctccatgcaggttccatctagaatctggggcagcagcaggtaaggccaggtcactgttctgtggggcttacatgggagtggagggaagagatcagcaatatcaaacaaataaaaaagatcgtttgggatggagataaatattgtaaaaaaaaaaaaaaaaacatcaaacagagttgtttgatgggtattgagcaggggtagaggaaagtcagagggttcgaggaattggcatttatgctaatgtctacataacgtaggaggactaggtaggcagagagcagaggaagaatgctttaggtagagaggaaactaaatacaaaggcctgggtgggatcacattcaggggacgcaaggagcagaaggaaggccagtgtggccaagtgtgtgagtgaggtagagccgtggatctgatcatatgtggcaatgggaagccttgggagggtttgatatggggatgtgacccacacgggtctgcatgtttagaattatcacagtgtaccgctgtggagacgtgggagatagaaaagggataatggttaaaagttgcagtagttcagaggacagacagtgctggcttagacaaggggaatagtctgtttatttgatttactttcaagtatctctgaactattatctgtattttgtatatgtgtttatatagagaccatttattgcacactttccgggtactacagattgtgctaagcactttgtatgtattatctagttcatttttcacatagaatcaggcatagtaatctccttttacacataagggaattgaaactcaggtaggttaagaaaagaagggggaaaaagtcaacgatagtccctttccccaatacagaccttattaggatttagaggggcattttttgggggtcatttatttacaaaggcccaagtttataacatacaggtgacagaatcagcattcagacccaggtctgactcacttcacagcgtaaaacgactgtcctgtacaaatttaaatcctgctataatgttattgtgggtgtaaacactctccccctatgcaataactcagcttataggtcagtctccattgcaatgagaatgtttaccagacaatcacagaaactcaccgtacacaaataaaggcttattgttcactcatctgtaattgctatgggttgctcaggtggctctgctgatcttggccggactcacatatctagagttcaggtgatttaagctgacctaggctggcctcttctttcattttccagcaggctagactgggcatgtttatggtaatgacagaagtgctacagaaaaggggcagaaacatgcaaagcctctttaggcccagcctcagaactaacactatcatttctgccacattctgttggccagtgcaagtcagagaccagcccagatgcaagaggtagggaaataggctctgcctggaagtgcaggtcccatggaataggacatgaatgggttaggaatgagcctttggccatcaggacgttagtgttaagcttttgcagaaaggacttgttggacaaataacagattcctgctgcgggaatggagaccagctaatatggcctgagtcccgaaagcccatatccttaggctgtatttgtgaggttttaatttaatctttgtatatatcgtgagcactcttcgttgaccttatagtgttgctatcatctcctaagttgattggctccctgaatgtaaaaggattttcagaggcaggcatggtttgtagcaaagtcagctgtaatccctgatgatggtatcatcatcaagggatgccaagagggtaaaagcactatttcagattatggctacgtgggatccaggaagtcatgacaagtgaacagaccctaaactggtgatgaggaggagggcagaggtgagcaggagggaaagattcggcaccaaactttgaatcactaggagtttcactcatcagctctaaaggaaaccctttggccaaaataaaaattgtcttctctttcctcagccttaattgatagaggataatgttatcagctggctaatgctcatcagtgatcaacattagactactgtgttttgacgttactgctgcaaatctcctgctttattaactgcctgaatgaggagcacatcagaaagattggaggtgttgcaattagcctttaggatgaaataataagtaacactataatttgtgactttgatgcagacatcaatttaaaacataaaccactgactagagaagagataaagacagagtgctgctgttccccttcattgatggctgcttgctaatgagctaattgaacacaagctgctaaattcttgctaaaatacgaaagaatatgaaatatcctgtttccagttatactatttggaggtttagccttgcctaatctgtgacaaaagtagaggccaactttgggtttgaaggtaacttctattctttttccagatttctttaagccctttgttccaccctttcctccagaaaccctccttggttcttctggaagtgactttcagcaagaagcttttagaaagaaaaacaaaaaaaacgaaaaacaatgttccagtaactgcagaggctacatgatggggttgatcttgtccactatggatcttttaaataaagctttggaaataccaagctcagacttaacaaatacaggagaaaaaatggcatgattatctcaataaataaatatcaaaaggcatttaagagaacttaatacattatttctggttttaaaaattattagtaaaacaaggttggaagaattggaactgccttactttgtcaagttgtatctactaagatactagaacaagcctttatattgaaggatctgaagaattaaaagcatattcctttaaagtctgggacaagcagtgatcattagtctcagtctctctttcttctcattgtcttgcagaaaccggctaatgcagtgagactgaaaattattaaaaagaaagtaggaattataaacatagaaaggatgccacctctgtctatagaggcagaagatgagattgttcacctaaaaactaagagatgttagaactgttagaactattagaactaataagaaagtaaagtggctggatataaaccagtaacttttaaaaccagtagcttcctatatagcagcagtaaccgcttaggaaatataatagggtaatataccctagtaacaactcttataatacatttaaggaataaactgaaatgtgaaaggctaaaataaagaaaactataaaactaaactgatacatgtttttaaaaaagcccacaaaaaataaaaatggagagcatactgtgggtgtattcaatattttaaagatagttgtcctcaaatttacctgtgaaattgtaattcaaaaatgccaaatattattatatttaaaacggtaactttaaatataacttaactaatgtattctgaagtttacctagaagagtatatgtataaaagtaccttagaaaattttctaaaaagaacaaataaccaataaacatgcaagatgttcagtgtcaccagtaacaagggaaatggaaattataacaatagtaagaccagcctggccaacatggtgaaaccctctactaagagtagtctctactaaaaaatacaaaacaattttagtctctacttaaaatacaaaaaaaaattagccgggcgtggtggcgggcgcctgtagacccagctactcgggaggctgaggcaggagaatggcttgaatccagggggtgggaggttgcagtgagccaagatcacgccactgcactccagcctgggtgacagagcgagagtctgtctcaaagaaaaaaaaacaaaaacaaaacaatagtaatagttgtgcatatcagattgccaacatttaaaaaatcatattgtgtgacacgtgcactcttacaaatgggtggtgcaagtgtaaatagctatgacatttttnnnnnnnnnnnnnnnnnnnnaagtgtaaatagctatgacattttttggagcacagtttggcagtaggtttttaaaatttattattatttttaattttagattcagtgggtacatgtgcaggtttgttacatgaatatactacgtgatgctgagatttggcctttgattgaacccttcatgcagagagtgaacataggtacctaatagatccttttcacaccttgccccactcacttcctccacctttttagagccctcagtgtctactgttcccagcattatgtctgtgtgtacccaatgtttagttcctacttagaagtgaaaacatgcagtatttggttttctgtgttaattcatttaggatgatggccgccagctgcatctgtgttgctgcaaggggcattatttgattctttttaatggatacatagtattccgtggtgtagatgtatcacattttctttatccaacccactagagatggcacctaggttgattccgtgtctttgctattgtgaatagcgctgcgatgaacatgcgagtgcaggtgtctttttgattgaaggatttatgttcctttgggtataaatccagtaatgcgttgctaggccaagtggtaattctatttttagttctttgagaactctccaaactgctttccacaggggctgaactaatttatattcccaccaacagtatatgaatgttcccttttctctgcaacctcaccaacatctgttatttcttgactttttaatagccattctggcagtatgtttaaaaatataaaatgtacatgcctcttgcgtgagcagtctcacttctagaaatcacttctataaaaacatatacctaaaaatccatcagttgaggaattatacatcgttatatatccaaactatgggatcctcttgaccctttaaaaagaaaaagtagttttatttgtactaacattggaaattgcatatggtatattgatagattaaaaaagtaacttgagatatgtgggtagtataataccatttgggttaaatcacttatgtgtaaaaaccaagatataagaggttcacgtcaagatgttaagggtgatcacctctggaaagacagtgagtgagactgggggaagaggagaatagcaagaaccaggactttcactctctttacacattcctgtatttgttaacatttcgcagcgaacatctttgatcatttaaaaaattaatgatgcattcttatattgacaattcttatactaaaattttgaaaatccacaggagataggaaaaaataccccttacttttgatactattgacattttgaaatgaaaggaaaaaatgagtttagtagagttaattcagcagaaaatataaatatataagatggcactaaggtatctttggggagaaacgggacctggttttgtttcgcaggtcctttgccatttgctgtttgatactggggaagccacgtaccttgtctgtggtccagttaggtttctccactctgcaggtagggctgacctacttccattggaggaaaaacctagagagaaagaatgtcaagaaaggttccacctgaatgggaagtgttattgttagaatgtccatgaatgaatgtcagagtccagcatctcagaggccatcattaaatgaggagcagtctttgtagaagctgaactctgaagtatgcatcatggtgaggagtcaggtggggataaatgaataaaacataaaagaccatgtggtatggtagaggaggaggtgtgtgcgtgtgtgtgtgtgtgtgtgtgtgtgtgtgtacagcttaagaacataaagcaataaaggagaacattttgatacagcataataaacaatattggagtactaaggaggagcttggagcaattcgatttgggaagtattaagaggtgttacatgatgataggagatgggtgcacatgcctgtgtaagaatggggaggtggggacattgtagtgatggggcattggcattgggtagctttgttattaagttcaaagagtttctaaagggaaaataaaatccccatttgaatcacaggtggttcattttctgaggcaatctcaagaggcacaagatcaaatctagcttgacaccatccagtacagaactcagcagtctctagaagctggagctgagctacagcttggctaatgagaactctccatcctctgccagcacctcagggcccatctcttcctctttggcaagcaggatacaaagagagcgcaaagcagagtgggacctagaaggtcacccagagcattcattttgcaaactccccaccaggcctttccagaagacagatgatcacggtttcacagttttgctagaatccgagccagtggcttcatgcttcgacctggggtaggttttaatgaaacctaaagaatacttcacacattgacctaccattggcagtgaggaagagggggagatgggccaaacacagctgaacgacatcctctcatttattcatggggcgtgagaggagtgattgtaaaattcagatgaaaactagaagttaaaattcagagctcccagtataaacatttgggtctggtatgaagttcactttcaccagtaagacacattgagaaacacaagaaacccattgttctctggatgtttgtgcatttcagtggttttgcctgtaggaccctcaagtggaagttagattgtctctattatgttctttctaatttgttaaatatttcttgaactaatctccttctcactatctccattgctaccgttaatgtgtacactgtttatcacaacagccttgcatctcatcagtctgcagccgtggctcatgcaatccgttcatcatgctgcctgattcttctttccaaacatcagctctttgtcacttcactgctcagcatctctcactgacatttggattgttcaaaatcatatccccactgcccaccttcttggccacatctcttgtgcttgcacctctccccactctgttttcttctgattcaatgtgacagctacccaagactatacgtggttctgcaaaaatgcaaacctctgtcttgtcttggcacctagaataccctttttttgctaattactctttgtctcaagatgcggctgtaccaagagtcatctctaggaaatgctccctaacctcctttgtgttacgtaccatttcctcacactgtggaagcacatgagaattacttccatcccaacatctgtactctcccctaactggctagtttttggtctgtctccctgactcacctggaaaccaccctcaaggtgaaaattacgtagttctgttcattgcatcttgcagagtgcctggcacatcgctgtgtgataggaaagaatgaatgtgtatttttaaattgggcttctccttctctagtttttgaacatgtgtatgtgggtttctgttttgcctgatgtgacgtgagtcaagtcatactcaacctgctgtgttctcagaaatgcagtgcggatgagtaagataaatcatgttagcatcatatataagtgagctgaagactcttaccactcatctcagagcaccattaagtagctgcctactgggtctctctagggtgttcatgaattaaaactcctgtgttgttccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggtaaattggaactggtaatcagtctttgggcaaatggagagtgggatccacagacagattaaaagggtgaccccaggatgatcccagaagctagtgcatgaaggatttctgatttctgatcctgtttcttggcatgtgacttctaggccagttgtttcctctctgggtattttttgaaatgcacttttatgtcttgatgctgaacagaaacaaggagaagcagtaaaatgttggagtgattttaaacccatgaaggaaacaaacctgctcctatctgcatggaaacccacaaaagtctaataaaattaaaccccacatctttcaaggttgagaagagaaagaaaatcatttgagaagggcatctgaacctcattgccctcgaagggttaccttccttttagaaaatttttgataatttgctgctgccatttccctgtaggctgcgaggaataacagccagagataggaccttcctccatattgccaaccttggatgaccagggtgggattttgtgaaggaaactggtagttccctgacaccatttatatgtatcttaagtaacgatcacttgaatatctcaccgctagattaattctaagtaggttttctctgcagtgttgaagggacaccttatttataaagggaaatagatttaccttggaagtcaaatacagcttaaaacaaaattaaccagacacaataatgacatcttaggatgaaaattctttccaaaattatgccatgtctgctaatgccaaaatagaaccatttcttattaaccattgcttagaactttcatgcttctttccaatcatgtgggtactagagatatgattattatgtagtcaaggccttggaaccaggcataattagcccttttctactgtctgccccccatctctcaaacctaactattgttcctatgtagagacactcctaggctgggaaataggaatttgagacaacgtctgaactggcttagaccagttgttcctgctttacatagctagaaaaaatgctggaagcagaagtacctggcaaatttaaatcactgctgtcatccacattcctgagattaccttaattgatgcagaataggaaaacatcagggctgaaggggaccttagagattcatttgtccaaaattaccacttgcagttgaggaaatgcagaaaatggaaagctgaagtcagcggatcactacctgttagagaaaggcttagcctggctcccaggttgtcttgcttcccaaaaggtcacagcagcatgttggccctgacaagggctataacgggggcccatgggtgacaaatcaatggctgtcaccctgagaatcaaaaaaggaaatcacatggtaaaaacaccagaaaatctaaactagtcaggacattgatggttagactgagatggggtaaaaaaggggcaccatgggctcaggtcttgggcaattaggtaccttatttcaatgagatgcctttcctagtcttgtcttcttagtgatccaattttttatggtgttttttttttttttttttttgagatggagtcgcactctgttgcccaggctggagtgcagtggcacgatctcagctcactgcaagctccgcctccccggttcaagccatcctcatgccttagcctcctgagtaactgagactacaggcgcacgccaccacgcccggctaattttttgtatttttagtagagacgggatttcaccgtgttcgccaggatggtctcgatctcctgaccttgtgatctgcccacctcggtcttccaaagtgctgggattacaggtgtaagccaccgcgcccggccttttttgtgtattttaaagcctcgtatcttaaactaaagccagggatcctgttcaacctggattttctcttgaatggagggtagtttgaaaggatgctgctatgagtgatagacagaacttccagccagactttcacaaagtctccagatttatcaaagagcaagattagttaataacccaggtaaccttggcaacaaagaggccagacaaaaaccgtctgtgctggaattacacatattgctgctgtcatggtcaggcctgacctttccacatagcaggtggggaatgggcaggaacattgtcctgccaggtgtccttggatattttttagttgtggacgaagtctcaaactaaagaccatgagctaatataaagcaggaagcagagctgtaacatgtttctccttctggcagaaaggtctgagctaagggtagatggaggagaaggtgtttctggcccccagcattggacaagtaaaccagttcaatgaaatggccccactaaaaatgatcttccctgtagctgcctgaacttcctctcttgagccaatcattagggttagcatgcatgcgctggagaaagaagggagaattgaggttgacatgctggggtacctagctgaaaatccatttaattaccttgattttttaaatgcttttaatggtccattcattcacttgatgaattttttcaaatgctagtgtgtgccaaccctctaaccctgtatcaggggctgggaataccgaggtgagccaatactgatactgttcctgccttcatggaacttgtagtctggtgagaaacagggagtgttgatctgttgggtggggcggggctaagtgggtcccttgttgcatggaggtaactgggtagccagatggcatcagcaactgggagagggaaagggggcagaggatggagtgccaagtttatcagccccgctcaaaatcccgcttcccccctgcccgcaacccttctgcgataacaaagggaggcgagcaggcttttctagtccaggacactcctttcgtcattcctgccttctgtatcctcttctggacccggttcccagctcccctccctcccacctgaaaggtttgttttgcattccacaccttggctggctcatctgcatgtgtggacaggtgaggctgggaaatgagagcactttagaagtgagaagagctctaataagttagagagaagttggttgttaccctgaagtcagctggtgactccctggtcattaagacctggtcagaattgtcttacaccacatcaagcctgtggcctatggtgggaccccccattcctcccccatcacatacatgcagtttctacagtgttccaggggcttgttcttatgtaccccttcgcctcctgggctcctgttcccccgtgtgcagactctgatacatcctaaatcaagtcctcttttgagtgctcttggaaaccgcactcccaggcacattgttgggtatagatttactgatactgtgaagggattggaacccaggcttctatcaaaacacaaataacttccatcagaactggaggcttcaccactgttgttaactggaggcttcaccactttgggccccctcaccaccatgacgtcattgactcgcctgactcctcccagcctctcccctgcctccagctcccctgctcgctttcagaagcacagacaacaaattcggccaacaaccattgcacacctgccctagcttgctcacccaggtattcttcaaagagcagcctcctccctcctacccagaagaattctggtaacatctattttgaaaatcgtttttttaccctgttgcatattgttatgaaatgtataaaaagctgggggtgctttatttaagatgatagtactagtttgtggatggcagataggaggtatctacacagtttctatcccacactttctgtatttgtgcagggcaaatgcctgttgagggtaatgggcagttttgggggtggaccgctgaccttagactttccttgcagctttggccccaacccatgtgacctccttcaatgccaactgccccttggaattctgaggggtgcaagcactggcctgacccatttattctgggtggcatgtaactgcaggtagtagcattgctaggactgagggatttgctgttgcaaattgttgaaaaaggggagttgcaaaattcaccaggtgccaccatcagtgaattgggaagatctaaaagaagatccctgtttcttagtcttcttaagaagtttttcctttctgtcagggaggcagcagtgggggtggagggcagggaaggagggattgtttttacactgaccacagtaaaatattactcaggctaattaaggcctagagaatggttaaacaagaaattagagtaaattatgtaaattctggccaccaatatgagtacattgattagcggcaggttgaagatttttttttttaatttctatttttaattaccaaagtgtatgtatctattatatgatattgtaatagttcagaataatataaaaggtagaaagtcttacatctttgcctctgccaatcccccttctagaggctccacctttatagattagtataaatctttttgcgcctctttctatgaatatatgatttttaatcaaactgggatgagaccatacatatttgtgtgtaaactgtcattgtttccacccacatagtggcatatcatatgaacatctttctggtgcaggtgggtcattatttttaacagctgccaagtatccctttgtatgactgtatcataacgtggttgttaaatctcctatgcatagtttttcctcattttttctactgcacataatgctgcagtgaacagtttatgcttgtgtgtacatgcacatgtatggagattgctacaggacaaaatcctggaagtggagtgctagatgaatagtatatccatttaaatagttgatagatattgccaaattgccttctaaaatttttgtaccaactcatacccaaaaaagcatatgagtgcccttgaaggaaaagggttcttaaaatgttgagcagggagagtaaagaaagttgaaatgtaatttaagggtgaggtgagccacctgctttcatccagcctctgatctctgcttcactgagcacgcctctgctgggcaaagagtaggagcctgttgggacagatcggtgggtccttgctccaagaaggaagtgtggctcatgggccacactctcagacatgcagaaactgtaaaggaaggagacacaagctaagaaacccgggctggcacctctgcacaatcctggagcctgcccgtgccctggctggcactgggctttgctgaaatctaatatcttgtttctttttcccttctgtaactaatgagcaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaactctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaagtctttaattttgagcaccttaccaaacataacaataatccattatccttttggcaacaccacaaagatcgcatctgttaaacaggtacaagttgacatgaggttagtttaattgtacaccatgatattggtggtatttatgctgttaagtccaaacctttatctgtctgttattcttaatgttgaataaactttgaattttttcctttctttcatgtatttttattaacagttggctagcaatggtattctgttcccacctcggtagcaaagagaccatttgtagagattattacctagataataaaatgataatactatataattagtaataaattaacatttattgggtagttatgtgccagacactgtgctaaacacttagatggaatattttattccatattagctctatgaggtagggacaattattatccccatttacagaagacaaaatggaaagttaggagagtcacgtagcttacctaatgttacagaggtaaaagtggctgagatgaattctgatccctggagtgggcattatttagaggggtggttcccaaaagccagtccacagactgtcttgttctctaatatataaagaataattcagcaacatctaggagtataaatccagagattctgaatcagtagttcttggatggggcccagaaatctgaatttttaaactgatcccagccaacttccatctgcagccaagtaattggtgtcaaggatttatagacttggctcttaattcaagttcatgacccttgggggatccacgcagaggcttcagagatgccataattatctgaaattgtatgcaactttttatgtataaacatttattttgctgtagagaagacttgtagctttttttttttttttttttttttttacttccctaaaggaacctgtgatgcaaggcggaataaaacccctgattcatgtaagaaggctgatgtagagcagtggttctcagcccagggagcccagtagattcacctggggagctcaaaaccggctgtgtggggctgcagcccaggccaagaaactcagcatctccggcatagtgagaagggggctctgtgttgaggagtacaattctggattcaaatctgtcacctagtgggtatgtgaccttgagcagcttctaaaccgttttgaacataatctcatctgtgacatgaaggtatactcacttctgagggttgtggggggaactaatgacaacaaatgaattgtctctggcacatccgaggccttcaacagataactacatggggcccacgagagtagaatggatgccttgagcatttttccaattcaatatttcagactattcgttccttcagagaggacggaaaagaattcccctgctcatatgccagagcaggatggctgatggtatgggaatgggtggtagagacgttgtttcatagtgtgacttcaccaacagttcatagactagcgccagctttgtgcacaaggtcgatgggcatctcttacttggtgacaacctctagttaaaattgggtggttacaagttagggttcagctctattttcatccatcaaacacctttcacctttttgttgttgttgttgttgaggtggagtctcactctgttaccaggctggagcgcagtggtgcgatctcagctcactgcaacctcagcctcctgggttcaagcgactcctgcctcagcctcccaagtagctgggactacaggcacgtgccaccatgcccagctaagttttgtatttttagtagaggcagggtttcaccgtgttggccaggatggtctcgatctcttgacctcgtgatccacccacctcgacctcctaaagtgctgggattacaggcgtgagccactgcacccaacccacctttcacctttctcagaggaataagaatagtgaccttagcttaagaatagtgaccttagcctaagattcttctggggcatcttcaaatctcttggaggaaatgacttcatgcctggagagcatttggatccgagatggcaagaactgatatgaagccaagctgcgtagactcccagtcatacacaagtcctcagtccctgggggcccatcacatgctgcatgtaggatggctcttccatgcacacttaagcataagatgccacccaatcaagcccctctcttcaaagcatacaacttcaatttccttgttgaaaatcattggcttagaagtctctttggacatctttagctaggaactgggtgagaactttgaaatcttgtctttgtggtcagaagatggcttcttgctaataaatcaaaaggaccctttggaggagataggactagtcaaaggtggcaagcatcctctgcctctctgggttttgagtcagggaggacttggatccaaagtccctgtctctaacttctttttatcctgcaaagcctggcacaatgcctggaaatggtatagagagataacagttactgagtcctaaacctgtgccttccacatctcatttaatcctcacactacaaaacaggtactattattatccctgttttgcagataaagaaacaggcttatggaaattaggtaatcagcatttttaacccagaccaaagcctgaccccagagtttgacaggggtgggaaacatcaggagtttaccaaacctatttatttaccttctggacattcaagtagaccactttttccagactcccttacctctagtatgaccattcaactgaattctgtccaaaggaacataagcagaagtaaccccaggtgtcacttccatgaaaggcccataaacagtgccacctgatgctctctctctcctttttttctggctcctggagaagatggagactaagaaggaagggacccaggtccctgagtatatggcaaacgcacctgacagcaataacttcagcatactctgagaatgaccctgtatggcagacacagctgaatgtgtgttcagagttccaagctcaggaatctgggagtggccagcctggaggttcattctttatctgtgacgaacatctgaaccctcagcctgtcccaaggaccacgagccatacaggggatcatagtcctctgttttgggttaaatgaaggttgtcaggtggaggttgttaaggggagggtgcgaagtggaaatgctattttataaactacatactatttgcaagtggttgtagttctgtctggcccactgccactggaccatccctacatgtaaatttcctctaataataatttatatctcatttgctagctctgggtttcttcttcagcctctcaaacatggttccttccctgttgagattaataggggtctggcatgacactaagtcatcaaactgttacacgaggaaggaaaaagcctctctgtattaaaccattgagatactggggtttcttgttgcatggcctaactgctgattagcctaaccctaatatgaggaccttcttctgaagcccagtgtccttaatttgaggtcttgacatctttgccaggttcccaactgtaatctaggctcatcacccctcacatacctgactttgaggtttgtccaccttctggacagacctcccaccctggttaggctaagcctactgggttggaccttcagaacatcactgcctacctcttccctccatttatcctgcgtttgaacactgtccagaattgttcaattgctctcacggtgtattagtccatttttgtgctgctgtgaagaaatacctgagactgggtaatgcataaagaaaaagaggtttgatggacttacagttccacatggctgaggaggcctcacaatcctagcagaaggtgaaggaggagcaaaggcacatcttacatggcagcaggtgagagagtatgtgcaggggaactgccccttataaaaccatcagatcttgtgatacttattcactatcacaagaacagcacgggaaaaacctgcccccatgattcaattacctcccaccaggtccctcccatgacacaggattgtgggagctacaattcaagacaagatttgggtggggacacagccaaaccatatcacaggggaagcagcctctacttccagatcagcttttctactcattatcctctcccgaatccaaattctctccctggccactcagtgcccccttcatccccagccccagttattcaggtactcacttcaagatgaggcctaccatttcttagagcactggtctttcagtttttttgctcacatgctcccaaaaattctttttaaaccatgaatccacattgcacattataaagttgacaactaaaatttttttaatcacaagtttaaatagttgcaaaggatgtaatagctgctctaagtactggcatttaaaaataagctactacatgactctttttaatatatctgatgaactattaaaaccctagtgatttactaccaaccaacatccatttgaaaaatagagttggaatttgtacaccacttttttttaatcaaaataattatttacattgtgtttcctcactgagtttgtctcttatgtaatatatttttatgcctcaaagtcttatattgtccctccatcgtatttctcagtcataaaacaacagctatagactgagattcttatttttattttcaaaaaaaataaaacaaggctcataaattttttatctttaggtatgagttatggttaccttcattactagcacatgcatgatcaaaaccatgtctatagtaaaattttaaataattattatccatgaaaaataaaattttaacaggactacaaatctaggaagatggataggagtggttgtggataactgataaagaaaaagacttcacagacaacaaacttccttgttgtccctttgtctggtgccacaaacatttttatgcctggaactggagcccagagctagagtaagatttagcctgggtaggaagtatacctatgttttgtaaaacgagagaaatgtgattgtaaaaggagaggaaaggaaaaaaaaaaaaaaaaaccaaccagcgtgaggcctcatcaacaaccactttctcaggcaggtcaattttaagaaaaaatacgtatagaatttgagggcctagaaattcccttaagacttacctatgcaaatatatcccttggatatactttatgcagcactagatgtgtgtcctgctgacttaaaaagcagggcattagagtggggctgatggaggtaaaagagcagaagggttatttggccagttctaacatttttgaaggggctcaaattagaatgtttgatttgtttccaagtgaatatacatattcctaaagatagaatgacaactttttttgtaactttcttctggcatttctatatcttttgaaatgtcccttatagcccctaaaatagaattggcctcatgcctcccataagctctgatggggcacaggatgggtctggggagtccccagaaagaaggtgatggttgaagtgagtgaagataagcaggagcttgtcaggaagagatggagagggatatcccaggtggcaacacagaggtaagagaagagaacagaacactcccacaggcgacagcatggtaggtgcaaagggtatacggtgagcggtaaaaaatgaggtatgaccagaccatgaaattccttgcatgctgctctaaggcctttggactttagcctgaccaggagaatgacatgagcaggtttctatgttaaaaatattatactggcagttaagaggaagatggattgcaaagaattaggaagagtgagggagatttctactttagtctctgagtaagtctctagggatgaggtgggtgcatagattcagagctatctaggaaggtttagcctgcagggtttagtagaaggggtcaaggacagctctaagttccatgatctcggtcgatctatggttcacggtcagggatgcacataagaatcctctcaggagtctgcaaaaacacccatgcctggcaccaccctgtgactcgttgaatttgcagcctctggtgtggaacgccagcccattttccttagaaagctctcttggtttattctactctgcactctctgggtgagaggaatatgggccaggaattgtaggcttcatctttccgttaaagaaatcaaagctcaaagagttctgaaatcagaattcctggagcaaagcatataactagggaaatggtaatgccaggatttgaacccaagttacttggacttcaagccccttcctgttccagacgtgctgatccttgcctacctgcccacttctgcttcctgtttgaccacctgtcctatatattcctgagtgtggctgatgtgttcataatttcagccctgcctccatccacagctgcctgactaggagggacacctggccccagaggagccactccattgaatcagctgatatctaagatagtggctctcaaactttgctgctcattagaatcacctggtaaactttaaaaaaatcctgataccaggtcatatttccattcaactgaatcaaaatgggaggggtggaaatggggaagggggtggaacccaggcatagtttacaattttttctccaggtgattacaattggagcttatgaactatgatcaaagttctccaaatgttgtccacaaattagcagcatcaatatcagctggaagctttgcaggagcgtagactctttggtcctatcttagactcctgaatcacaatctctattttaacaagatctccagatgattcctatgcacattgcagattgcaaagttctcccctaaacaacacagagtgcagtggctcactcctgtaatcccagcacttcgggaggccaaggcaggcggaccacctgaggtcagaagttcaagaccagcctggtcaacacggtgaaagcccgtctctactaaatatacaaaaattaactgggcgtgatgttgggtacctgtaatccgagttacttgggaggctgaggcaggagaatcgcttgaatgtaggaggcagaggttgcagtgagccgagattgcatcattgcactccagcctgggaaacaagagtgaaacctcatctcaaaaaataataataataataaaaaaaattagctgggcgtggtggtgggcacctgtaatcccagctatttgggaggctgaggcaggagaatcccttgaacttgggaggcggaggttgcagtgagctgagactgctccattgcactccagcctgggcaacaagagcaaaattttgtctcaaaaaacaaaaaacataaaacaacaacaacaacaacaaaccgcagaggagcaaaatgagtcagtggaggaatgaatggcagattagtacatgtccttgcaatccttcaaagtccttggatttccttgattcttgcccttcctgatgtctaactgttgcgcttcccttgaattctgaacaatatctagcattataattaccctttcccgccccacctttttttaggctactttgagtaggcttctatctgcttgcaactgttagcactaggaaacannnnnnnnnnnnnnnnnnnncagcaccaaatatgttagcagcagcgaatccttatgggtctgcagcaacctcaattcttgcctcctcaaaagaaagaattcgaccaagggtcataaggcagagggagagacggaagcaagttttacagcaggagtgaaaggttattaaaaagtttagatcagacgggaggctgaggcaggagaatcgcttgaacccaggaggcagaggttgcggtgagccgagattgcaccattgcactccagccctgggggacaagagcaagactttgtctcaaaaaaaaaaaaaaaggggggggtttagagtagggacaaaaggaagtaagatacacttggaagagggccaagcaggccacttgagagattcaagtgtgtggtttgacctttaccttggggttttatacatcagcatgcttcccaggcgggtggagtgcacctttctcccctgattcttcccttggggtgggctgtccacatgcacagtggcctgccagcacttgggaggagccgcacgatcagtgttttctgaagttgtatgcatgctcactcgaggccttcttcccttatcagtcaagtgttcctagaagaaggtcatatgccagttaaatgccaccattttgcctcttagcgcacatgcttgagcccactcgcccaactcctgagaccgcatagggaagctgctgatcaccagtttcaggtgtttttatctgttgggaggctggccttttccttgtgctggctgaggccaattattattttagagagacagtttaacaactgcctgaccaacacctgatggttgcctgacagtcccggtggtgggggtgggggaggcgggtcctcttctgccctgctcatgtctcactaattacctactgtaacacaaccacaggtgccacaacatacttgctttttaaatttccttttgtttgaatcaaccaatgtgccttgcagaatgcttcgtcagtggagtggggaactgaagtcatcactgattatttggtgcaaggtctcaaaagcgtttctcctgaatgacattttggacaaagcttgccaaagacgggcagcctttgaagaagttcaatcaccatcttcctttccaagttgggcttgaggatgcagtgtgaatagcacaggctttggagttgaattaaaactgggttcgaaccctgtctctggcatccatttatttcagaaacagatatttatggagcgtccactatggagaaggcctttttagctggtaacattatacttaatctttctgaactcagagtcattagtgccatcttaatattgtttgtacttggcaagataagaaatatgaagcatctggaggcctggaatagtagacattcagcaaggatgagtttcttcctttgtactgcccaatcccctctcttctccctggaccttgcaggagatggataaggagcctcttgaaggaagtggctcaggattagtgttctctctctgacctttgaaaattaaatgaataacacaagggacatgacaaaacacaatgacaccatttggggcttttgtcccttaggctagatttacttgtaaggtttctatcctgacctactagaggcagaagatggattaagaaaggagtcttagataatctctcatctactatccttatttcaagatgagaagtcaaatagttgctgttggagactggattctatcctaggtttgcaaacttcccatctgatctcgtgccgtgacatcaatcttgcccccaaacaatcctcatcacatctttatcttccgtccccaaggtaaattgatagtgcaagcatcatgaacttttgtactgcatgatcaccactcgtttccaaaagccatcccaaatttgcacatactcaagtaaaaccaggatccttgctttgctaacatggcttccaattcctgtggcggcaccttctatcccttaaatagactgcagctcttgagtcacttctatgtagaaattctgaagccactactgaaaatgagtcccagggtataaaagactggaaggcagtgcccgttagttgaccccacatccacagccaattgagcactgtgtgattttccttggaagtagatacaatggactccagcatgagtcacaaggcccagctctaatccaggtttcttccccagtcgtcatttctgtccctcctctgtgcagcatcctgtggcctgggaagggggtgagaggaaggaaagaaaaaggagggtccctcatgaactttgcctgtgaagacgatgcactcagggaaggaaacatgattcctgcccatgggatcaggatcccgccacgtctgaacaccgttgtacagcttaacagtccctcatctgtttttcattttggccctttcagcaaccctgtgagggactcagggtacaataaacaaggagacagatttggtgatggcaaaccttacc

SEQ ID NO: 413 - DNA, 5299 bp, Homo sapiens
gggaggggggtggggtgggacggcgcaccgcctccggtgctggcactaggggctggggtcggcgcggtgtcttctgcccttctgcagccgtcgacatttttttttctttctttttttcaattttgaacattttgcaaaacgaggggttcgaggcaggtgagagcatcctgcacgtcgccggggagcccgcgggcacttggcgcgctctcctgggaccgtctgcactggaaacccgaaagtttttttttaatatatatttttatgcagatgtatttataaagatataagtaatttttttcttcccttttctccaccgccttgagagcgagtacttttggcaaaggacggaggaaaagctcagcaacattttagggggcggttgtttctttctttcttatttctttttttaaggggaaaaaatttgagtgcatcgcgatggagaaaatgtcccgaccgctccccctgaatcccacctttatcccgcctccctacggcgtgctcaggtccctgctggagaacccgctgaagctcccccttcaccacgaagacgcatttagtaaagataaagacaaggaaaagaagctggatgatgagagtaacagcccgacggtcccccagtcggcattcctggggcctaccttatgggacaaaacccttccctatgacggagatactttccagttggaatacatggacctggaggagtttttgtcagaaaatggcattccccccagcccatctcagcatgaccacagccctcaccctcctgggctgcagccagcttcctcggctgccccctcggtcatggacctcagcagccgggcctctgcaccccttcaccctggcatcccatctccgaactgtatgcagagccccatcagaccaggtcagctgttgccagcaaaccgcaatacaccaagtcccattgatcctgacaccatccaggtcccagtgggttatgagccagacccagcagatcttgccctttccagcatccctggccaggaaatgtttgaccctcgcaaacgcaagttctctgaggaagaactgaagccacagcccatgatcaagaaagctcgcaaagtcttcatccctgatgacctgaaggatgacaagtactgggcaaggcgcagaaagaacaacatggcagccaagcgctcccgcgacgcccggaggctgaaagagaaccagatcgccatccgggcctcgttcctggagaaggagaactcggccctccgccaggaggtggctgacttgaggaaggagctgggcaaatgcaagaacatacttgccaagtatgaggccaggcacgggcccctgtaggatggcatttttgcaggctggctttggaatagatggacagtttgtttcctgtctgatagcaccacacgcaaaccaacctttctgacatcagcactttaccagaggcataaacacaactgactcccattttggtgtgcatctgtgtgtgtgtgcgtgtatatgtgcttgtgctcatgtgtgtggtcagcggtatgtgcgtgtgcgtgttcctttgctcttgccattttaaggtagccctctcatcgtcttttagttccaacaaagaaaggtgccatgtctttactagactgaggagccctctcgcgggtctcccatcccctccctccttcactcctgcctcctcagctttgcttcatgttcgagcttacctactcttccaggactctctgcttggattcactaaaaagggccctggtaaaatagtggatctcagtttttaagagtacaagctcttgtttctgtttagtccgtaagttaccatgctaatgaggtgcacacaataacttagcactactccgcagctctagtcctttataagttgctttcctcttactttcagttttggtgataatcgtcttcaaattaaagtgctgtttagatttattagatcccatatttacttactgctatctactaagtttccttttaattctaccaaccccagataagtaagagtactattaatagaacacagagtgtgtttttgcactgtctgtacctaaagcaataatcctattgtacgctagagcatgctgcctgagtattactagtggacgtaggatattttccctacctaagaatttcactgtcttttaaaaaacaaaaagtaaagtaatgcatttgagcatggccagactattccctaggacaaggaagcagagggaaatgggaggtctaaggatgaggggttaatttatcagtacatgagccaaaaactgcgtcttggattagcctttgacattgatgtgttcggttttgttgttccccttccctcacaccctgcctcgcccccacttttctagttaactttttccatatccctcttgacattcaaaacagttacttaagattcagttttcccactttttggtaatatatatatttttgtgaattatactttgttgtttttaaaaagaaaatcagttgattaagttaataagttgatgttttctaaggccctttttcctagtggtgtcatttttgaatgcctcataaattaatgattctgaagcttatgtttcttattctctgtttgcttttgaacgtatgtgctcttataaagtggacttctgaaaaatgaatgtaaaagacactggtgtatctcagaaggggatggtgttgtcacaaactgtggttaatccaatcaatttaaatgtttactatagaccaaaaggagagattattaaatcgtttaatgtttatacagagtaattataggaagttcttttttgtacagtatttttcagatataaatactgacaatgtattttggaagacatatattatatatagaaaagaggagaggaaaactattccatgttttaaaattatatagcaaagatatatattcaccaatgttgtacagagaagaagtgcttgggggtttttgaagtctttaatattttaagccctatcactgacacatcagcatgttttctgctttaaattaaaattttatgacagtatcgaggcttgtgatgacgaatcctgctctaaaatacacaaggagctttcttgtttcttattaggcctcagaaagaagtcagttaacgtcacccaaaagcacaaaatggattttagtcaaatatttattggatgatacagtgttttttaggaaaagcatctgccacaaaaatgttcacttcgaaactctgagttcctggaatggcacgttgctgccagtgccccagacagttcttttctaccctgcgggcccgcacgttttatgaggttgatatcggtgctatgtgtttggtttataatttgatagatgtttgactttaaagatgattgttcttttgtttcattaagttgtaaaatgtcaagaaattctgctgttacgacaaagaaacattttacgctagattaaaatatcctttcatcaatgggattttctagtttcctgccttcagagtatctaatcctttaatgatctggtggtctcctcgtcaatccatcagcaatgcttctctcatagtgtcatagacttgggaaacccaaccagtaggatatttctacaaggtgttcattttgtcacaagctgtagataacagcaagagatgggggtgtattggaattgcaatacattgttcaggtgaataataaaatcaaaaacttttgcaatcttaagcagagataaataaaagatagcaatatgagacacaggtggacgtagagttggcctttttacaggcaaagaggcgaattgtagaattgttagatggcaatagtcattaaaaacatagaaaaatgatgtctttaagtggagaattgtggaaggattgtaacatggaccatccaaatttatggccgtatcaaatggtagctgaaaaaactatatttgagcactggtctctcttggaattagatgtttatatcaaatgagcatctcaaatgttttctgcagaaaaaaataaaaagattctaataaaatgtattctcttgtgtgccaggagaggtttcagaaacctacctcgtcttacaaatttaaacactttggagtctgtacaggtgccttatatgtaggtcattgtcacgatacacacacacgaacactccctctggactggctgcctctccatccagggcagttaactagcaaacaaggcagatctgcttcatggagcgggaggccatggcttgactctgagtgatttgggtcaaccggagtcagacgcatgtctgcacgctgcagctattatgagagtccctttgtcatttttcaccttttcatcctaagcatctttcagagattaattatttggccattaacaatgaatccaaatcatatcatactgacatcatctagacatgatttggaaggaacagcttaggacctcctgatgaggtcacattgttgtttcttttaactagacttggcaaagaaaggcaaaaattgaccagcctatctttctgctggtgctgccttaaggaggtagtttgttgaggggagggctgtagatcattacttctttctcttcaggaagtggccactttgaaccattcaaataccacattaggcaagactgtgataggccttttgtcttcaaatacaacaggcctccactgacccatccctcaaagcagaaggaccctttgaggagagtacagatgggattccacagtggggtgggtggaatggaaacctgtactagaccacccagaggttccttctaacccactggtttggtggggaactcacagtaattccaaatgtacaatcagatgtctagggtctgttttcggaagaagcaagaattatcagtggcaccctccccactgcccccagtgtaaaacaatagacattctgtgaaatgcaaagctattctttggtttttctagtagtttatctcattttaccctattcttcctttaaggaaaactcaatctttatcacagtcaattagagcgatcccaaggcatgggaccaggcctgcttgcctatgtgtgatggcaattggagatctggatttagcactggggtctcagcaccctgcaggtgtctgagactaagtgatctgccctccaggtggcgatcaccttctgctcctaggtacccccactggcaaggccaaggtctcctccacgttttttctgcaattaataatgtcatttaaaaaatgagcaaagccttatccgaatcggatatagcaactaaagtcaatacattttgcaggaggctaagtgtaagagtgtgtgtgtgtgtgtgtgcgtgcatgtgtgtgtgtgtgtatgtgtgtgaataagtcgacataaa

SEQ ID NO: 414 - protein, 316 aa, Homo sapiens
GAVVSFFLISFFKGKKFECIAMEKMSRPLPLNPTFIPPPYGVLRSLLENPLKLPLHHEDAFSKDKDKEKKLDDESNSPTVPQSAFLGPTLWDKTLPYDGDTFQLEYMDLEEFLSENGIPPSPSQHDHSPHPPGLQPASSAAPSVMDLSSRASAPLHPGIPSPNCMQSPIRPGQLLPANRNTPSPIDPDTIQVPVGYEPDPADLALSSIPGQEMFDPRKRKFSEEELKPQPMIKKARKVFIPDDLKDDKYWARRRKNNMAAKRSRDARRLKENQIAIRASFLEKENSALRQEVADLRKELGKCKNILAKYEARHGPL

SEQ ID NO: 415 - DNA, 189158 bp, Mus musculus
  misc_feature (1)...(189158): n = A,T,C or G
tttaagggatttctgtgttacttatttaagtacttctaggtgtttacctgtgttctcctgtatttctttaagggagttatttatgtccatctgaaagtacactatcatcatcataagatgtgtttttttcccttgagatttctttttttttaaatatttttattaggtattttcctcatttacatttccaatgctatcccaaaagtcccccataccctccaccaccccccactcccctacccacccactctcactttttggccctggtgttcccctgtactggggcatataaagtttgcaagtgcaatgggcctctctttccagtgatggccgactaggccatcttttgatacatatgcagctagagtcaagagctccggggtactggttagttcataatgttgttccacctatagggttgcagatccctttagctccttgggtactttctctagctcctccatttggttttctcatggaatattttggattctccatttatggtaattgagaattttgatgggtatagtatactggcctggaatttctgttctcttagggtctgtatgacatctgcctagaatcttctagccttcataatctctggtgagaagtctagtgtaattctgagagggggccctgtgatccatccaatagctgactgtgagcatccatttctgtgtttgctaggccccggtatagtctcacaagagacagctatatctgggtcctttcagcaaaatcttgctagtgtatgcaatggtgtcagcgtttggaagctgattatgggatggatccccggatatggcagtttctagatggtccatgctttcgtcacagctccaaactttgtctctgtaactccttccatgggtgttttgttcccaattataagaaggggcaaaagtgtccacactttggtctttgttctttttgagaaacttaggaaacccaagatataagatacaatttgctaaacgaatgaaactcaagaagatgtgcttttaaatcagagtcttgcctttctggtatgttgacatttccagggctcactgtggtgggagaactgggttctgatgatcccaagtagccttgatttttgttgcttatgttcttgcccttgcctctcgccatctggtatctcaggtgtttgctgctcttgctgtctctgactgtggcttgtctttcctgcaagcctatgtgtcagtattcctgggagaccagtgctctctgtgaggaatttgtgtatggagagctgtggcacaaggtcagctccaggttgcagacagaaactggaaggatcctgttcctgctgttccttggttcctgtgtcctgatagctctgggaaggtccctcttgggccaggaatttgagtagaagtggtggtcttagctgtgctcacagatgtgtcagcactcttgagagaccagctttctctgggtggtatttggggtgtggagcactgtggtacagaatgagctccaggttcagaccatttctttaagtgcttcttgacttttagatatttctctgttaagaattcttgtttagctatgtaccccattttttaattgggaaattaatctgaaattctctttctttgttgagtctttgtgtggtttacatatcagggtgattgtggcatcatagaatgaggttgccaatgttctttctgtttctattttgtggaatagtttgaagagtattgctattcacttttctttgaaagtctggtagaactctgtgtggaacaatttggtcctgagctgcttcccaccgctcccacccccaccccacccccaggttgggagattttaatgactgcttctatttatagtactatttacattgttcacctgatcttgatttaactttggtaagtggtatctgtcaagaaaattatccattttgtttagattttccaattttgtggagtacaggcttttgaagtagggcctgatggttctttggttttcctcaggtctgtagttatgtctcccttttcatttctgattctgttgatttggatactgcctctctgcctctgagttagttttgataagcatttatctcttttttcaattttcccaaagaaccaggtcttggattcattgattctttgtgttctctttgtttctaatttatcgatttcagccctgaatttgattatttcctgcaatctacccctcatgggcatgtttgctcttttttgttctcgaattttcaggtgtgcttttaagttgctagtatgagaggtctccagtttccttatgaaggcagcaatgttgtgaaaagacagctaatgtaatactgagaagtggactcttctttttgtgatagaattttcttaagctctctggatctggagcatctctgtctctccagagtcactgtagagaggtccccatctaaacaggaagaacctaaggaggcaagctagagagatggctctgcaggtaattgcttgccgcctgcatctgaggccctaagatcagaactcacagctcccacataggaagattgtccagtaggatgcagctgtggtttcagaatgtggagaggataaggggaccagatggtcccaaagctttgctactcaacctgtcaggttataatagtgagatccagataataagagagagaagtgattaaggaagacatcctaatgtcaaccactggcttacacatgcattcactagagcgagtacacacacacagaactacacatgcactcacaagagcaagtaaacctgcacacacatgcacacacacacacacacacacacttacacatgcactcacaagaatgagtatacctgcatatacacactcttacacatgcactcacaagagcaaatatacctgcatgcacatacacacatatgcacatacacacatgtgtaaacttgagcaagataaagcaggctgaagaaagaggatgagaaagcttaagacccaagacccagaaagttcctgctggaccctcataggtcacagtgaaaagacttttaagagtcccctgcccagttggaattggagaggaaagagtgtttctctctcagagaacatgtgcaatgttgatttatcaagttggcctgaaatagttgtggggagacaatatctgaatagatttgtcttctctggaagtggaggtgtgcctcaggacagagctctgagggaaattctagttacatcccttcacttaatagttgagtccactgcacagttaacctttccaacctatgtttcctcatgtgtaaaacactgggtgctgattcgtggtattggaatgtctctgtgggaggaggttgagaagaggttagagcagctgtggtgctcgctaagcactctgcagatgtgttctatgacccaatactgagctaggttagggtgatgctggtgaagagaagggagcatgtgaaccacagctagaggtttccaaatcttaaaagccacaaaactcattaggagccaccagccacacaggttcacttgtagcagccattcataagacttttacattatgtttgatccctgagaagttaaatattcatggatagacagaaaaatgtaaaaataccatagaaccagtcagcaatctggaaaaaaatgttagtgaaggatccctgttggcctgtacaggtgagattgaaggaataatcagatgtttcagtatcctgaaatagaaattctgagaagtctcctctcttactgggacatgctactggaggtggagagggatggctggggaagctggtgttattcctagaactctgccagaatggcagctaactgggcttgtaggtggaatggggtgggtgacatggtcactgccagatttgctacacagagaaaggaggaagcaagccaaatctaccagtctatttccttagctttcaaggacgtagaaatgtattagtgtacaaaatgtggtgagcacagtaggtctctctctctcacacacacacagtaggtctggcccatctagctcgtactctccttccattttggagctgagccaacactgctgataataaattactgactctgaaacttaactacatattggaatcacctaggtagatttaggaacttctggtgactacatttttcccttagagaatcttaatttaattggtctggagacccccaagtagctttaagatatagcaaagcctgagaattagtgccctatattgaaatcagctgagaatcaccagcctcattaagtgagcacatgcatatcatacaggttttcataaagccaggaggagatagagctgagacaagctagaattgtgctatccatcattactatttaaatctaatgtaattacattcaggtaaaaattttaaattacttcttttgttccactggctgcgtttcaaattttaaaagatgcatatggctagtttctgccatttgaaccagacagaacatcatggaaagttctatgaatcaactctaagaaattggcaggaccttcaagctaagcaagcagatgcttaaggcaataaggcttgggatagaaatgaggaaggctgagcctcacacactggacattcagggggagagaagtgaactgtggagaacagaggctctgggcaccagaagacatatttgacagctcgtgcatgtgccagcccattggatgatttgctgctccaattgcgtagagcctgtagcctacaatgctggtagtgaagggagtggaaacccaaggcaactggcactaagccaggtggcactcatgtcattgacttcagaaccacacttcaaggcaaggtgctgcacttctactggctgctttgaacaacatcaaagccccagacggtgtccatcatgacagcagcatccatctctgtggtcaatgtcaggttgattccaggacctccaaccagaacatctctggcatcataggctcatatattgaaatgatcaagtgcacagcagaggactcgatgaactgctagttgggggagtggggaggggagtcccttgataccctgttcagtctgctccagagggctggaaggatttacatcatggtggctgaagaatgccagtctgggcaggaatctctctgcaaggcaccaggctgaatttttctagaaagaagggtgcattcattttccagggttgctttaagtaagtgacatgaggtgggtggcttaaaggacacatgaattcttgcaggtgctgggcaacagttgaggtcctgagacagagcactgttcattcagctagcccaaccatctgttttattatagaagctttatgtagcttaatatgccctcttggaagttaatatggtttgaaaaattgcctgcaataaaccctttctttcttgcacataagcttatccgttcttcattcagagaaaattagtttctctctatccaccctaaataaatgtggggagaaagtacttaaagaatatcagtctgagggagtatctagtttggagcctgccctgaggatatggtgaaatcctttggtcgatgatgtcattatttaccagggcctgttagaaacaagggtttctaaccccagtgcactctgactggcctcagtggttggttcctatggccaccaccttcacattctcaccaacagaaattttaaatttacacttacttattttttgttcatttatttaagagcacacttgtcacagtctgtgtgctgaggccaaaggataaccagcaagagtcggttctctccttttaccatgtcggatctagggttagaattcaagtcctgaggcttgagagcaggagcctttatgaagaaaaactttaagtttgtaagaccagaggttaacaaagaggttaaacacatgagctccagagctcaactgcctgggttcaaatccacccttgttacttgcaagctgtgtataaatgggaacgttatggatgacttctctcttcatgccaccgtagcctagctatgtttgcttttcaaaggatggacgtgaataaacatgaaataagggccaggtgatgcattccgtccacatgctgagttcaagagcctacgctgcatccgtcacctttcacatatgacgtgaaattgtctcagctggaaaagggtacaaagctttctggcgtgattgctgcaaaagccaaagttaacagatggctgcagatgtggctcaaggcaactgcagcctagcctagtgatcaaagttctagtccccagatccacgtaatgggaggcgaggactgactcctacaaggtgtcctctgacctctgcacatgtacacatacacacacacacacacacacacacaagcacacacacacacatatacgcgcacaccaccaccattacaacttatttaaacggataagaacatgtcctgaaatttctaaagcaatatgaatatgtcaatcatgatgaccagggaagataggggctgaattactattgttgtccttgcaaagtgggtgatagagagcaagcaagtttaaaccacactttaataagaagagcctcaacttacagagagcagtttatttcacaaggactggcgagcatgattgcctagggcacacagaagacgttggtgtgctcctgccatcccaacccttgggaagcacaggactgcctggattgctgggccctaccctctactcagaaagtcagtgtgagggattggattaaatggagtgggaacattcccctgctggagctggcatttgcagttagtaaaggatctttatatttgcttaccttgaatgcgacaccccttattaagaatcatgagcaactcaaggctattgctctgggaaccctgtcttgagtctccagaagagatgatgcatctctcataatgactggggatgcataatgcttaaaaccaccttttcctacgcatttagcattgtgagcactcactcgcctcaacaccttctctctgtgtcgaaaacctgatgctcttgtggttccaagtggctgctgtttatccttggagatcaaatattttcataaagtaaatctgtattatttcatttcttcccatttctctcatttcctggggatggggtcacatgcttggatagcctatttgagatatgtagcttaatgccaacatgattcatagctctatgtgtgaattacacttgagaataaaagtgtgatccatttgtgtcaactgaagtgtctaatacaaaaacaaagaccaatttccattcactgtctcttttcacttgagcctgcccaagacactgaatgtattttctcttctctgaagatgtcaaatctacctataacccatttctctctcaaaagataccacagaagtatatgtaagcctctcatcttgtggttcattatttcacgcattcaaaccagatgttaaaatacaatgagtctctcagggacaaatggaaccattccatgagggagaagagcctggaaggacatgtcaggcctgtggtgtagatgccccatctcagtgtggaggtctctggccatcgaggaatgcaggaaagtcaccagctgttacagtatctttttccaaatgtaaaatagtagaaaccgccctttatacattggagatgaagcagaaagcacaccgacgaaaggcaaaggattgccttcatgtcaccttaactggtgatccacaaacttgtaaactctgatttccaccattacacaaaactagaaagactcaggaattatgccagtaaattctcgtactgccatagtcaatgaccaaagaatcagtcctgttcccaaaatggatgtgtgtgtgtgtgtgtgtgtgtgtatactgacatgtatgtatgtatatgtatatgtgtatgtgtatgtgtatgtgtatgtgtatgtgtatgtgtatgtgtatgtgtatgtgtatatgtatatgtatatgtattatgtgtatgagtgtaaaattctgctaaaataggaatggagtcttcataaggtgccagagtagtcaaagaatgaccaacttgtaaaatcctaagcatagtggactggagatggctttctgctgcgtatgatatgacaaaaacttatgttcctttctgctgcgtatgacatgacagaagcgatatgctccttttccttgaaacctggattgttcacccacttgtgcatgatgggtgatgcccctcacctataggttctctcacgcagtccagcatgggaaggcaagtggctaggaccagcatcaaggcaatgcagcttagtgttggagcgagcatgagactctctttgtggagcagtgtggtcatggatgacagcgtagaggacttcttccctctggaagattattatttcctcttacctatgtgagagtaaaggaagtggtattataatttgtgctaagacccaatacttttgagacagttggaaggccacatctctacttgaaagccaacatagtacaggaacaacaggctccagttgatttgtggagcgtgaaagaattggcttctcccatgggatggtgctacaggaactgggagagatttttttttcaggcttccaagaatataaatggctttgtgtggtttcacttgtgacaaacactaagggaaagaaccttacatggcccagatttagacaggaaacagacagcagaaccagagtgtccagtcatggagactgagcctttggagaactaaactctcccaggatgagggcacagagcaagcactggacagtagaacatcgggggagcttcagcagaatgcattacttcccttcatctgaagggacaagacatgggaccaaaagaccagatatgacagtgtgtgcctatgatcccagtgctcacggagaaactgaagcaggaagattgtgatagactctaggcctgcctggatacatagttaacttccagacagcctggactacatagaaagactttgtctggaaaaaaatgaaaaatgggacctgaagagatgattcagtggagggtctgagtttagttcccattgcctacatcagagaaatcataattactccagctccaggggacatcacactgccttctagactctgccagccgccactcccatgtaaacatacacatgtgcacaaagatatacttgtacacataattaaagtaataattttttaaaaaatctttaaaacaatccaaacagtaacaaagcatgcgatagggaggggacagagaaggatgagggttcatatcaccaaggcctagcacatgctctctgggtagaggggaagagtctttggcagcatctgtatgtgtagaggcagcttgactctgttctcagactccctcatctcatgtccagtccgccctctggtgctcccctcccagatgagagcccaggaaattcaatgtgtagattcagcctcctcgtggaacagcacagcatgtttcagccctggacctgggagaaggggacaaacagaggcagaaagaattacagctcatggcatgttggaacagtgtgtccattcttctaattgacattttgtagatgagaaaaccgagggccaccaattgtggtgaaccagtgaatgtctacctaatgaagaacatacttgagaacaaaggcagctgacctctgctctgatggccctcctctctgttgtcctgggaatcatgagttggaaacccccattagagtagacttggctaaaaggagacagctagcctaccatttcctatggctgtgcccagaagacatcactaattgatcacagatgtctttcctactgagcccagaaattccttcagactctcctgcactaaagatgatctcatcttgttctgttatctaattcatataacatgatttaataactccaaataaagaacctccgactgtttgtgatgtaaaattggtaaaattgtctgcaccaaagcttagctcattctctggagtggcctgtagagtttcagtttgctagccctagtgactattgggagggtatttatagattaatttgcttgaaggttagtactaaaagtcctaatccctgggggtttcctttttctcctttcaggtggacaggacggaggtgattcgtacctgcataaacccagtgtactcaaagctgtttacagtggacttttattttgaagaggtccaacgtctccggtttgaagttcatgacatcagcagcaaccacaatggactgaaggaggctgacttccttggtggcatggagtgcacacttggccaggtagacagaagatgtcttttgtctcctccacttcaggccttcctcccctcttctgatccttgctctcttttcctttagtggtcattttctttaaactacagcatcttccaacatttcctaggtactgttatatcagttatatgcacaagagatcatgcaagtatatgcagttgcttcttttgtagagttaataaactctcatcctgaatgtcctcattgtgtcagtcatgtatacaacaaatgcagatccagcacttactacatccgctatccctgtgtctgttagagccacaccaccctgtcccatgacaaatttgccatctcctaaatgatctggaagattcccacacatagactgttcctcattcaaatttatgcaaagtctccggagacaaaagttaaaatgacccaagattaaatagatactgtaatttaacccctaataggaatgtgacatggattgagttcctttgataagggataaaaaagatccagagtgcttaagcgacctaccagtggttctcaacctgtggatcttgacccccacaagtattgaatatctgatatttacattataatacataacagtttcaaaactacagttatgaagtagaaataagaaaatgttatggttgggggtcatcacagcatgaggaactgtacgaaagggtcttagcattaggaagggtaagacccactggtgctaacagttcacccttgtaagtggcagagtcagtgctggccacaaagcccatcattttacttccactggcctttcctgtctatcccctctcaatctccttttgctgtacccagagtgcagtggagcatttgtaagaaataagtcaatggtttagactcagttcaatctcaaaatgctgagagctggctttttattggtctgagaggttagtgtcctcaaaccctgtggctagggacccgagaggacatgagaatgagccagttgtgcggagtctgagaatccggtctttatgttttgggttggtgagaagggaaagagaggtctggcatctccaagcccagaagctgtttttctggatcaagtgttccttctgaaactgcagagtgaaatataattcaggttttctgtttttgcaacatcagagcccagtgtatatgaatattcagttggtgaatgctttcaagaattctatggtagctggtttcttgaagccttgggcccgtttaatgtcgctggtttgggggtacaggtttcctttagaagagagggatcaaagtacaaaacctgttctgagcctccaaaataattgagctgtgtggaaaatgaaagtgcagtccacgtgctcaagcgcatcactgtgtgtcaggttctgggcccctaccctagtgtgtgggccttcaggaaatggaccaaactttgtgggaaaccaaaaataaaaaaatgtggttcagggaaagcagaggaaggaggggaactctccaggaagaaagttgtgtgaacaagtttgaaggtcaggtgagtgtgccaggggtgtggcttaggagagcctggtgtcagtgagccaggccagatgcctacttcctgtaaaccactaaagattgaacttcaaagctctttgcagcccaggcctcctactaaggctatggggtacattgttatttgtagatttgcagggttttgtcacaaagagggactccaaattatagaagcctaatgttccagcaaacctacattcccttcctgcctcaggaagggaaaactctgaggaaaagtcagcctagaaggcaagcctctgtgttcccatgtgggtgcttgccctcctgcaagccacttgctggaagacatttctcccagtggaaaagagaggtgactcagaatgcccctgttagccttttccaggaaatacagtgctcgccttcacaggaacacactatattcccttaaagaacgccaaaggccagatgcagaaattctcccaaggagaggcagagagagaaataaaggataattaatagaatcagcctgaagacttctcaaaagacttaatgatagagaattttagaattttgctgagacagccaccttttcggtacaaatgaaatgaatgacttatggattttgtgtgtaactttgtttaaggtttttaaaacaagcggtcagctgtaaaaattatatgtatgggaacctttagatgaactcagcgggttgaatttatgtgcagtaacacacacacacatgcatacatgcactggtatgtttatgtgtgtgtgtgtgtgtgtgtgtgtgtgtgtgtgtgttaatataataactgaagaagaattcatgaatttgagagtgagtaaggagatagcagaagagttagttgtaggaggggtagaaatgatacaaaacaaggttttaaaaatgatggttaaaaaaatgatatcattatatacttcagtgagcctttccaagattctgcctcagactctgggcttcttttatatagatataagttgtatttatcacaggaaataaatgtagatctatgtagaagtcacaggataaatgtctttttcattcaattttttaaaaataattttgcctgtgaaataaccctgaactttagttccttacaaggttcatatttccaaacaccagcaggtctgcaaccctggtttgcactagctattgcactagaggtcaacaatataaaagcaattgaagacagcatccctgtcttcaagctggtcaaatctagtttagttgtagttggggaagcaaagggctgagcaggaaaattacaactattacaaggaattgcagaatataagcctggtcactgggaggcattaggtgtgtgtgtggatggtggtagtctggagtaagggtttccaaggacagtggcatttacactgaaataaggagaagaaatcacatttccccactgatggcaggacaacatacaggcctctagatttaagaatgagctggccattatggtaaagagcttgtttgcttgattttgtcaagacacgagctccgaaatcaggggcgaaaagagtcgagacaccagaatggcatgaagaagcaactccatggaagaaaaacagtcctcaaggatgtatggtcaagccagccaccatagtgcatacttggagctgagttctattaggaacattctggaagccagtgcatagaaacgtcagagtttgcgccctagggatgaggaaattggctttttcacactctggctgaatctgttctgagcagtcattggtggagggctgctccaaggctggggacgtcaaactcccagcattcctagttggctgcctgggtagcaaaggaggctttaagactggtggaagcttaggcaaagaagtgttcagtggctgatggtcagaagttagtaacttggagtcacttcgtgggcctggcgatagaaacagaagctcatatgcgagttcttcagttcttattacggcttgccatgccttgatcatctggggatcattatttttgccatggggccctgtagagaatagctccgtctctaactcaggagggaatcctgactaagctcggctgcacttctcacccctccgcctgccagagttgtggcttagggctatgcctgtggccagacctaactagtaaagcatgagggtgttatctgaaagctcctagcctagagacacaaagactgtttttctctttgcctgggattcctgggagattgtggtagtcttgcagcatggcttggggtatgtgtagccctcagggcacctcaagctaaaaatcactatggaggcacagggttgacatgcagcccccacccccaccccccaccccaagccaactccaggtgacatgttggcctctgttgatgacaatcacctcattattggccatgagattagtagaatttgctttcctgacacatatgtattcagcatcacttggcttcaggcaatcaaagcatcctttgatgatgatggtggtggtggtggtgatgatgatgatggtgatctccttaccaccagccactgaactttgtctgattctagggtggttggtttaggggaggcaatgtaacattcatgcatttacttagtcattcagtaagcatttaccaggttccctggacatgtcaaatactatgcttggtgctagagatacaaacacaaagcagacagagactctgtccctgagaagctctgtaattacctaggtgacaccaacctgtagataaatgaccaaagtacccatggttaaatgctacaattaaaatgtgttccaggagttgtagaacaaagacttgtctgtccagaggaaatcaaagagaactcacaggaacgatgactctgaacctgaaacatgaactcaagagcagttcaccagcacaggaaataaagggactttccaaaccaaatgagcagaacacacaaagacacagtcacatgggacgttggggtgatggcagagagacctgaagagactgggtaagcagtcagatgaggatgggaagaagatacagaggcaacacctgtgaggaagagttgggccatgcagccttaagtgcttagacttgatgcactgagtccttggtaaccaggggaaagacgagattggatgcaagtgttagaaagagcacttcagtatgctcatgaaggctgcgtgggaacagagggatgtggaggcaaggatagcacttaggagacccatgtcatcaaaggcgtgagggggaaccacagtgaaggagacccagaggaggagacccaggggagagtctttggtcagcaagtttagaagagtagggaggggggtgactgcaaggtaactaagaggatcacttcacgctccctgaggagaatcatacaaggaaggggtggggcgccctgtgtgatactgacctaactacgctcaggactttgtgcagaaaacagggggtagggggggttgccagtggctgctgaccacttgagtgtggagtaaaacaataccgcgttagcagatactcctgacagtgacagtgagtagcaccgaagtggtcagcgagcccgggatgatgcaggttttcatttgtggaaggggatctgttgagcttaccatgtttgaatgaagcaaaggattgtttaaagctctctggagatgaaggccaccctacttcattgtctttcagagaagggaatgaacttgacgtcttaacattgtcaacaaaagcctttctttgttgagtgtcctccggtgcattttccctgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacccacccccaatcccctacccacccactccccctttttggccctggcgttcccctgtactggggcatataaagtttgcaagtccaatgggcctctctttccagtgatggccgactaggccatcttttgatacatatgcagctagagtcaagagctccggggtactggttagttcataatgttgttccgcctatagggttgcagatccctttagctccggttgcagatccctttagctccttggctactttctctagctcctccattgggggccctgtgatccatccattagctgactgtgagcatccacttctgtgtttgctaggccccggcatagtctcacaagagacagctacatctgggtcctttctttttcttcccctcaaaatatctgctctctcaagtatgaacaagcaaaacaggaaaaccactaccacggtccctcttgacatctgtggtggtaaaaggaggtgttttttgtcatgtatagctaaggcaggcaaagaatggctagatgtcagctgggaggatgacacagccggtgtgtcccaggtggctccttaaggcttgagtataagcgctgtgggctgtactgtttaatggatcctcaatggcctcaagcattctctctcagtgctcccaggttctctgtccaaagacaaactcttcccactcttaaagccccatttcttcatctaccaatagagagagccgtattgctgagccttggcgatattgtgagggttggtctggagggatagctcagttcatgcaagcataacaggataacctgagtgagatcctctctgaaccattggaggagaggagcctgagtgcgggacatgaacttgtaattttagcactgggaaatggaggctcaggagccaaccagtctagcccagctggtgagcttcaggccagcgggagaccctttctcataaaacaaagtggacagctgcctgagaaaatggcattcaaggttgtcctctggcctccatatccatatgcatgtgcacatgtggaactctcaggtacacatgtctatatatatacctgcacacacaaatattcacctatgaacatacatgctcacatatgattacccacacaatcagtgagtcaatacataaaaaatgctgagctgagaccctgatataaagaaagcacttggagtgttgttgaagatgtctgagtgccgttattcatgtggtgaggatctagggaaagatgggaagggtcagcctcgtcaagggaaaggaagagttataaagaacgagttcccatgacctgggcagccaccaatactgaaagtataatttcagtttgttagtgatctcatttcatccagggattcaaggtacacattggctcatgtgaatgcttgccctagcatcagttcttttaggataatttgtgtgtggtggggagaggatggttttaaaacagaatgttgaagcctgaaaagttggcacactcctttaattccagcaataactagagacagacgactctctctgagttcgagaccagcctggtttaaaagagtgagttctgcaacagccaggaatacacagaaaaatcctgactggaaaaaaccaaaacctaaaccaaaccaaaccaaaccaaataaacaaacaaacaaacaaacaaaacaaacaaataaaaacagaatgttgcaataatctgggtagttattctaacccttaacccttatcttactagaactaaagcccacaggaaacaaatgaagtgaattcaccagaactacacaggaaatcacatgtgcagcctgttccctaccccattccccaaagccctaggcttccacaggtgcttggggggatttgagtttgagatgtgcctactctgccatgaacagccggacttttgctttacagaaagaaaagctgcagccctcagcaggctaggaactggcagactgtgcagttgggttcaagcacagcaagtgactgactgcacagagccaaaaaaaaaaaaaagtgcccaatgaggccatggaaggttcatgtcctcagagaggcagagctgtacattctcagcagatgggagaggggggtgagtcacaaggacacagagtgatcagaaagctgtgctttccttctgggttcctaggaactcggagagcatcctaccccaaactagatgcacagctaagccatcttgtgctacaccctaccaagggttcaccagaaaagacaggatacctcaccacctacaagagtgagctgccccttgccctggcaatttcatgtcccttcttcttctgttgtttattcactcattcacccatttctagatgtccacctctcttcacacaccaaggcaatgaatgatcctaaggaacaaagatgacttcctcaagctgcagggatagggagttactatcccttaccacctcaggacccagaattgagagacactggccgctactgttactgacattaagcagttgagagaaatgagagcaagaggacaggaacattgtcgagagccacaccgacctttatggttctttccatttattctagtagctagttcatcactaaatagtatacattagaaagcagtattagtgcaaagccaagttggagttgactttggtagtgtttggtggacccttttctctttcagttaaatttgttttatggtttatacagaaggaatatagatgacctgtaaacatttttttgtacaaacatgacattagttatcctccctcagaaaggacatttgctttaagaatatgatatagggactggagagttgactcagcaagtaggaacacttgctactctcagagagggcctgagttcatttcttagtacccacgttgggcagctcacaacctcttgtaactccattttcaggggatccaagatcctgttcagtatacacataattaaaaacaaaataaatcttaaaatcaaaagacctcagcatggctctctgaaaaatgttggagtgactgccaatgtcttaaaggcagaatcgtacaaagtcaccacccaggggcatccccacctggccaggattccttctgtgttcagtcatattgaacataaacattgcctaagttcttagaggcattttctcttttctatgggtcagcaacatttacattaagtcccccttctttattgccatgtggctgcccctcagtgtattttattctccagaatttatatctgtctgttaaaactgagaactccgtctgtgagccatctaggggtgctggtcttggtggcacagggttctttggctcctgtttgtaacagaaggatagcatactatgtgccacatgcatgcctggtgcctatggaggtctaaaaagggcatcagttcccctggaactggagttacaaatggttgtgaaacaccatgtgggtgctaggaatcaaacctcaggcctgtgctggaatgtccagggcttctgatcactggcccatctctccagaccctgatcccaaaacttataaaaatgtagattgattggcctatcctagagtgtctgatcccaaggatctcgtgggagacccatggtcagaatttccaggttccctactgacaccccttctgctgcaccagagactacctacactctgagaagcctgtacctgctagcgagtcagactctatcaatagatttagtgataaaataaaccaatgatgtaagaaattatctagagaagttaaggacccagaagcaagagcttatcatgaagttaacatttgtacaacagagtctgtacatggctcatgggttatatttttgatgtgcatgcatgtgtgtgtgtgtgtgtgtgtgtgtgtgtgtgtgtgtgtgtgcgtgtgtgtgcattcaggtgactgttgtaggggatcagtgcttgtgtatgtatgtgcttgtagagatcagagaacaatctcagatatcattcctagggcaccatataccttgctatttgagataacatttcttacttgtctggaactcatcaagtaggcccagctgactggccaatgagtgaaccccaaggatccacccttgtctccttttcctggtgatgggattacaaatacacactggctttttttctttcccacccctcctcttcttccatttgtcatgtgtgcatacatgcctttgcatgtgtgggggtgcatatgtgtgtgtggaggagcatgatcatccatctgcatgcagaggctcagagatttgtgttagaaggcatccttagttgctcttccatgctacacactgagtcagggtctatcattcaaatatgaaactcacccacatggctagttcccctagccagcttgctcatgaaatcccctgtctctgccttctgaaattgtaatttcagggtgtggtcccacattctgccttgccactggggtgtaggaatgccacttgggcaggtgaaatgggaggccttagactgcattttccctacaccgacatcgggttctgggtttatgggaagggccaatgcaccactcaggatgggatagcatagccttgggtgggggcctcagcctgagtgagaaatgacataggctgaggcagaatctggggttccctgactcccaggtgtccagtcactgctggaaacaacatggagttgggaatggaggggggccacaggcctgtgaggagcctaggaccaggagtttccaaactcccgaatatccagatgcagctggaagtcagggggagttgggaatggagtaggcccatgggctaagagcctggggctggaggaaggggaacaccagcttgctcagtggtagagagtccagaaatacagaaggaccttctgcagttcagtagacaaaggctttcaccattctccccatggctggtcttgatgagagagacagtccttggtttcaaactgtttattgactgttcatcatggaaaatgagtgcatgccacttcctcagggtggaccagaggttgaataccttttggaggaaggactgtctggaaagggaagcttattaactaagccctcagggccaatctagatacctcattagcatggagaacgttgttgtgatctacttgaccattgatcaggtccctatgtgaggagtgccaggtcaaggatctggtagggaacagagaaactcctactgtcctcagatgggtgccgtgccagggtttctgaacctactcaaccttaccaagtttcctggcatgatccactgccccacaacagtatcatgcccaccccgtgttcacttgggtttcatatggtctaaactctggtccacatacttgccttgcaagctctttaaccacaagacatctcagcttgatggagatcttggctgccactacgtatttctgctatccattaaatatagtcaaatggacctattatccagacaatgggttttcttcctgacggagatggatgtccagatgatatcagctcaatggcccttgaaaagaccgatagatctcaagttgtcacagtctatgggaatttgatctagggtcaaagtgtctccatttgtggacgccaaaagtggcatctgaactcactgtcatgcctagagcaagattctaagtcattttgttcaataatatctacttcttttgtgcattaaaaatgatgcctggggaagttaaatttacatattacagcaagcaactcatttcccctttgtttctcagagacaaagctttccctaattctgcagaaacactgcagtggcacctgcatgagtgagtgatgtcataggtaagcatcattccttcagttcccctgatgctgtggaagcctggcaaacagtactgctctctagtgttgatgctctgctcacataggatttggggtacttgtggggattcaagccccaacctctccaaggacaataaaatcctttctttcctttttttctttgttagctttttcaagctagtaaccttaaattcaaactctaggaaatccccgcttcctctggaagtcttcccttagagctttgcacctcctttagagggtctgcaattggagtcatgcactgtacatcaggtggctgccacccaggccctatatggcttttgccaagctgtttaacatctctgtgacatgtgggtcatggacttcatctatctgttttggaaggttggggtcaactcctttctgagttccttcccatccagtcagtggctgtcaatcatttcttgcctttcacctcggaaacaaagcattttttttctgtactcattcatttaaaaagtggtctcccaagtccccgccacacagcccacatgcacccctacagcacatctgtgactcagcggttccatgatgctaagtactagatgacattgagtaacagacagatggcattgctctaccctagcactctgcttccctagagaaagcaatcctgtgcccattccatttcaaagatactattaaaaagatacatgcagtggcaatttaaatgggattatgtttacgggccctatttcatatctattcagctatttaatacctgtcttagccttatttgatgcagaggaggaggctaagacagctgggactgaaagacagtttgcaagaacttccacctcagtgccgaaaaacagctccaggtatttgtcctggccttaaccctttaagccaggctggtacaaagcactcagcacccagactagcttacccaggcaaggaaccacttagtgcctacacctgagtccacctcagcttctgctttttcattcctaaccagctttccttagactctcgagtccatgtagctcagaactggctatccatgcagcctggccctgtctctgggatgtagcacacatgtcccaccacctgccactcatctttcctctgtatgtgctgtcttttttttttttttttttttttttgatggtcttcatctcagagctctctttttttttttttccattttttattaggtatttaactcatttacatttccaatgctataccaaaagtcccccatatccacccacccccactcccctgcccacccactccccctttttggccctggtattcccctgtactggggcatataaagtttgcaagtccaatgggcctctctttccagtgatggccgactaggccatcttttgatatatatgcagctagagtcaagagcttccggggtactggttagctcataatgttgttccacctatagggttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaatgtaatccattatataaacaaactcaaagacaaaaaccacatgatcatctcgttaggatgcagaaaaagcatttgacaagatccaacacccattcatgataaaagttttggaaagatcaggaattcaaggcccatacctaaacatgataaaagcaatctacagcaaaccagtagccaacatcaaagtaaatggagagaagctggaagcaatcccactaaaatcagggactagacaaggctgtatgtgctgtcttgatgcccttctcagatgtcagcatcccgagtcccagataagaatacactgcccttgtcccagtgtggagccggaagccactgtatcaccatgaacagccttgtcaataggccagatcactggtttgctaaacctcagtaaacaaagctctttaataaataatgtttcctctcaaaccattctcataaaaaaaaaaaaaccagttttctgaactacaaattttaaccttataaagtttgcttcaattatgttaaaacgtgaatatttctgacttcttcaaattatgaatgaaatttaggtagtgttgatgatgcgcctttcagaatacctaacaagtcataagaatattaaacagtgtctcatattttctttcaaaaagggagaaaaatatggtggtggtcagtaagcttccagtttgctcaaaggacaaaggctagggaggatatgtatctaggtgctaatgatggtggcttcagggttgtgagactatagctagtgtgtaatgtctcagctgtgtttctctatactttttacaatgaatatatagtgcaattatgatttaaaaaaagtacaacaaaggatctcaggagttcatgagttgtgtgtgccacacaacataagggctggagtttgggtcccaggcatatacataaaatccaggttaattggtgtctctctataatctcagcactagggacaaaactctgaagcttggtggccaggcagaccagactaacagtgagctccaggttcagtgaggccctgtctcagaacaacaacagtggagagcaaaccaggattgtaaaataccacagtggtcaagtaggactatcatcccttttatttatttaacagaagaacttgtagtctctggttggctcgagggtacagttcatgtcttacttattgttttattgccctgagagacaccatgatgaaggtaacttagaaaaggaagcatttaattgaagacttgattatggtttaagaaggtcagtctgtaattatcttggtgataagcagacaggcatggtactgaaacagtacatgagagctttacatcgtgatacactggtttcaggaagagagagaaacagaaacagagacagagagaggcagagacacacaagacacacacacagagacagagagacagaggcagagacagggagagagacaggcaggcagacagatgatagacaaacacagacatgtacctgtatacacagagagagagagagacaaagagacagagagaggcagaaacagagagagacagagactgagagacagagagacagagagagacagagatacaccaagacatacagagagagacagatggagagatggggaggggggggcaagcagacagatgatagacagacacagacatacacctctacacacacacacacacaaccatataccacacatattcacgcaaaaaaaccaaacagtgagtattagtaaaaacatcctgaacatccataaataagcaaaagaggatgggacatacattataaagattcttaacctccccacctcccacatatataaatgtccatgtaaatgcaaatacacatgcaagaactacagagagagagagagagagagagagagagagagagagagagagagagagagagaaagagagactcttaaaccattgataaatgtttacaatatatgcagattttcagcccaggatgtcagtagaaaagtctctggagtgcattatttgtaagatttttgagaagtcgtcctaagatgcttttgagaaaaccttggtccccaacactctgcccatgggaagcagaaatgacccagctaatctgattctgagcttttgtaatattacttttggttaccgaagagacctaggaaggcccaggacactaataacaaatagcttaagaaaccagcattgcctctgcaaaggggttgtgagattctcccagagctgatacaagctgaatttgagaaacataatatttgtattttgaattaatctaataaagtttagaggaagaaaagttacctgcttggtttacaaagtcactcccaagagtcttagatttagatcccaggacaaaatgaggccaggtatgaattaattagccttgcttcacatgaaacgtgggcctctggggcttctctgtgcaccagtacaggtcgtccaaggtgcacactcctgagtcccagctcccaaaggcccagagtaagctgactccagccctgtctcctacttccttagcatctgcccacacggaggctcagggcaagactcttgacctcactagtcagagaaatgaaggagcagaaatcctgccaacccctctcccctctgttgaaattcaaagcaagaattctgctgttacaattaatttgctgacagggccctagtggaatcagacatctgagaactgaggagacaaagctctcttcccgctgaggagtgtgccctcttctgaacacttctgtggaaggggactgtacactctcatgagagagacatataatgagactgtaccctgtggttccatttgcctaggccatattaacttaaacacatcatgttgttttaattaaacacatttttctttcatttttaaaatgccccactttgaacaacataattttgtggctacttcatagtaataaatcgcttttgtagctgaccagttcagagagctgatcttaggtctggctggcacttatgaccctggtgctcttgatggtatcatagttatcattgctaccatcacagttgccatcatcatcatcgtcgtcatcattgtcatcactagtaccatcatcaccgtcaacactatcaccaccattagtcatcataaccatcacatcatccccactaccacagccattaccatcaccatcagtgctgtcaccaacatcaataattaccactatcatcaccatcactatcatcccccaccataactataatgttatcttaatcattattatcaccatcactaccagcagcagcagcagcataatgatcactaccatcattgctacctgtccaaccatcatcatcatcatcatcatcatcaacaacaacaacaacaacagcaacagcaacaactacaacaacacccaggcaagaacagaagcctgcaaactggcacagcaaaacttacatgagacatctggattcatggaattccaagatgctcttctcatattcctaatctatattacatctgccctgtttcatatccttaataagaaaactattaaaacagttttaaaatcctcactgggtttctctaagtgttagataaaaagaagagaaggaggaggatgaggaagaggaggaggaggaggaggaaaaggaggaggaggaagaggaggaggaggaggaggaggaggaggaggaggaggaggaggaggagaagggagaaaataaagaccgatttccattaaaccttattctatcatgaagtattgtgtcaaatgagagcaccattatctctaattgatagattagagacaagagtcagcaaccttggaagctcaactccttcacccaagatcacactggagtgtagctccaattcaaaattaagatgagttgatttcaacatggactctgtattccatcacatccctcaaatcaaatggaatgcgattttatttttaacgttatttactgtaatttatgtgtatggcatgtgttctgtctgtaggcatatgtgtgcactctgtgcatgcctattaaattccctggaactggagttacaggcagttatgagtctccatgtgggtgctgggaatcgaaccccagtccactgaggagcaacaagtgtttttagctgctgagccattctctccagccccaccctttgtaaacttaacccaaaatgtgctgttcttcctgaatgctgccactgtgaaagtagtcaggaatgcctagcatgggacactttattccacaaggtggtagattaatcgaggagtatttctgataaatattcacagatggagtgccagagagctctttatgctaagaaaaggcttttttttttcagacacaggagtcagaggatttaagcaacttggagtatgtttgccatgttcagtcgtggatatgttttgtccatatatttattcatctcttattgaataataagtttactaaatgctaacagtaaacacagctagtgatccacccagaaactttgcaccaacttacacacatccctctactacatcttaagtaatagctccaacatctcctttctgaatgagtctctctttgaagcttttatcatcacatgaatgagaagacagaccttgtcatgaattaaatgccaactcccccacatagacccttccccagccatagatgatcatggagaagacagaaggctgaatgtcatccccccactccaccatggacctggaggttaattccacactagtgggtttgtccaagggttgggggtaaagtacattatgatgatattgctaagggctcagcctagatggctggctcactcttagccctgccttctttccctttcttataatccatgtctgttctttcttttccattcattatttatgctttggagatttccaggccaggacacttcctcaaatatccaacaatataggtaacaactccaaggataactcacagacatctcagagccaatatccccaatccaagctcactgtcttctatcacccatccttcctctagtggggtccatgcagtgaatggtacctctatcttcccagatgccggagaaaggaaacctggaagccctccatcacctcccactccccagcccacctataatctgatcatgagaccctaatcaatcttcaattgattgaggtgtcttcaatgcctcacacacatcctttctacctctggaccccagtctaagtcaataaatagaggactgtaattatctctaagtagggactgactggatgggatagaaggcaagaaatcattttcaaagcacctgttgtctggttgtggaatcttgtaaatgctcattatgcatttgagaaatatgtgtgatagataatattatcatgagttcacagattaggaaactggggtacagctgatgaagctccttaaggccccacacctgggcttgcatctacagcttccttgcagttcttggcgtagaaggtatagtggaaggcccaacagtctaatgaacatggatgctataactcgattgtctagattcagatcccagattcccttactggctgtgaaagtctcagtaagtcagctttctgtcatgggctaaatgatagccttcacaacttttgcccatgtcctgtgagcatgactccaactagcaaaagcctttatcgtttgaagtgaatgatctcaagatgaagagaccctgagtgagccagacgagtcccatatccattaacacgggtctttgtgagagaagaggagagggccatctaaagaaaaagaagagtaaatcagttctcagggaaaaaagcagaggaacagagatgccaccagaagctggagggacaagattcagagtggcccaagatcctctgagaaaacatggccctgccaaccctttggtttcaaacttctgccctctagagctccataagagtaattgctcttgctttaagcttcaggtctgtagttctttgctagatggtcagccttagcaaactacaggctctccacgcatcagttctcacctgtgtgtgagcatatagcagtgctttaatggccatcatgagaactaagcccattagtacccacaggccctttatagcagcagctgccaaatggttgtatttagtttgactcttaaatagttagtatgtgacttttaactggtaacaataaggacactctgtctacctcaaagttgggttaacatctttcattttaaaactgcaaagtctatagagtccagctctacagactgccaatgcttgattgctagccttgccgtaaacaagctacaacctgccaaaggcagtggttgaaaagctgttgcctgcccttcccttttagaatgttatggactggacactgagctacgtgaacaaccctttcttctttccctgcttgcccatagtgtggcaggcagggtgggatgagggaccaagtggcttttgactagtctctatactgagtcatttgggatggtaatggagccatacttagtaacaaagcaaaggtgagtaattagtgctcagaaggattgaaaccttaaatccctctccttcactctaactcttgctaatgaagtcagagaaagggtaaaagcctgtaattacaccgaagtaattagaaccctacttaatagaatgcttaaggcaggaagcccaaaccaatagatcacccattgctaccattacctgctctgtccttctgaatcatcctccctaggatggtccatttaaagcattggttcttagcctccctgacgctgcaactctttaatacagttcctcatgttgtgacccctgaccgtaaaattatttttgtggcttcataatttcagttttgctactgttgtgaatcgtaatgtaaagacctgatatgcagatggtcttattgctatccctgtgaaagggtccttcaacccctaaagaggtcatcatggcccatatgttgagagccactgacctaaaggctgaagactatatttagtttgtctaagtggcacaggcatactgccaccatctctcctgcatgctcaagacagcttcagaattgtgtttttctagcgtgacttcatgatacccgcctctaattccagctactcaagagactgaggcaagagactctcaaatccaaaggctgcctgagctacagaatgagttcaaggataacctgggccacttactgagagcctctctcacaataaaaagtaaaattgaagtagaaggacgtaactcagggataaaaaagccttagctttatccccaaaaccaaagatgggggaggcaggttgtgcctctcttaagtgctacaagttttcctccttggtgaagtcccaccaggacaacttagtttaaaaggccctttaagtacacctttaaaatcggatcacattatgcactgtagtaagaatttggagatttgggtgggttttgttgttgttgttgttgtgttttgttgtgttttgttttgttgttgttttaaaacacagaaatattgtaagaatgtattttgttttaatcctaggtgtgggatgcgtggctgcttcaaattgtctacagcagctgactatgatttgcctcgtgctctaacaggggtgtgatttttgtcagctgcagatagttcctgtaattgtgtgacatttggaattttggggactcttcagaagatatatacatgctaggaacccccagaagtggggtaggttgttgtttggtcgttgttggtccttgttggtcttggttcatgagtagtagtgcacaaagaagaaataaagagaaaaagaaaatatatatcctgatggcaaaaatcaaacttgtcccaaggacctcaatgccctagtcaacaggaagtattctaataacaatattgcccccttcctgatccccaactttatttaggaattctctctcctccactaccttctctctatccttctttctttcctatctagtgttaaagggttgaatggttggaagaagggtggggaacggtggaagaaagaagaacccacaaagtagcaaagccagctacagtgcactgaagttatttgtctgactgtattcttactttctagttcaaagaaaaggagatggggtgtttatataccaagttcacccatccttgtttgaaagctgttcccaaaagtgtagttcttcccacttcctgttttgtgtatctgtgggcaggaagtacgagtgacaggcattttctcttcctaggtgactcagctatagtccagattagaccaggttaaaagtagataaaagcaggtttattaggagtcacctctagggtgggttcactgatctcaggggtgggtgtcagtgaagtcacacatccaggctaaagcaagggggttttacagagtgatgaagtgccagccaggagctgggattgtgtctatacatagttaaaaactgagctgctgggcggacactcctgggtgggttgacagaagcacagagatgaggagtgatggcaggttaacccaaagttttctccaaatggatggggagattttttttctgtggggttgcaggaaggagttcgttcaggtggtgcttaccatcttgtgcaggaggtgagcagggttccagcttaacattctgacctctttgggtatagggatgccaattcagatctggctacttcctgctgaagaggggcagagtggtgtgggagagtcgggagtctatggggtcctgctcagccgccaggtgtagaaggcttggttgacctttacttgggagaccatgaatctgtttctgaaggaagaggagcaggcaaggtgctaggagaaaaataaaagacagattagtatcatcagccctacaaactgggctggacatgtgaaaagtgaaaattgtcagaaagaatggaatggagatgtgtcctgagagagcagtctctctgtctctgtctctgtctctttctctctctgtctctctgtctctctgtctctgtctctttctctctctgtctctctgtctctctgtctctctgtctctctgtctctctgtctctctgtctctgtctctctctgtctctctgtctctctgtctctgtctctttctctctctgtctctctgtctctctgtctctgtctctgtctctttctctctctgtctctctgtccctctccctctcctcctctctctctctctctctctctctctctctctctctctctctctctctgtgtgtgtgtgtgtgtgtgtgtgtgtgtgtgtgcgcgcgcgctcgcgcacacatgccagagatccaagttgagtgccttctttcattattttctaccttatttgagggaacaaacccagaactcactggttgctctaggctagctggctggtctgctccagaatccaccttcctctgcctccccatcactgagatttctggcccgtgctgctgggcacagcttttagtacatgggtactatcgactggcctcgggtcctcctgtttgtgcaggaagcaccttaccaactgggctctctccagccctgggcactgtnnnnnnnnnnnnnnnnnnnncactgtccttcctttttgcagcttcccatcttctcgtgtgtttgctactacaatttctcggactacacctaacaaacaaaaacaaaacaaagcatcctggcagaggacagggaagctgccggaacctcttgggctttcctcttgtagagctggtcaatcttcctacagccacacttgatatctctgtgctcgaaggctttgggtggtactgactgtagaccaggactttgttctccggagcctttagatttggagacgtcctttctacggtttctccacccaccactgtttgaccccagggacactgtttgacacaagtcataggcctaggggtctccacttagactgagagatgggcaaagctgaattccaaccctatcctcagtccccctggggtgcctgttacgaaatttatccaaattgggactgtctcaggttttgagccccaaaacaccattgttctgtggcctggcttcagtaaatggctaccagagagcatttatttttattattattattattattattattattactactattattattaattactattacatattttctttatttacatttcatatgctatcctgaaagttccttgtaccctccccccactctgctcctctacctacctactcccacttctcggccctggcgttcccctgtactggggcatataaagtttgctagaccaagggacctctctttccagtgattgctgactaggtcatcttccactacgtatgcagctagagacacgagctctggaggtactggttagtcagagagcattcttgatgttagcatcctccatgatcttagatttctccttacatatgggcaacggtctgaactcccctctatccaggtttgttgggaaccacactctcatccctctctctatagccaatattttatggcaaggctctactagtaagtatggtcctgccagcggaccccattgcctccaaggactccaatcctgaatccaagtcccctgttttggccaagccccgcctccaactccctcgtcttcgcagcaacatacttatttcggctgcaatggcttctccgaaccaggttgttaatctaaccctccacagttatgtacaaatcatttgtctgcgaatttgattccaaattccagagtccgattcttcagcccactctgtcccccacatggctgtggcacgcaggcttcctttcagtttgccctagcaaatctttagaagcaccccctcctcctctctccttgctcattggacaacggcatactcactcccatatcagccccgcccactctgcacagtccagcctatcccagggtgaggcctcaatgctgctgtattgaacaccacagcttctccaacacaccttaacagcctgtccctccaggagctatggctttcttaagcctatgcctggttcacagaactgattttttcccttaggcctgtgtaggaatcttcacccacctccttccaacctccccagtcttcagcaccatgggtctccaaacttgatccagctcctccaccactccaacagtcccacccccttctcacagacaaggctctaacaaataaaacaaaacaaaaacaaaaacaaaacaaaaaacaaacaacaaccaaaaaaacttccctcctttcagcccagtgcgcagctacccctcccttcctaaagctaaattctacaccattggctgttgggagaagcagaatccgtctctcccagggatgagtcaccctcatttgttgtccaatgtagagtggtcagccttgattgcatgtacacaaagacagcaaaaactgactcagattgtatctatacatagtcgtgcatacacatacatttataactatatacatatacacataaatatcaataatataacaataatcaaagaaaatggctatcaacttgagtgtaagacatatgaggggttcaaggggcggttgctgggaggagctagaggagagaaaatgactagggaaagagatttaattttacttaaattaaaaatattaaaaatgtaaccaggtaatggcagcacacaccttcaatcccagcactcaggaggaagaggcaagtggatctctgagtttgaggccaccctggtctacagaatgagtttgaaggcagccagggctattcagagaaaccctgtctcaaaaatacaaaacaaaacaaaataaaataaatgctataaatacattttaacagatttctctccacccttgtagcgtatgagccaatgtttgacacatataagatattcaataaatatttgcaactgcaccgatttcaaagctgattataaaaagaatcctgagaatgttttcactacaagcagcctcatgacaaatgcatgtctggtatccaaatgactatttttgaaatacagctgattatacacttgctacaacactggcttgagtgtttattttcctggctttggtcctatttgcttaaataaaactccaggctttcctaaaaaaaatgaggtctgtttgtttaacattgggctttacggaacatggagacctgtgctgttggacactgctgttttccacactagaggagtctgccctccattgacccagggctggctgcagagcagattcttggtggtgcaaatgtccctgtgctccaaccttgctcacccaggggcttcagcttccatttgctctttctgggcatcaccctcctgcagcatgcaaaggtctgcagctctgaccctgccacggggtaaacggaatcaaattcaagaacttgtgacaggtgcacccccctttagccttgatgccaagcaaaccttattatttgctggcctcaaatgtcagctgcagccagggtgggtccttgtcactatgactttctcattctaaggcatgacctgaggtctcctccagcctggtgcaaagcaacagaatatgtgtgatattggtttgggggggggggtttgcagtgaacagacttctccataccccagcttggcacccatgctggttttgcctgagagctccaagaatggcatcaacaatgacaggccattgcatgtctatcatggtcaccatggaagctttgaaaccttaatgattattcgtccttggaagctgagttggaggcctagagagtataaagtgggttgttatttggtttggttagtcacttggacgccaaaggcccactttctagccctcagaaggcaggagatagtgcacagtaactggttcttcacatcctggactgcaatgttggttgtgtctgcataagactgggcaaagggagctggggaaatggagtgtcaccaagggtgaggatctgagttttacttccagtgcccaagtgaagaaaataaataaaagccaggagtggaagtatacatttataatcttgagaaggttgaggtagacagatctccaggtatcactggccagccagcctagcttgactggtatgtaccagacccgtgcgagaccttgtctcaaaaactctcagacaggattgccctctgacctccatatgtgcatgcagccaggtacatgtgcaacttcacacgtaagaatatgcacacccacactcccaagactgaagacaatataccacggtccaacttggctcccatgtgttgacttctcttacatttgcttgaagcatggaaatatggatcttgtaagacgcagcctgtggggacaatccatctgcacctgtgagtgactagtagagtccctgaaggtttgttggaatcaactggaacctgggtaagaaaccaatgtaggcaaaacacaaggaggataggaagaaatgcctctgatagcagattaacctggaaaatgggaaacgtctcccgtcagatgttagcccacttgctgctcatagataatcagtgtttggtcattttttattatttattagacattttctttatttacatttcaaatgctattcgaaaagttccctataccctccccacacccttctcccctacccacccactcccacttcttggccccgacattcccctgtactgaggcatataaagtttgcaagaccaagggacctcttttcccaatgatggctgaccaggccatcttctgctacatatgcagctagagacacgagctttgggggtactggttagttcatattgttgtcttctgtgaggctatgccagtacctggcaaatacagaagtagatgctcacagtcatctataggctagagcacaggtcccccaatggaggagctagagaaagtacccaaggagctgaaggggtctgcaaccctacaggtatttggccatttattcatcttgtgttccccaccctcctgctgcaagactcattggaagaaactctgtgttccgtgaggtcaagtctcgttttgcttgtgcctattcttgatgtctggcccaaagtctctcatgcagtggtgagaagatgcctacagagttaagacatctgacgtagtggtgctctctgtaagtgggaggcttccttggagctgtcattgcagctaccattggtgtgaccagcaacactggtgtgaccaccaggtagtttcatgttggaagtgctctctactcttcagaccacagcccagtgatcaccacaagcacaggatcctgatggaagcattgctctgctcagcccgggaatgtcatttctaggcttcttcactctgactagaatactgatttttcagtactctagcagggagacaggaaacacaccatatgagaatgggttgtctcccaacctcacacagtgcctttctgtgattaacaaaaagaaaacaattacctgaaaatgctataactttacaaaagccagtctttatcatctcaatactccttgtttctagaaccagggtgtggcttttctaggtcttctagataaggacctatcaaagatgaagttagggtgctactgtccctgggatcagcttaggggtagatttcttcccatacccctgagctcaactgaaagtaaccatcagcccctttctgcatgaggctttatacaattcagttatttgtgtcccccaaaatagcacgagaaatgggagttcccaaccacatattctctctccactctccaggtgtgctgatgattagaagctgccactcaagggaggggctcacacaatagcaccacaccaggaagctagcatcactggggaccgggttagacagaggccgcccatcaaagatggtgatgttgcttcccttaagcacaggcacagcaccatctggactctcttaactttttcctttgggcatggcttatgtacacacacacacacacacacacacacaattgccactgtgtcttaccacgcttgcctttcacagtagaaaaaaaggtgggggcaatcagagggacaagcaagttcttctaagaataacttcagtgtgatgatgtagctgtccctgcatgcatgcagacaccgggtcatgaagagcacccaagttgcttgtctgagcattggtttcctgatgagacagatagctccctgatgtatatattgaaaatagaatccagaggttacagacccagaagttacgcattttcacctcctcctcccggcacctactttgcaaagatttgatgctaatttcagacgattccaaaactttgttcctgttaacttgatgttcacgttccacactgccctcctcgttctgatatgaacgtctcagcaacaattacaccacctcccaaatgagttatctaaatcccctttcttccagcacacacagaaggagaaagcaggggctaatttgtattcagagaggcccaggaacaaggccggactcataagtggacatagatggtttcaggtggagctgttgtcggtgaagcatcttgcagaggagaatggttaaagatagacctgaagtcacatacatagcatctcttctttctgtttccttttgcagattgtctcacagagaaagctctccaagtccttgctgaagcatgggaacacagcagggaaatcctccatcacggtaagctggccctgtagtggcaacaggtgtcagacactgtgcactcaccaatccaaaagggacactagggtaatgtctcctctgcctgctgggaactaactgactacccctggctcctctgtatgtctttttttttttctgccttccacctttttctttcttggtaaactattttgatcgttttacccttagagaaaatgggaaggaaagtagatttgaatgggagatcactcacttcttactgagagtttctgcaatcacaagatagagtaggaaagagaaaaaagaaaaaagttaactttgttgaacacagtgagaatatggaattgactaggcttttcagatagaatctctctctctctctctctctctctctctctctctctctctctctctctctctctcttattctcctattataatatttttgttttaaaaggatttagttcatggtttagtttgctgcccaagaagaggctagcctgagcagtctttattaagcaacagattggagctctgttgcttggttctatagacagtaactatttcagcaaatttagtcccggtttaaaataaaataaaataaatgcagctcctttgtgacactgttaataaataaattgaccaaaaatgaatgagtctagtgacttgttaaagaaaaggcaagtgccttttaatggttttgcttgtttgtttggttttggggggattgtttgttgtttgtttgttgttttgagacagggtctcactatattgccctggctgacctggaacttgctatgtagatcaagctagcctggaactcagagatatctgtctgcttctgccttttaaaggctaggattaaaagcatgcatcaccaagccaagcaaggaagcttttcttagtcactcctcttgatagctttacccacagcctgggccccatctcatatttcatgcccagggtttgaaagtttgtcaccctgctgctgtgtattctagtgagctcctgtccagagctggaaatggtgtatgcatgcataaggaatgtggagaaacgtcttactcaatgtctgtgtttgctcatttagagatcaaagcgacccgaatgtgctgctaggctcctgggctgaacaactcctgtgtgcttttctcctaggtgattgctgaagaattatcgggcaatgacgactatgttgagcttgcattcaatgcacggaaattggatgataaggtaaaatggtctgcattgacctcactggaggaagtaataaagccaagacacacagtttaatcagattcttcctcgaagctatttttccctttcaacccacattattaaacatatcaaagacttcagagaggtctggaaggtgaggctttccccaaaatggagaggcagttaagaaagaggggaagggcctgtaattagtacatgaccatttggtaatactaagtcttcatttgtttccaaacatcataggtcagctgtgcccaagaaaatatgacttgttcccaatcatcagggccattctaaatggaaaaaggctgtgagggggtagaaggatcacacataaattagcatcggtgtttgcccagttcagagttacgagctttgcacacactgtctcattagtcatttgtacaattcccaggtgaggggtagtatgactgaaggtgaagaaagattaaaagatgagtaactaaactaagctttctccatgtcacagtccagagcctctgaataacagacaccaaggctggataaacacaaggattgttatctgcagaaattccagtgggttgcagaaaggaaaagctgggggaactgacaggtcatgagggaattccaacccttgaggaaagagaaatgagcaagcatggatggaaagtctcctagaatgccacctacaccaaaagaggagcagcaaagccattgggaagttccagggctgtgtctcccagccaaggacctgccttagtgtcccctatgcacttccttactggacagagcagccctaggtagcctggccacagtgtgaatgcaaagatggacattagagttcagaagcctataaccctcagccagctccatgccctacagaaagagtttacaaggtatttccatggccactgcatcctgatagtggtaaagctgaagatccagtcccatgtcagtctatgcccaactagttagtcttgtgtgtgtgtgtgtgtgtgtgtgtgtgtgtgtgtgtgtgtgggagagagagagagagagagagagagagagagtgcatgtgtacgttgtgtatgtgtgtgtacatatgtatgactgtgtgtatatgagtgtatgtataaatgtgtatgcatgtgtgtttgtgtgtgtgagtatgtatgtgtgtatacatgtatatgagtgtgtttatgtgtgtatatgtgtgtgtacatgtatatgagtgtgtgtctatgtgtgtgtacatcggtgtgtgtatgagcgtatgtgtgtatatgtctgtgtgcatatgtgtgtgagtatgtgtatgtacacatgtgtatgagtgtgagtttatgtgtgagtatgtgtgtaagtgtgtgagtatatatgtgtacatgtgtgtgaaatacaaaggttagacgcccagcttcacctgatcatttctatgatttcccttcaaacgtatccttatgccaaaggccacaccacatcaggaattattgacccacttgctctcttatttatgagtttattcctttattcatcattcatttgccaaaccacactgggtgtctgttagataaaggtgctagggaggggatatgcttcccttgctgcaacctggacagcatcttctaagttaaatacaaattaaaaactacatgagatataatgttatggtgatgtacatgatattttaattagtgtgtgaataagaatgtctgggatatcagactttaatccttataagccgtgtgtgtgtgtgtgtgtgtgcgtgtgtgtgtgtgacaatatttaaatattatccctcaggagccatgggtcttctttttcatgacaggctgtcccactggctcttagagcatgctgattatgctggattggctggccagcaaaccccagggatccacctgtctctgcatccgccgtgtggaaattgcaaacctgtcctaccaaatctagattttttttcccctcctatttatttttaaaaatttttgcacacgtgtatcttgattatatccacctgactctctctcttccaggcccctacccaacaaacattttcctcccaagttcatttcatctctttaaatttaaaaaaattatagcacagtgagtccaattactgctgcctatatgcacacagatgtcgagttaccactgggacatgggtgcttactagtagccaaccctccatacccacagcaatgctacttgatccccaagaagctatcaactgtcaatacaccagctaacagtgaggtctagggagcccctccctcttcaacattgaaatttgtttgttttgttttgtgttttcagacagtgtttctctatgcagtgctggctgtcctggaactcactatgtagaccaggctagccccaaactcacagatgtccacctgactttgcctgctgaaatgctgagattaaaggcagtgccatcatgcctggctcaacattgaatatttttttattcttctctcatatagtacatcctgaccacagttttcccttcctcttctcctctcagtacacacccacaccccaacccattcttcctccttttctattcagaaaaaatcatccctcccttgtatatcaacaagcatagcatatcaatttgcagtaggaccaggtgcttaccttcctattaaggctagacagagcagcccagtaggagaaaaaggatcccaaaagtaggtcaaagagtcagagatagcccctgctcccactgctagtagtaactggcttggttatgtgcagctcttaggatgacaaccacagccactctgaattcatgtgtggaagagccatgtcctgtctagaggagcacacttcccagtgttcctccccataccccagctcttacaagctttctgtctcctcttccatgaattcccaaacactgggggaacagttccccatgatagagatgtcttgtctatggccaggcactcttaatcactaactctcaacacttggactagttttgaggtcctacattaaccaccaccctctgcagcaagaagcttctctacccaaggttgagagcagctttagtctatgatgtaagcatgagtgcttgagtctatgatgtaagcataagtgctatggtctatgatgtaaatatgagtgctcgagtctatgatgtaagcatgagtgcatctcgagtctatgatgcaagcatgagagagcatctcaagcctatgatgtaagcatgggtgattgagtctatgacataagcatgagtactctagtctatgatgtaagcaggagagcagctcaagtctatggatgaggacttagagtgcagtttgacacccatttagcagaacaacatcgtttctcccctagggctatgacttcagtggccatgggttttaaccacgcttataggaccagacgtgaatttccttttgtagagcagcccccatatccaatcaagagagtcattggttaccccataaataatttgaccattattataaaaggagtacatcatgtctagtagtttggtattgcagcatggagggctcagtgctggataagatcatcaacgtccattcttccctccagcagtctgcatagcacatttcagctctatgaaagctagctgttgggtagagaattccctgatcggttcacaactaaacactctgtgctctgcagtcaaagtgggtggtgtcttcagcaatagtcttgccatgtagttatcacatccaggtttttacacaggttctccagattaaacacagtcctcatacatactaagatacacaaacacacacacacacacacacacgcacgcgcgcgcacacacattgctagaacagaataacacagtacaatccttttcttgcacaagtagaaataaaattagcttctggaaattctcaagtaagattcctttctagatttttgctttaaacagttttgcgaccacttatgtagtcatcagatatattcactggctagaaatcaatgactaaaagcatctgtcatacaaataagttcttaggctttagtacattagtaacattaaagtaactgatttctgcatatacttaaaaactgcagcttgactatgtggtggaaatgggctgtatgcagttcatacaagtcgcaggaaatctgaatctctgagccgcgagtaaccctggtagcctttcagcatttaaacaccacaggtaaaaaccacactgctctacccacctgccttctctgaaagatggtgagactctgagatgtgaaatgatttacctaaagcaacaaatacacactcaaaaaacaagcaaatgaacaaacatcagggacagagggtgacccagtgaagttcctggttcacatataaattagattgctttcaggaggtgggacccttggctcagagaatcaggaagccaggcaaaggaggctgggtatatatgctggaggtcagcagttgtcaaagggaggtagtatgtccctgcctgcttccataggagtccctaaacctgtttccatagtaaccctaagacagcttttctgctattctcactctctcactcctgaacaatgagatgctctggagggtgactgagcctccctgagcacaggagcacatgtgagaacccgagctcctctccctctccttgggttgctgtgtacaaaccttagtaatactcacctcactggcttcttgaatttggaaagtacatttctttttcttttttttttccattttttattaggtatttagctcatttacatttccaatgctataccaaaaagtcccccatacccacccacccccactcccctacccacccactccccctttttggccctggcgttcccctgtactggggcatataaagttttcgtgtccaatgggcctctctttccagtgatggccgactaggccatcttttgatacatatgcagctagagtcaagagctccggggtactggttagttcataatgttgttccacctatagggttgcagatccctttagctccttgggttctttctctagctcctccattgggagccctgtgatccatccattagctgactgtgaggatccacttctgtgtttgctaggcccctgcatagtctcacaagagacagctacatctgggtcctttcgataaaatcttgctagtgtatgcaatggtgtcagtgtttggatgctgattatggggtggatccctggatatggcagtctctacatggtccatcctttcatctcagctccaaactttgtctctgtaactccttccatgggtgttttgttcccaattctaaggaggggcatagtgtccaacttcagtcttcattcttcttgagtttcatgtgtttagcaaattgtatcttatatcttgggaatcctaggtttggggctaatatccacttatcagtgagtacatattgtgtgagttcctttgtgaatgtgttacctcactcaggatgatgccctccaggtccatccatttggctagaaatttcataaattcattctttttaatagctgagtagtactccattgtgtagatgtaccacattttctgtatccattcctctcttgaggggcatctgggttttttccagcttctggctattataaataacgctgctatgaacatagtggagcatgtgtccttcttaccagttggggcatcttctggatatatgcccaggagaggtattgctggatcctccggtagtactatgtccaactttctgaggaaccgccagactgatttccagagtggttgtacaagcctgcaatcccaccaacaatggaggagtgttcctctttctccacatccacgccagcatctgctgtcacctgaatttttgatcttagccattctgactggtgtgaggtggaatctcagggatgttttgatttgcatttccctgatgattaaggatgttgaacattttttcaggtgcttctctgccattcggtattcctcaggtgagaattctttgttcagttctgagccccatttttaatggggttattcgattttctgaagtccaccttcttgagttctttatatatgttggatattagtcccctatctgatttaggataggtaaagatcctttcccaatctgttcgtggtctttttgtcttattgacaaaattgacaaaaaaaaaaaattgtcttattttgtcttttgccttgcagaaactttggagtttcattaggtcccatttgtcaattctcgatcttacagcacaagccattgctgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcgcattcttctacatgataacaaccagttgtgccagcaccaattgttgaaaatgctgtctttcttccactggatggttttagctcccttgtcgaagatcaagtgaccataggtgtgtgggttcatttctgggtcttcaattctattccattggtctacttgtctgtctctataccagtaccatgcagtttttatcacaattgctctgtagtaaagctttaggtcaggaatggtgattccaccagaggttcttttatccttgagaagactttttgctatcctaggttttttgttattccagatgaatttgcaaattgttccttctaattcgttgaagaattgagttggaattttgatggggattgcattgaatctatagattgcttttggcaagatagccatttttacaatgtttatcctgccaatccatgagcatgggagatctttccatcttctgagatcttctttaatttctttcttcagagatttgaagtttttattatacagatctttcacctccttagttagagtcatgccaagatattttatattatttgtgactattgagaagggtgttgtttccctaatttctttctcagcctgtttattctttgtatagagaaaggccattgacttgtttgagtttattttatatccagctacttcaccgaagctgtttatcaggtttaggagttctctggtagaatttatagggtcacttatatatactatcatatcatctgcaaaaagtgatatttttccttcctcttttccaatttgtatctccttgatctccttttgttgtcgaattgctctggctaatacttcaagtactatgttgaaaaggtagggagaaagtgggaagccttgtctagtccctgattttagtgggattgcttccagcttctctctatttactttgatgttggctactggtttgctgtagattgcttttatcatgtttaggtatgggccttgaattcctgatctttccaaaacttttatcatgaatgggtgttgaatcttgtcaaatgctttttctgcatctaacgagatgatcatgtggtttttgtctttgagtttgtttatataatggattacattgatggattttcgtatattaaaccatccctgcattcctggaataaaacctacttggtcaggatggatgattgctttaatgtgttcttggatttggttagcaagaattttattgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntaaggacttctacctgtttggctgtgttttcctgcttttctttaaggacctgtaactctttagcagtgctctcctgtaattctttaagtgacttatgaaagtccttcttgatgtcctctatcatcatcatgagaaatgtttttaaatctgggtctagattttcggttgtgttggggtgcccaggactaggtggggtgggagtgctgcgttctgatgatggtgagtggtcttgatttctgttggtaggattcttacgtttgcctttcgccatctggtaatctctgaagctagctgttatagctgtctctgttaagagcttgttcttcaggtgactctgttagcctctataagcagacctgggagggtagcactctccttagtttcagtgggtagagtattctctgcaggaaagctctcttcttgcagggaaggtacccagatatctggtgtttgaactggactcctggcagaagttgtgttccactcactagaggtcttaggatcccttgtggaatcctgtgtgggcccttgcgggtgtcaggcgactctgctggcaaggtagcccggggctcgagtggagcggaaggggcttgtgccccaggtcaggcccgggtagtctgcttccctatgtaccgcagtctcaggttccgcgcgattggattggggccggcgctgtgttccactcaccagaggtcttagaatcccatggggaatcctgtgtgggcccttgcgggtgtcaggcgactccgctcacatttatttttctgattaaatgttactttgttcctctttgtgggccttgtcattaaaaaaaaaaaaaaaaccaagtgaatattcttcaaggtgtaagttttataacatggtgtttattaactagtacaatccacactaaaagtctggcaagtctccaataatttttaagagcataaagaaatatcaaaaccagatgtttgggagccattgtgggattcaccagcgagtgctaaatacttttgcaagccacagtgataaagcagtctgtccattcttcttggcagaaagttacttttcagtttcctttctgcagctcagcagagcagcagctatccaccaaaggctgaaatctttgaagtctgacaggcatttgtcattaagagcgagcaagtaaaataaattgcatttgtgacgggtatcttatttctttaatgtcgacacaactcacttagtggagagataggcttacacaactcacttagcaaagagataggctttatagcttcttttgttatattagcacacgtccatcatattagcaggctgttggcaattagcctaccatggaggcatacatatacatgctttggaacataaaagctaataggatcttccttctcctcccttccctgaggaagtatccatgctgctggagagaaactgctttttccactggtctccacatctgcaaaggttgtcatgacagactctattttaatggttccaggaacctagcttgacagagaggtagatgacgaagcaaatgtgtctctaaaatagaggttgtcaaacttttcctgtgcagggccagatggtaagtactgtaggctttgcaagccatatgctctctgtccctatcactgagctgtgtcttgaggcatgaagacagacataagtgaaacataaatgaagggatgtggcagtggttcagtaaaactttattcataaaaacaatggctatatttgtctctcatagcgtagttggctaactcctcctttactgtgatatgaaaactctgcttgctgtcctgtagggtcatggttcttgagtatggctgcctggaattgggggccaggtaagcataaatgatgggaaaattatagttattaagccactccaatgtaccagtactcaagtacctgacccatacgatccctaagatgctgactgtatttccaaaggtaggcatttatatttctaatttacacacagagcacagggagctttgcccacagacccaaagctgactaaccatggtatctagatatggcaacctccttccagttcttctctaaatcagtgttctggttcaaacaccactgctgtagatatgcactgttcattttgcttcttgtttctttaaaacatatattcttttataaaacacgcctgctaagtaacagcttccacatgattttttttttcatgcatctttggttttagctgactcccctctcctatgcatccacatctccctgcttccccttgcccccgctctgtacctttttcatccccatatcccccattccactttgttctgttatcttgtccacacctcccatttttccatggacctgttctagtttcctagcttttgtccacatgtctacacacaatgaactgtcagaagctgggggtcacaaagaaaagagagtgggttgtatgatggtatctgtctatctgatcctggattgttttggttgatatgctggcttctagtttcacccagttccctgcaaatctcccagcttcatgtttgttcacgactggacagaactccgttgtatatctctgcctccctttcatcatccattcgtcaactggtagacttgtaggctagtttgatttccttgttattgtgaaaagatcagatagaaatatgggtgtgttccaaattatttctgttataggatggggagtatcttctttttttattttttttaaatagacaattatttgtatgctaatctgatatacatactcaatgtgtaatgagcatattatggagattagtgttttcaactcttcaaacatttgtcattgctctttgttgggaacttttcattcttcctctatagttcttgaaactaccacaaatttcatagtcacccccacccagcagatttctttcacattggaccaaagtagtgttacctatagaatattaaatgattcactatagcaaaacttgtctaattggcctgattcattcaccttcatcatggtgaactgtctccaagatcactttaatataaagaaaactaaagagtccagattatggtgacctaacaattgtgcccagggttgtgatttacaatccatgaggatctgcatgagtaacttttttgaactgcttttgaggggtattgtttcgagcaatcaaatatactcctaaccatcactatcctcatatttgactagctcttcacagtattagtgtgacttctgtttttcctacattactcctagaaggcagcatttataagtttaccatgtgacagattcgtgcagacagctcttctacttttcccacactgctatagagaccagtgatcttctcacactgtgtgtgggaaattgaggctatgaccctgtgctcaggattatccagagcagatgtgatggagtttggatttaagagtaacgctaaagccacctagagtgtattagattttcagatgaatgaagccagagactgcatctgactctaccttttacgctctggtacactcacagtatcctgatgctaataacccttgtcagttaaagaaacagatcctgtaatacaggaatgatggagatggtttattctggagctaaatatgagggaccagggcctggtacacagggttaggtcttttcccaaatactatgtttcaatgagggatccatttcataaactctttatagcagccaagtttaaatatgtatgaaataaaacacttttcactatattgtcaggtatgtcaggtaggcagttacagcaaattagggggaactcttctattggcctcggatgctgtctgacagcaatcgaaccctttgattggtggatcaagaggtctgttcatacattcccaaggcttttccctgtagtcacaaaagatgttaggtcacgtacagaggagagcagaacatggctactaaatggggtaaaagatcccttcaggatactttggctctggatttataacattccaacctcttacacatcattgaagttctaattagtcgatcagccttggcagacacagcttctgtccaggaattcccattcatcccctgaatggtgttttctgaatgagaaataaatgagaagtgtgaaataaatgagaaaatttcagcatgcgtccaagtgaaagtgacaaaatactgaattatctggtagagtatatctagatttaccaaactactattgatacttggggaattgtaatatattcatttcagttgtaatatagaaaatgcccagaacatttaaattggttaatatgtctttactcattcattctgtttccctctccctccctttaccccgttggtaggatatttgatcataatgttacctctctctctctctctctctctctctctctctctctccctctctctctctctctgtgtgtgtgtgtgtgtgtgtgtgtgtgtgtgtgtgtgtgtgtgtttgtgtgtgtgtaaagataactttcaggagtccattatctcctactgcattgtgggtcctgagcaccaaaatgtcctttggcttgaagacaggcaccttgactcaccgagccatctcacctgcctttgagttgcttgtcttaaagatggggacttgtgatgcaaggaggagaatttttagctttagtttttgcttctcctctcaaaccttcccctgatagtttaaggattccatgcttttcacaaggcgtcccctgtaacccctcatacccggcatccccacctttcctctgtgcatgtgaactgacttactggagagtactgcatgtttctgcggaagaatccagactcagcaccgtaagaccaagctgtgggtgacttccaagaaaagaacaaggagatggtcctctggagtgaagggcctctcaagacctttgcaccctgtgttgtgtgacactgttcctagagagacatgataagacatctatctgctcatctcagatagggaaccattacagaccaaagtaaggagaccaccaaagtctgacctagtagaccaatgagttgtattggggttatttacaggaatatgggtaagaggttctttacaaaaaattattcaaagatgtctgcatcagtaaagcctaccccagcatgagtaacagctcatggaagctggaagcctggaaggcactgtactgtgcaacctgcaggaagcttagcaggttggaaggtgtcctttccaggtggttcagctggtctgacacttgtccagatagctctgctggtttctgcttcttccaggctgcttatcaaccttgagcctcttctcagccagtccatttatctgagactgtctctcatcaaacctcaatacttaatatcctcttgggaagagaccgggtctagtcaatttgctcaatttctggaacttcctgatgctattttgagttacttcctgagcttaacaggcttctctgtaggatggcatgtttcacctccccttacaacatcctgttgtgtcaccccctgtaaacattttgtcctaagatatcctgctgtttcactgcccttttaacatcccatgtcttgatgagcctccctccaagatagaaggcattaacctgtgaagaaactgctatacactatacagcaccttggaccactgagatagatttaaaaccctgaagtcttgaataaacctgttgcttctcaccgatttctttcttgtgatgtagtacttttattacttcattgagaacttcactcttatatacaatgcttctttaacttagccaccccctaattcttcctggatccattcatcccagtctatctcctctctctctctctctctctctctctctctctctctctctctctcatgtgtttaataaccaactgaatccaatttgtgggggcatttactatgggaccacacccttaaagaaaactgaatctctgccacttgcttccccaagccatcaactgtcaatagatcctcagctgatagagggggtggggaaagagagacagagacagagacagagacagacggacagacggacggacagacagacagacagaagattgcttataggtccctccccctctccatgctaaaatgatagactggcttgatcttacacaggctttgtgcaggcaaccacagctgctgcaagtcctcgaatgcagagttcctgttgtgcccagatgctgttttgttcaccctggccatccctgacctctgactcttaccacctcttcttccacaattgtccttgaacgtggagaagaatatgatactccacagacttttattctctgcactctgactagttaagagttccgtattaaccaccatctgctactcaaagaaacgtctctgttgatgtctgagagctacattgttctgtgaggtctcccaccaaacttctgtctcctgggttctcaggacagaaataaataatacaaacatcagattccaaacaccaagttatagatgggtttttggatttttttccctatctttctgtttttaacttatatttttctactttttccattttaagtgaaaaatcaccaaagaaaagttttaaattttccataaataggaaaaaagaaagtagttgatagagttcttccatggtggtcagcaattcttaagtataattcacaaacatcccccgaggggcagtaatctatttatggaggcaaagcaggagcccatgggcatataggaacaagctaatgtgccccacatccagaaggggaaggggaagagaggcggcaacaatatttttagaagtgtatagaaacagaaataggctgagaagcaaatgccttgacaagcacatgggaatgagctacaagtgtgcctgggaaacaaatgggccatttaggggtgaggtaaggtgtgtggggcaggctaacaaagcagacacctagacccctggtaagaggaagacagacattgccttcagacaggaatgaaaagggcagtactcaattctcgggttggatggggcgggatgcagagaaagtagttctctcctgcccatcttctctttctaggatattctataaaggttctccggcaatattcttttaaagaatatttgtatttaagtaattttcataaaatatatttctttcaccaaccaaagtttatttgcttattttaaatttgtaaaaaaatataatgctgtctgcttttctgtctaccacagtctttaaaaccattgccagtacaatactacttgaaaaaaattatgcacttttttatgaaatttaaacatactagctagatagtaataagctatttttaaagacttatgaaataattgtagaaaatgctgcaaaattatttttagtgttgaaattgtgtagaatatacaatacagagagtttttttaatcttcaatttaatttaatattttttacttactcactttatattccactcactgcccctgtcctggtcaccccctctcacaatccttctactgtgagtgggtgggagccccactaggtatccccccatcatggcacttcaagtttcttcaaggctaggcacttctcccactgaggccagacaaggcagccagctataagaacatatcccacatgggggcaacagcttttgggatagcccctgctccagttgttggggacccacctgaaaaccaagctatacatctgctacatgtgagcaggcaggcctagatccagcctgtgtatgttctttgattggtgattcatactctaagaaccccaagggtccaggttagttgaccctgttggtcttcctgaggaattcctatccccttcagggcttcaatccttcctcctattctgacataagagttcccaagctccatccactgtttggctatgggtgtctgcatttgtctgagtcagctgctgggtagagcctttcaggacaacatgcccctgttggtgtagttcaggagtctaatgtagatggatgagaggtgataggagggtggagatccccctgggatagcaggatgctcagggcccataagatatactttgatcataagcattaaaaatgaaaaacaaaacaaatgaaaaagataaaaaccatgcctaaacaagacgaaacaacacacacatcaacaaaccttagcatttgttatgtttgttttgggcaaccacccctggcatggggcctaccctggagtatagtaggttaatatacccagtagcacttccttggaaaaaaagctgattgaattttcccctttgccaatgggtaccaactgcaaatagcatcttggttgggtgagtcaccctgtgtctacttgtcccctcatgttgggtctccactgagcttgaacttgtgcagttgtgtatgcttccagtctgtgtgtccatatgtgcttcagtgctctttaggctcatattcaggatagagccaggttttctgctttcctgctcactgtcccttggtggcactgggctttctctccaggatagcaaagaccatcagtgatctttgttactatgtcttcaccctcccatggcacacagaaaaattaagctgcttcctcaaacccctccatatttcttctttcacaatattcctgctctagatcctcaaagccattttcttcagtcaaatcaaccatttatccctcctttctaaagaacccttgcgcacttgttcattcactatttagcataaatcatgttgactcttatatttatcttcccaccaaacttgaaggcagagagtacaactaggtactagtgttcctaggatcctaacacaacacaaaggctttatggcctccacaccccctacagcttaggggaagatgactggtgaagacactggtagagaagggaaatttacaagttggagccaaagggaaataaaatgtcagatggtggcttgttaactcgatggctgttagggccaatatagatttaattctgttctgttacattttagattgggaatgctatggaagaggtggctcactattctataccacaggctcattcattcattcattcattcattcattcattcattcattcctgtattcattcatgcatgtgttcctttacccaggcactattataatatatacactgtaaaatgtactccccgtgtaaaatacttagagagtacactatgtaaaataacaagaaagtatacactttctaaaatgctaagaagataaacagtaagtgtgtaagagaaagcaaggcatagttcctcccttctgagaatttaccaactacagggccaacaaaccaagctataaagaagatgtagattctgtaggttctgacgccagtaaagcacctgtttgtattggcttttcctcccactggaagcacccataagcactaaaaagatacaagggacatctgtctgtgggttctcaggcagccaagatgaaagaacccagaaattgagcagagaagaaaagccagcgagataactcagacactttgcgcaggtttctcacgcaagcctggttccttaaatagcatgggggtagagagcctgtgaagtttaccaggaagtgtctagaaaacaaaaactgagcccaaaattcaattgacttatggaatagggaaagaaaaggtagaaattcagggccactgagagaacgggatgcttcagggaggagtacagcaatgaggggcttcgcctctcaacgtgttcactaattaacaaacagaaacagagaaagtgaacccggaacctaaagctgggtaagcagagatcaacagagacacagagttctctacagggaggacctactccataaatgctctggcttgcagctagctcattccaaggacaacacccaagaagggaggactctgaaatagaaggactcttttttactaaaggcttctgaagaaatccaacctctgaacacttaatctggactagattcaaggcactgccctcattttagcacctttatagatgctgacgactcatctgaaaccttcctaatcttctttataaagtgtttatttaatcaaaattaacaaacataccaagaagcagaaccaagcaacagataatagaggcagaggcataaatgatccagacatcaaagaggtcagatatggactctgaaatagccatgattagcgtatctgagacaacagatttctgacttctcaaggaactggcatttgaatccatctgtgaagaatccttcagagctcagcctagcaaatacataacaaagagttcagatgcagctcattccaggcaaagagcaagtctgaaggacaagagcacaggaagaaatggtgacacacactgacttggggtaaggaggagagggtgtggagttgaggctgaccttccaaaaggaaatggccaattgacctccatttccccagaaaatcagttatggtgattaagcctaccagtggtcaggaccatatcaagttcaggaaagagataaagagaataaaagaacacttaatttcatttatctgttttaggatttcttcagtaaatcagacccatttctggaaattttcagaatgaacgatgacgcgactcaacagcttgtgcatcgaacagaggtaagatgtgtgcgctctgcctctgagaccagtaatgcccttgtaaagaatttttgtacatgatttccaatttttaaaagctaaaatatagttataccatttcccccttccctgtcctccctccaaccctttccatgtgccccttggctctctcttaaatttgtggctctttttctgtagctcttgtgtgtgcacacgtgtgtgtgtgtgcatgcatgcatgttaccttaaatatagaactacagtctgcttaatccataaaatgttgcttgtacaatttcagaactgacacttggtattggaaagtcaattgccggactcttcttcaggaaagactattcctccagctctcactgttatttgttgcctatagttctttgtctagggttggccatgggacatcctatttctttttttttttcccaatttttaattaggtattttcttcatttatatttcaaatgctatcccgaaagtcccacataccaccacccccccactcccctacccacccactcccacttcttggccctgttgttcccttgtactggcatcctagttcttgttagcttactgcttgtagacagacagacctggggcctcctctctccttgagatgatcctccacatttttggtttgggtgtttactctgattttctaacgttggagaaaattctcctctctagatgcaacgtcctatagttgactttcaacacagccaagcagcaatgcatttatcataaattaggaacactagagctggcaagtcactgggcctaggtgagctcctcacccattctccctccaaccgggatccctgttcactgcttttattatccctgtgcccaaatactcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctccccctccctccctccctctgctattgatttccccaaacctcttcactccttaacattgtcctaaataagcacagaatatattaaccaattctccttctcacagaaatttggtcatgcccagggtattaggagacaagacaaactcacgaaggaacattgtttgctgtattttaatacattaaaataaatctaataatgaatctgtgatcacatcaataatccataattatagtaaggaagaagtgggaatcatttatgaaataattactctatttggagacagaatatttttttccaaaaccaaaatccacaaagacttctacctaaaaacttcataaattaacacagcagatttcatttaatagtttaattttatttggatgccctcttaagtttcattcagtagataacataaaagatcttcaaaaatgtctgcttataggactaggtggcgctcagaatttgtgcttgcaagaagtccccagtaacatagcacctactggtccatgaatcacactctggtagcccctactctaaagtacatgcctggtacacaggaaccacttatacaccctgaagcgagccggatcattcaaaacaaaacaaaggcaggaaaaatctcatggactcttaggcaatatttagccaagttcatgattaataagctgattttaaaaatacattttcgctatattattggttaactttataatctgaagaattaccaggttatatctttccaaatattctaattgagatagtgtttggctaatgtaaagttgagtattcttcatctagaaaattctcagactctccatttgatataactcatagacttccaaagctctcaacacacactcacacacaaacacacacacaaacacacacacaaacacacacaaacacacacaaacacacacacataaacacacacacacacatatcttagccctctttcactttcactgggtgcccagcaatctcacctcctactttgatgttttcttgtgtgcttgtgtgagctgttgtgtttaattaggactgctcacatgagcgtgcttgtgaggttgttcactggagcatggacaactgaccaggatccacaccacaagcctaatggactcccctgaccccagcaatcactaactgctcacagcccctcagctagaggtggtgatgttttcagcagtacctttccatccatcccagatacctttcctctgctgactccaagggaaaggaatccatatggtaagactaatggtccttcaggaccggggaatcctttatcagtggccagaggcagccttgcctcaaccccaggcctttagatatagaagaggttatcttctatatccacatgctgggcaatgtcactgtccttattcatgaaacaatatcgaggccagagaacacagtggttctgcccataatgacctacttcagggccactcttaaaatacccactgtcctcaagtttgcatcaagccacctgtcccagatgcgtgtccttttcataaacagcacagtggcttctcgagtcattttcctgttggagtatgaaaatgtcaagcctttcctcttcaaatcactattcatctctttctcttcccaggttgtgatgaataacttaagcccagcctggaagtcattcaaagtatcggtaaactctctatgcagtggagatccagaccgcaggctgaaggttagatcctatctgagagatgtgaatttgaaaatgtattgcactgcacttgcttcttctctcccatgaaccagggcatgcagaattttctgtgccactctcccaaacctctcaccttttagcatcttaatggaagaaagtgaggctgtttcttcttccagagctatcaacacacatacaatagccctaaaataaatcctaatgtattatgtcaaaagacagtgcctggggtgtttcagaaacaaaatgtggcaataacttcagagtataattgaaagtttctggaaagaaaatatttctgcatcaagtatctattgttatataatgtattactctacacacacacacacacacacacacacacacacacacacacacacacgtgtggtagtttgaggtagtaaatgtgtttagcttataactctgtgcatgggcaaacagggtggttcatagacaatctaggtgattcttaggtattcttggtctctgtgaggcactcatggtctgctgcccatgaatgggttgacttctaggggttggtaggcagtgcatgtgtgtgtgtgggggggggggtgtcttagtccttgtcatcagtccttgctggtacagtccagtattctcaaactcctgacatttccacagtgcctaaaagacttgttaaaataggaatggctgagcttcacctgcaaccccaagtttcagattcaggggatacagaataggcataagaatctgcatttttgtcaggcttcccaatgggagtcatgctcctgttccagtgaccacgctttttgagattaagcgtcggcagctttcactagtttccactctacccttctctgctcctctttactggcttcctccctgccaccctctctctgtgcagtgctcagacccaggctgtacaccctgcacatgcaggagaaatgacagtcagctctctgctttggaggctgtccttattcttctgcctttccttgagcacactgtttgcttctgagtctcttcaatctcctcccgcttgcagaacgccttcctggtggcgctaacatctatggggtgcttcctagccttatttaccaatactttcttagcccttgtagtgggcagtgagtgtgggcgcatgcgtctgagtatatgcatatgtgtattgttctttgggtgatgtcaaccttcaaaaaacaaaacaaggtctctctggggaccaaccccaaatcctcaaagcgctttgcagaatgcgctgtctcatcagttcagaagcttcctgcagatgtctctgtcttcccggctgacgctgcttctccacacagtcagcatctgttccctgtgcatccagacatctaccacatccaggccctgcctggagttcctgcagtaatggcttctggccttaacctgtgctaggaaagctgctctaatagggaggttggcaggctaggcctagccccattgtgaagaggcttccctacctcccactgctgagctggccctgcagtggcactcagccgctcactgtaacgttggctcttctgaaaggtgggatgggttcttatgcggccttttatttatattcgttggttcttttgcttcgagagcagccatgaaattctagtatggcttctccaaatactgcagtgccaagctgccagaccagagctctaatcatatgggtgtcatcttcccaaccaacaaaattgaaaattggaatgtcctaaaccatctatcaggctagattttaaatcctaacttgataatgaaggctttcgttccaaagcatcctttcagtgtctttcttagtgacgcagcatctacgtgaacatcaacgttaagtagctagcagcttctccatttgtttgttttcctctccatgataaaagtcaaaacagtgactggatgacacttttgaaattgatttatgtattcaatatgaaagtatttaagtacacaggcagtttaaagagtgctgagaccttctcccctccccctcccccacccccataccatcccacagcttcggaaatcattactcatggccagcttcctgtcatcacgccctgatgttccctgtcactcacaccgctgggccatcttgaaccgaggtgagcaggcagaaggcccacaatgctctcaggtgcccctcccccaaatttctctgagtccttttaaaagaatagatgtcttgaatcagatcaaatacttatgtttttgctacatcataagatgatgacgttctaaaggcctgtggtaagctactatagaaagccataaaggggcagggtagagcctgaggccaagcaatagtatgccatggtgttatttagcaaccacatttcctgatgtgaaaatactccaggatgtaccaccaaaggatgaaggaccttccagtaaacacaactagaaaactctctcatgcccaagactgttacctggaagcatttaatgccattagataccttgccacctgcgcatatctgcctctctgctagtgatttgctaacctctgaaacagttggattttctgttctatgtgtgtgtgtgtgtgtgtgtgtgtgtgtgtgtgtgtgtgtgtgtgtgtgtgcgtgtgtgctgtatgtgctcacatgtgtcaggtgcacacacccaaatagatactgaggaggatgtggggtatccttctctatcaccttgcacgttggtcccctgagacaaaatctctcactaaatctggagctaggctgagagccagcaagttccacctgtcctttctctgcctcacccacccatacacagcgctgggcctgcaggcacagcgcttgagaccatacatgagggccagggatttgaactcatgtctgttcaacaagcactcttacccactgagacatctcataggtcccggttatcttggttttacagtaggctttaaaccatgcccagggtgaaaatgaggctcttttaatgagttagttgttgctccctctttgtatgtttagtcttgttttgtgtgaggtttctttaaaggaaaaaaaaggcagactagtgtgtcctgaagtgtttttctacattctgtttcctataaatgggtcactggggccaagttctgattttgagcaacaatgcccctggtgttattaagaattcatgggattttttatgtgaatgtttcagtctatttccacgattattaatcttttcacacactctatcattatgtctttgagcaaggagaactcctttaagttggcccttgaattcttcaagctcaaacttcataagtgggtacttaaaggtttccttgcttcctagaccaaagctttgagatcatcaatttaaaagttctataatttctttctccctaggacataactttatgtggatgtcaagttgttggctatctcttgaactcattcctcctgtatttgatttattagaagatgaatcaccatgatgagcatgtttttgactcgagcaaaatgcttcattttctgtcattgaaacatttaacaagaaaaatgtctacatgtaagatattttatgaggtctgaaaccctgaatcacttaatgttccattaaaggaaaataatctccaaaaaacccaattcaatgaaatgtgatagtcatcagttcttttgatttgatcaacacactgatccgaaacaagtcatgaattttagagacagtgtgcttctcagaagagagtcttccagatttgggggggtggtcttagagaaggagagggttggggagcaccattggcaagcatttattgacatcataatgtgcttagtactgagaggagaggccacatcagagcaggcttgacaaataccacctgctcacactgagaactttgaaccacctatactaaagggacagatcctctcttttttcaatatattagttacacagatgatttggagactcccctctataaagtgtatgcgaattccttcaagtaagtgttgatgaaagctagctgctttgagagtggcaagcaaggggcccagactgttattctaaggtgggcacagagaaaacatagtcaggtaatcagcagtaacagaaagcagggagcagtgtcctcttaaaactaaaattaaagagaagtcagacccatgagagtgagaaaggaagcccaaatacccatcaaaagtgaccatcaaacaataatgttgcccacacctgttttgttcatctgtcacctcctcctttttggctgccacgctgattgacttaataagacagccacagttacaagttgccatctgacactcccaaagttgggacttgtgaacgatccctaaagtgttctcttaagtcaaaatcccagctcattaaggctggaatcttcctttttaaactcataaatcgtactagacacaaccatttgcttagcctgcattaagagacaccatctccttactgccaacttgtttcaggttccgcccttcagcagttcattatttttctgccatcttaacacaaagctaagtgcacatgtctctgtgtgttctttccactctataaaatcatttgcatttgttctttcactagtccaactatctgcatcttccccttctaactgtggccagcctgtcttgagttgaaattgtattttctccctaagttccactattcttccttggactctctgagtcaaaatgatatgcaattgcctaatgagttgagttgggactgccctccagtatgttcttagtttgctttggacctttgctttttatcccgtccctgaaaacccattacctttaacctatctccatcctgtaaatagtcttgcattacttattgttgatttcctctaataaatctgtattttactgcctgagaaggatgatactacattgcaatttaaatccctccaaagcttagtccttaatagtgacccccattcagttccataaaaccccaaatctatagcatggggattggtcaacattttctggggttttggtgcatgcaaaccacaggcaacttgacttgaagggaccattaatgtgatcagaattactggcaatggtaattaagagcctggcattattagacagtttaatgcaaccttacttctctttctattgctgtatagctatgaaggggatgtccatggtcttattatattttcttgaaatctgttcaaattcaagtgcttccctcatagccttggggactcagggctgttggtcttgtgcctgtcaatcattcactctgccaaaatgttcagaagtttacaggaggcttcaagtctcatccaagtctctcttgattcaattgtctgtgtctctggaattcttaactccacttgagtaaatggtgcccctgatccatgattctccctgagaatctgtaatcaataccacagtgtggaaagcagtgttcaataatgcaggaatcgggcaggcttgtgaactgatggggacatggcctcctcgttttaatatttcttccttttcattaatattgttctccttcacaaatgaggatcagagactctgctttgtagaaaataatctaagatttgcagcttaaataagcaaaatcttaccttaaaccagagcttcccgtgcctttttgtctctgctaaacaacagataatatgtactgagtgcgtgccaggctccaggaactatgctgggtaggcccttggcttaagttttctcactgaactctgcaattaccttagcttaaacaatccagcagggggctagagagatggctcagtggggaaagtgcttgctgtgtagacataagggcctgaattggggtccctagaatccaggtaaagggcaggcacaactgtatatatctataaccccagcactggaggatgacacagaagagaggatctctcagcccattggccagttagtctaggtgaaccagtactgagcttcaggctcagagagagaccttgtctcaaaactcaagtgagagagaaattcaagaagacactggtgtcttctgccaacatacacacgtgcacacatataaaagaaaatctaaaaggcaaacacatagtatagcaaagaacctccatgtatcaagtttatttcttgcttataaagcaagtacagataaaaaaattcaaaacaatgtctgtttcttcatgattcaagaacccaggttccctctgggtgtggtggcacaaacctttaatccaatgactgggaaggtagatctctgagtttgaagccaccctggtctacatagctagttctagactagccaagactacataaccagaccctggagagaactcttgggagtggtactcaggttcctcgtacctatggctcacaccctcatttacttccaggaaacagaaaaagaaagctttgtgcctgaaaccagttactggaactcagtaacagctcagtcacacggagcagccaggcagactgaacaatatagtctagttagatgcctataaagaaaaagaaagagatttgtgtaactggttgtttgacttcccttagggtttcattgctgtgaagagacaccatagcctaggcaactcttataaagaacaacattgaattagggttggtttacaggttcagaggttcggtccattatcatcatggtgagaagcatgacagcatccaggcaagcatggtgctggagaaggagctgagaaatctacatcttattccaaagggaaccaggagaagactggcatccagacagccggggtgtggcatgtctccaaacccaccccctcagtgacatactttctccaacaaggtcacacctactccaacaaggctatacctcctaatagtgccactccttgggccaagcatatccaaactaccacattccactccctggtccccataggcttattctaactcatgagtctatgggggtcatacctagccatagcataatacagaatatatttagtccagcttccaaagtcccatagtctataacagtctcaacactgttcaaagttcaaagttcaaagtctcttctgagattcatccgatgacctaaatgtaatcccctaactttcatatggagaaatgttttttattgcccactgtgtagatgagaagtctggggctcagaagaagaaaatagtattctaacacctagatccacaacgtttttaagtggcatgaacaaaatcaagtcgatctgacttttgagctgaatttcacaacagtatgatacaataaaatgttgtgaaggggaagataggtaagctgtaggaagtgtgcatcagacccaaaggctccatagaacacttatgtcatgcagatgttccaagttcactcgtgttaattggaagaagatgactttacctaagcctgcaagttccgaggagcagttgactgaacagacacatctggccagaccagttacctcccagccatttcttctctttcagcaccttcctattttgcttgtcctgtgttaataacccattcctctttccccaaacatcatcctttcatccacggagcaggaaattgcccttcttcctgccccaggctcctgctgccaatgagagtcttctgctgcatattgtatttagtaattctaaaagggaaagggggatgatgtctcctacaaatgggctcagcagtgggtgctgcttacttcaataatgaagtgatgcttctatcactgagaatcagaggggtcagaggaggagagagggagaaggaaagacagagggaaagagagagagacagagagactaccttcccaaagcaagacctgttttgtctaggaatccagcaaattggatttacataaagcttaagctatggagctggtatttaatggtcataaagttttagtgaggaagacagatcatgtcttgtggtgagcaatgataatggttataccacaatgcaatcatacttaatgctgcagagctatgtgcttcaaaacaatttgatggcaaatgtagtatgataaatcttttaccacaataaataagtaatcttccagttaacttgagtgaacttgaagcatctacccagcatcagtgttctatggggcctttggctcctacccctacttcctacagcttacctattcttgctctgtcagtcacctagcagctccctaaagattccttcggacactggagttcttctgtttcataaatcctctgcccagtcattatgaatgaagagtacagtggaggcagcaccaataccccactcttcttctctccacaaatcatcccttctaacatctattgagtagacccacccaccccctgtctctgtgtgatatccctgaagctaatggaagccctcttcaggctgttgtattaagaaactacaaagggggaagatcagccccaggtactacttctatactaagataatgacacagaaatccaactattttattggcaaaattgcccagggctatggcatgtctttaactgtctgccaagaataacctgccaggacttgactggttcaaacagtggttttgaagaaatcacttcagttgtgaactaagagccctgagcgagcactagtcatgtctctggtgaggtctccagatgataagagatgagaggcctcttgtccttctgagtaccttgtctcccaattacagactgcatccactgttctgtttcctcatatttatcctacttacagccaattctacgcagaaaagcggtaggtgcccagtttgggggatgaaatcagaggaacgacgggaagctgaatgatgataagaaacactgttgtgatttgaatctaaaaagccctccatggactcttgtgtgggtggctcagttccccacgtgtagtgctaatttaaaggctctggcgtctttaggtgtggagttggggcttacctggtggaagcggatcactagcatttgaaggttccacccagctctggttccagagtttcccagtcaccaggtaaggagtctctcccatgcactcactccatcatttactaactctgcagtaccttctgcactgtgatccactgaagccctctgataccaggagccaaggcaagccttcctgctttcaagctgcttctgccagatgttttctcatagtgatgaggaaagtagctaatagagaaaggaagagagtggggattctgggaatcccttaatacagctgtcataggttgattctatttgtagtacaataggacaattctagttgtagtatggcaatctgttactggtaaggctgatgctgtgtgccggccactttcgtggctcattcttgagtttatttgttagttggtttgtttgcgtgctaatctaagcctttcatgttctcatctattgtactattttgttaacactgcaactgaaaacattgcctccaaagatttcaatgtttattactgcacagttggaagtgtttttaacctgaccttgttgataggaaggtcaggatggagtcggcttcctaggaggcatttgtcactgagtcaggtctgtggggtgtgcatacagctccactctcacaacttaagcattcactaacaatgtggtttgggggtgggggtgggggacatcacagtttatggctattctgtaaggttttctccagaaaaatattttcaatagaatctacaaacaaaacagaaagagagttatctctgaggaataacatcagccttgatgaagagagtccttgagactgggggaaggatcctcattccactgcttagcagagcaatcccagaggcctcctcgggagctggaggagatagtagaaatagctcctctcataagtgcagtgttcctgagatctcacatgcctgcaacatccttggtcttcaaagcagggccgaggaaggtcaaggctatgccaggtatgtgagcatgaaacagattccttaaactgaacattaaggaagaaaacaggaaagttctcactaacctcttaggaaattatttgcccccgagaattaccgtcttttgggatctcaaactctagaaaggaacaataaatgtttcctgactctcccaataaagagaggaaacagtgccgtgaccagccacacctggacctcatgcagctggagataaaagagtaagagaagagagatgcctcctcatgctgtctacagaggcttctcgtgtttgggattcccagcaagcaactggtctagactcgagcttcttcaatgaaaggagtccggctgtgtccaactacttgacaggatctggaagaattgactcagaataaggaaatatgtaattccagaggccataattctaatttataagaaattcttaaaatgttaataaattgactagaccaaaaaatatatatatattcctcacattccatatagagatgggccttcccttgtatctgaacgttagtaactagagcccagttgacccaacctcaagggctctctttataaaatctggtgttcttcctcagagataactctcctggtgccttatttgaaggttctgttaaaggtgcattccagagagaaatgcccagcataaccttagattgtggttcccctcctgctcagtaaaccacattcctacttagtacttatgctgtgcggggagcagctgcacgcctgccctgcagacctgactcggaagcaaatgtctctcagctctccagtcagctccatctctgaagatcttcctgccaacaaggtcagagtaaaaatctttcccactgtgaagaagtaaacattgaagtctttcaaggcaacttttccagacctctgatttggacaatgaatgacacttctcacaatataatgctgatacagtaagaaagcagtatttgcattggacttcaaagtgattatgtttactgtgttgtatccagctcattaattacagagaaaagcaaggagatgataaacctgagcattttccaggaattcagtttacacatctttccctcgaaacgtgactagagctaagatttcttttttctttaatcctgcctctttttaaatgattttttgataattccatatatgcatccttattactgtcacctcccacccacttatctctctcccacctcagccatcctccctcctccctcctccctccaagttcctttcccacagtctcttcttttggtctcttgattttagtcaggaccatttgtgtgacaataggtttagaatagtccgctggggcctcctgggctccttccttagtgagtacaacacctcccctagccatcaatagccagtagttcagcagacagtagtagagtccatgagggtccatgagcctctccccaatccccaattgtctgttgagaagcacagtcatgtacaggcccggtgcaggcaactatagctgctgtgagattgtatttgcaacagctgtgtcatgcccccatgacagccttttccagcctacctctctatcgtctgtcacttacattctttctgttccctcttctgtgttgctccctgactcttaatggctgtggtataaatgttgtttagagctactaactgctgcttagctatccattattctcagcaccttgagcagccatgagtctctctgccttcaccaccactcacaaagcacttctctgattaggacttagagtagcacttatctaagagtataacaaaaaaatatttaaagggagtttggggccatgtcaatttagctgaatatcaatagtaaactcacacactccccaaacccatacaaaagcctcctcggcactgagtttttaactgagaatagagtaccaaccatgaagtcctccttatggagcgagcctaaaatccagtgtaagagtgattggttatcaccaaactcactgtaccaccgttgtctctattacacatctcgtgtggcatgtcggcattgtggttcataaagatcacagctggataagaccactgattctgtttctttcctagcggcagggataatatctttaaatgttatgaaagccagccagtaggagaaaacttctaggtcagttacagctcaacttctctgtatttttcaactgaagtatgtggtgtcttcggcaatagagccttatcacttagttttggtgagcaaccaagtggaatggcaagagcctatattgtttggagcttctcttgagtctccctgaccagatactattccatacttgctactggaattttttaatattctgtggctcctaggagtaatattgtctaatagcgtagggaattactttctaactcccttttttaaacctgtgtttttaattggtttgcaaagtagcatgattctatatggtttttcatatacccttctcttggctagcactcactcccagcccccttgtctcccctgtgctcctaccctaccctgagtacccccaccccatcctgcttaaacctttctgctatcaaaattttttctttacttccatatcatctataaagaactaagatttctacatataaaatagattaatgtccttcaggacaatcaactataaatgttgcactcatctttgttattggacataaggtattacattgtacacacgtgtagctacatacacacctgcaaatagatcaacatgtatatttatagagtctgagtccttaattaaagtagtaaactttgaaatcaagctatatgttcttgtaaggaaataaattacccttggaaggacctgttaaacaaagtttcttcatggcgttgaaagaatgtgtagccacacccatgtgcttaagtctacattgtgattaatgttcttaacatattcaaataaccccttgagttcacacatctaaagccagatgtaaacctgacatcctcatctgttcttcaagcattttgtccctgtctctgcatggctagcaagttcttcacctctgtgtatcagttcaggagccagctactcagacacgatcacacatgtcattcataatccaatcactgccgcctcatcacctattcatctccttcaaagcaggtacggtcgtctgctaccgtcttgcgtacttacatgcatgcttacggtttgtctcctcgaccaaagtattagtggcacggtccaagggagagaaactgacttccttcatctaagcagtgcttagcctttttctactgtaatcttcataagtatattaatggatgaatgtgaggtggatgaatggatgtcaaagcctgtagtaaggttttactatttgtcctgaccttttaaaatctcccaggggaataaaatactccttaattttgtaatcttgtgtgtgtgtgtgtgtgtgtgtgtgtgtgtatgtgtgtgtgtgtgtgttgactctaatgttggacctgggacacttgctgtgacctatagcaagtctaaattcaacatgcaaacacttctcattgcgtctcaggggatatcccccactgaaatatgctattaccatattctttccaacgagtttcctcattaccagatgttatttcccaccaccagccccaggatacagggaggaaggaggcaaaggggaagcatgccttcaggactgagggcttacagagtgagtcccacaaagaagaaagttttcttgaccagaactgactctctgagctcagctttggaggatacagagactaaattctcctcagaaaagaagggaggatggaggctgctttgtggatttttccaaatgtcaggtccctttcgtttcagtgccgcatcttgtacttggctccctttgaacagtttctgaaatgacataaaccaagtctagagctaagaatgataaatcctggcttacccttaagccatgaggtgttcagtggaataaatcaggagagggggcagggtgggtgagacaaacaggattcaattaaaagtcttgaagagagtgagagccatcctggagaacctgggccttaaagcttttctacaacctactccttcctctctcacccctcccttctctctcccttagcagttaagcctgcacccagcatgcctgattgcactgacatttaaaacacattatggcagacatcccatggaagaataaaatcactaaatggacttgtcaggaggcattctgtccagctcatctcccctgcggaccagctggcctgattcattggctctcttacaacctcctcaactctgctacttccaatcacgaaatcaactcttgaaggcccatgatataccagagtacaacggactttcggatggttgaggtcagcatggaatcccaaacaatgctgccaatttccagcagcatcagagtcacctggagagcttgttaaaacaggaattcctgagtttctggcacagcagggattggagcccgagaatgtacatggctaataggttcccgggtgccactgatgctgctggccatccacatttagagaattaataataatggagaaaggagccactgccgtaatattatattgtcttcaagccttgcaattctttatatctgcatccattactgtttatcccccaaatcagcacttcgttccagtagctcacatgatatccttccaccagcaggcactgacacaagcatttgaacactaggaggaggctctgtagttttctgtcagctgggggctccagccttcccatgacccatattttggtctggacaattgcgtgtccagacatttactaacatcttacttgcacagtaagtaggtaggtaacttactgtgcaaagtaagatgtgcaataagcatctgctcggtcgttgaggctcccatccggacaagccagctgctcccagtgtaggctgagatcctggaactaaaagtgcacatttaatctcttgcactttgggggactttaagggtgaaaattcatttcaacccatcttgaattcggtccaattgaaaggtaaagacataactcaaaaacatggcaatcaaaatgtcactttggtgctgataatcctggtccctgatgcccaggtaggaaagtctcctaggagactttgggctctgatgaacaatagtgtcaggcactgcgatgcatatttgtggaatcctagcactttagagctggaagcaggatgatgaggtaatcaaaaccattcttgtctacataagaccttgccttgaagataacatcaagtgagagaagccatagctacttttaggataggaagacgagggctttagaaatgccagattcccactgtgtacatgggcatccagtagcctgagaagcataagtcaaccttggatatatattacaaccacctggcgagcataagaaaaacatggattcccaggcctccacctcagaacaactaagtaaaattctctgggtaaagatggcagaaattcttagatgtagccagagtaatctagcaaggtgaaggtccactgcttaagtgattagactgggacattttgatccctttttctgatttattttcacagctgaggattgagcccagggcttcaagcatgcactcaggagatgagctcacaccatttttagctttggtagctagagtcccactgtgttgtagagagtgggatcaaaattagtcctgcttcagcctcttgagtagccaggacaacatgccaccatgttcccaccatgtctggcttttgtgttgggagccttttctgaaaaatcagcgaggaaagcaaccacctagactaatgcaccattgccccgaaagccttctaagactcttccagtcaatgagtcatcaaattctgctgccatgtaagtggcaaagtagctggcaagagcactgagggtttgcataggaagcttcaggggttttctgggacaataccatgtgtaggattctgtgtcccaaaggcctggggctttgtaatgaaaaggctggaggttatattattttaatgtgttgccagggactccaagaacagttaggagattacaaagttagtaagttaggtacagcctgtgtttcagcttaagaattttaggtttttatcccaggcaatgagaagcagcagttctgtgaggaaaggtgatgagatggtgtttgagctcttagctggaacttggagggagaaaggataaagttgagatgggcaatccagttcatggcaatggaagatgatcagaactcggccccaaattgtatgctggatatagggagaaggaaaggagaaactagaatgagtctctgattcttggttcactaacatgtgtggagaagggaccatactataatatgagacactggaagaacaggtttggggtgggaaaggtaagttttggttcatagttgctgagtttaaggtgtttctgagactttcagtagacagcccagaatttcccttacataagtgcaggaagccataaagtcctgaacaaaccaggataactgtttaacatggcaattggcttaatgaatttgactctcagaaaagagatctaagttggggcacacatgtaagactcagtaaacatgcatgtatatagtcatatatatgcatatatatatgactataagaaaacacatcaaaatgtatttctcagtggcaaaattgcaaaaaaaaagtttctttttaattttctaccttcaaatgtgttacatttgcagtgaggaaaaggaaaacactcgtttaaaatccccacacgtttttaatatacatgccaatgtgttatatttacttagacctttttagttcctatttaaaaattcaaaattgaagtgactatttttaaagtccccagtgggtttttctgatgatgagcaagtgtgtcctatttttgtagagtgacattatgcaaagttttccagtttgccctaatctccacttaaattcagtgtctgtagaggcccaaagtaacttgccaataaagtgaccacttgatatggatgcaaacaacaaaggctgtcagcctccaaagctttgttagtttctaaaaatgagtttgtcttctaacacacttcagtcttattcattcccggtgatcaataatctagggagctggctcagccatcaagagtgcttgttgctcttgcagaggaccagagtgtggtcccaagcacccatgtccggtgtcccacacatgtgcatataaacacacacacatgtacgcatgcacacacacattcacgtacacacatggaataaagcttttcaatctgtttgagactataccacagcacttatttctgaagcttgtggtcattactgtcattgactattctttaagacaaatacgtcaggaatgataacataagtcttcagctgaagtgagagatggaaactaatgttcagtggctctgatatggaaagtcttggattctttagatgactgagggataggaaccttaaggcagcccaaccattttattatcccagcaacaaaaactgtgagatctagcaacgagaaatggcttgctatgtgccacgaggctcattagaagtcaaaacaagaccttaatatggatttatagatgaaatgtgctcttgctgtggagcagaaatgatttgggtactttcccttaatccataccacaagccttcaaggttagcatagaaagaagctggagcccagagaactgagtaagctcctttaaaaatcacagatctctcaaagtcagaacctgaagcccaggtctggttgagtcccaagttcattttacatttactaaagtgccccaagactctgtgatccttctcttcggacacactaccttcctaagggtgagagaacaggttaaacctctgtccttaagtgaaagggggaagtgtcacatttatttatcagctgtgctcagtgtttaaaggatgagggaagaggataaatgccaacaacctgactataatttaataggaaggtgaagggcccttaaaggcgaacaaccaggaaacaggaacctcgagggctgtcctaagcttgttctaaaagccaaggactctgtagatatgggggagacattatgtaaggaagggtagagaggagagggcaccttgaacattctttctttttcttctaagtctgagatcaaagaggaagaaacagttttcttcctatacctgtattgtactaactgtactgcgttccaagacctcccagggttttcccattttgcagatgcaaaacagaaagatagattcaattatttgtacaggatatcatgaatgattttcaaaaggtgggaggagactacaaggaaaggagctattaattaattgcatgattaattaattaattacatatctctactcttatgggactagtttgtgaattttatccaataggagaatttttatgatgtagaaaaattagcacaaacgaaagcactaataattaatattttcttccttttccataaccacattacacataccctaggctggccctcatgattcctgtctcctaccatctttgcataatctcatgcttttaaatgtggatgggacctgttgctttcagctatcaatagctgtggtgataatgatatgccatcctgtggttctgtcttattctatggcaaagatgaaggtatagctgggataccacatctgtccattttgatgtaataaaagagctgattatgggaagccctttcaaagagggttcagggagtcccagatgtcagagactataagcctccctgttgctggcttctagaaaaccaggtacaatgaaactaattctgcctacagtcccagagaggctaaaagtcaacactttcctagttaagcatctaggtgaagtcaggccaatccctccattctgccctgaacaagaccccagatgatgaaagcaatgagtggactctgagatacaaaattgtgagataacaaatgagtattcttttgatgcaagccgttatccaacactatagttaatgttacgtttacagttaatgttaaatggttgcttgttgcctttgattaaggaaggtcaagttcaaaataggaggttctacattctggcacagttgcctctaagttggtcattggcctcaagaacttacatattctaggcaagtgttccaccatggagtggcattcccaggcccattctattttattttctattttattttattttactttatttttttgtgtgtgttttattcttgagattgaatatttctgagttgtccaggctatccttgaattcactctataggccaagtatatactttttttctttattttctttatttacatttcaaatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatatagcatgcatacacatgagaggagtcaagcagggagttttgctggaaacgtgcaaaaaaaattgctgtgaggaaggggctgttttgtatggtgaggaagagaggtagtgttttcctgcaaggtaagattatttctcctgaaggaatgaccttggcagttgccaggggtcacaattgccgaacaaattggtagcagctagaatcagaagtgctttccttgcttacacaaaataactgtgtgcctagagaggtgaggcagaagcacagagccgcagggaggagagccagccacagagcagccgcagtagcaatccagaggagttctagaagaaccaagagaggaacatcccaaatggcaggcaaacctcagaaagtgcatggcaaagcaaggacaggcatcacacattaagaagagtgttagggaaaagtggggtctctggagtgaaagtatagaacaagttggtaaatgagcaccatacaaaaagaaaatgagctgaaccctctgtaccttttgttcatatagccaaggacagagcaagctcaagggagacgatcattgcttatttctaaacacataggaccagaaaacacattgggcatactgaaaatagatctctctaattcagccaacaatttaacccattgcttctcaaacaatgtgcagagagctcagctgggagcctcttttaatggatacttgggtttcatagatctggggtggggactgagattggatttctgacttccttgtgaccacgtgttttcctgaaagtacctcattgctgctgattcatggtgatcctgtccacaccacactctaaacagccatggccatgacttagcaaaccaaactcgctgtgaaaggaccaaaggagaaccaaaagagggttctaaagaactgagagggttataaaacgacctaaggcaaaaatcccagctctcaagaggtacaattagagaacttttcccagttgacagtcccaagcctggagaagggagatttggtaactaaaattacgcatgcaatttggtaatggggagattctattaaatttttgctcagtacagccctcttaactttttgcttatgtattgttttttacctttgttgagtgtttatgtgtgtagtatgcaggtcacacgcactcctcatttgtcacccagccaagccagcttgcccaaggatctgctgtccctggcttccaagtagtgaggtcacaatcaggctgccacaactttctggcttttatgtgggtgctggagatgcaacccaggtcttcatgcatgtatgacgctctacccactgagctttcctcccaatctgccatcagaactcttcattacaggaacaaaaactatcatccaacaatggctttcttctccacacactctgtcttgtcacataaaaaagaagcacgggcttacagggtctttgtttgtttgtttgtttgtttgtgtttgtttttgttttttatcttgacgtatattgctacagtagtttagtgacataaggtctgattttaaaatagagtagattaattgtgtggcaaaggtgtagaaataggaatgctacagacattgcagacaaactttctgcattaactctttaagttgtccattaaatacctggctctatctttgtacctctgtgaaaggcatcaagtggtctggacttcagaaaaccttggaggatattccagtctcctctatacatctctatcagcgtggctcccaggcaacagaccaaaaaatgatagcaactaaacccatagtagactacagtgagattgtgtgtgttagaacacctcagtaccaaggacaagaagcccacttccatgaagagagatccactatttcaatgtgggcttccactccatggttacctcacaagtaacagtcatttctgacctgtcctttaaggtgcccaccctctctagacaatgaaacttctcttgctatgttatataattatttcctgatgtgtttatgtatacaaactggcataatgcttcccatgggccagcgtcatcatatacacttacatattagaattagaaattcgtgtatgaaaggagttatgaaggctgttttgcactggtcagttttcctgatttggtgcgtccatattagcttttgcctctcagctcatgtctgaggtctaggaattagccttcatggctttcaattgagtctcactttggggctagatccacgatatgctgcttcatagaagaagaatcattagagcgtgtgacagtggtcagtacactcatttattcaccaactgagcaaactagagctgccacttttcctggtatggagagcaggtgaattgccgtcatggccagatgatgaatacactctcaaaagcaaaaattgagagtaaagaaacgaggttaaaggagatgtctaaatgcaatggaaccagaaaattgactacaactggtcaattgcctacacacttcaaagctcagtacagaaagccatttgattgtcatcagaaaagcacaattagaagatgactcacagatacttgccacttatgagatggctgtgctaattttccttaggatccataagctagaacaatcagtagataggagtctctgcagctcaccatacaagctgctgttaaaaatgatagctttaacgacacttgaggtgccactctcaggataaatgtcaaagagaccacaggagagacactggagcatacctttggcatctgtgattgtaaaaaccacaaactatagatctcacactcaaggggagagcttagggcttatcctctccaggatcattttaagtgatgatcactatcaaacctgactctggaccccaccaagttatgaaagtcctccttcttaacagatgaataacagagaagccactgggtggtattttattattttcatattgctgctgtataaattttcacaaagctggttccagagagcacacagatgttctgtcttgctgctctgcagatcagaatccaaaatgagactagactaaagtaggtgcctgtacagctgctttccttctggggactgtagaagagaaccatctggttaccagacctggggtatttgtccttatcttctgacccttcgcctatcattcacatcatttgacctcagctcccccatctctggttctaagccaccctcctcctcctagagaattcttttgattactttagacccacttggataatccagataatcttcctatccaaggacatcagccatgtaagtcaacaaaatcacatgttgtagttccagagattaggatgtgagcatatttggggggctacaccacagaccatattttcattgaagacttaacaaaagaagaagtaaaacagcccacatctgccctggaagaggcaagtagatgggggactaaagagctcaggagaagtcgtccactaggcaaaaagaaacctgattcacccaactacaattttgccaatttgaagcctttacaaactctcacataatctcttattccaagaagctctctctaaattatatccatcatcatcattatgtttttaatcagctaaacaattacagtaatgtctgtgttctgaaaacagggacatgcgagttggctgctctcccaggaacccttctgcatttcttttcacctctgagtctgagtaaaatcatctcccacaagttatgtaaccaaagcagaacaactccaggtagatgcgccctggcaaaagctcccttgggtacaaacaccaaagagaatgtggtagagtggctatccattgcttttgcctgcaaacaagcattgacatgagggggtagtttacaaactatgtaactttggacagaaacactgtagaaaacggaagactgtctcccctgcaatcacagacaggactgtccagtccacttccttaatctctgtatccctcctacccacttattcagcctcctgccatttgtcaagacagtgggatgcagtgtatggtttccccaaaataattggagaagagctgcctggtgtgtggattcagtaggcagatacttaggctcgtcactcagaaattctgatttttttttttccgttttggcagggatcttgttatctacttgaatagatgattcagtgattcttattatcagaccaggatgagcagggctgacaggatgaaacaggatgggcttagaaattggccttggaaattagacacacttgaatacagcttttcaagctggtagaggtgaagaagttgcttagctacactgagcctatacagtcaaaatgtataggttattggagagctgaataagatagtgtatccatttggttgtatccaaacaatctacagtttaatcattaatcattttattttattttattttattttattttattttattggggggggttgttattgttgttattgttgtttttcaagacagggtttctctgactgtcctggaactctgtagaccaggctagcctcgaactcggaaatccacctgcctctgcctccctagtgctgggattaaaggtgtgcaccaccactgcctggctaatcattgtcaatgatcagtggtcaccctcccttttttctcccttccttctcccttccctccttccatccttcacaccatgtcttttcctatgatacctgccatattgggattttcacagcagaagaatgtctactgattctgaaaatgtcatacaataacaaccagaaatacttggttaattcctctgccaggacaggccctttcccatccaccagttgtcaacttcatcatgcaattgcgtagccccttggcactctctctttcacatagcttcctcatacttacaaggaattgttcacaaaggctcctctctcttagagcaccctgctgcacacagaaagctaatatcgtgcagccattgctccaggaagtgtccaggaactggttgcatcttattctggagaaaataaaatagcaagccagttttgctgaccaacaggatgaggttacacatacatttcaggagacgctcctgctgcatggagtccctgtcatcacatttaatgtcttgtatctaccagcatcagagtcaccatggggatcacatgacacatccagtcttgatgtgtattttgcatttgctggaacattaggtatatttcaaagaccacctccatagctagtttgaaatcttaaggctcagctagaattagaaaggcagtctgttcttagtaactacaaagaatcttgggagtatatttgacttgtatgtgttctctctctctctctctctctctctctctctctctctctctctctcttagttaaaactattttattttttatttttatttttttctctatggtaatttttatttttatcatatattttctttatttacatttcaaatattatcccctttcctagtttcccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaattaggccatcctcatctaaatatacagctagagccacatgtcccaccatgtgttttctttgattggtggtttagttccaagggagctctgggggtactgattagttcatattgatgttcctcctatgaggctgcaaaccccttcagctccttgggtactttctctagctccttcattggggaccttgtgctccgtcctatggatgattgtgagcatcctcttctgtacttgccaggcactggcagagcccctcaggagatagctatatcaggctcctgtcagctaactcttgttggcatctgccatagtgtctgggcttggtggttgtttatgggatggatctccaagtggggcagtctctggatagtcattccttcaggctctgctccaaactttgtctctgtaactctttccatgggcattttgttccccctttaagaaggattctgagcttctgggataatatctacttatcaatgagtgcataccatgtgtgttattccgtgattgggttacctcactcaagatgatatcctccagatccatccatttgtctaagaatttcataaactcattgtttttaatagctggatagtactccattgtgtaaatgtaccacattttctgtatccattcctctgttgagggacatctgggttctttccagcttctggctattatggtgcaggttcacagggacctaaccactgtgaccctcttctccaattcttgacattataggtaagtgacaatgtgttctccagaccacagagcagttgtaagaagtgcagcctccaggtccatgtgtcagacatactgaaacaaaaattctaggaattaactcagaaataaacagttgaaagcacaccaattggttatccaatatccaatggtcagcccttgaaaacatacatacataacattatacagactgagcatgctgtacttaaagtacttaggaaaaactgtattgtacaaaatacacacatatacatgtaacagttaatgaaaaagaagccatgaattcaaaagaggatgagcaggggggtatatgggaggattttgaggaaggacgaggaaggaggtgatgtaattctattataagctcaaactcaagagataatctttaagagccttagatgatcgagacacatattggtttaacattggctccactacagccatctctgtcttttacccatctcttgagagtaacctcataatatgctgctagcttagattaccactgcccattcaaaggctgcataggagtatccccactatgccaactgcattgtcttcccaagatcatcttggaaaagctcttaaaaaatcacagacactgtagatcacacaggtggataactgaaagaccaatgcagttttctaaaaggcacatgatatgaaaaaataagtggctagtactgcgctgaatattttaagtggtagaaagaacaaatattttaaaattaattattttatttattaacattctaaatgttgccctcatcctggtcctccctccctgagttcttcatcctattattccacccctttgcctctgagagggtgctccctttctcagcatcccccttccctagggcatcaaatctctacagggttaggcacatcctcttccactgaggtcagatagtgcagacttctgctatatatgtgccaggggcctcagaccagcctgtgtatgctgcctggttggtggctcagtctctgggagttcccagcagtccaagtaagttgacactgttggtcttcctatggggttgccatccccttcagtttcttcaatccttcccctaactcttccatagggatccccaacctcagtccaatggttggctgtaagtacctgcatctgtctcagtcagctgctggtagagcctctcagaggacagccatgcttggctcctgtctgcaagcacaacataacatcagtaatagtgtcagagtttggtgcctgtgcgtgggatggatcccaagttgggcctttcctcagtctctgcttttttttttgtccctgcatttcttttagacaggaacaatcctgggtcaaagattttgaaggtggattagtgaccccatttctctactaggaggggccctgtctatgtattggaggtggtcatttccggttccatgtccctactgttgtgcattttggctaagttcatccccattactttctgggatcctttcacatcccagatctctgggcctttctagaggttccatctatcccccaccccaagaagctgcatatttctactcattctcctagctttctgcacttctctcctgtctcaccagatatctgatcttgcccttcccaaccttctcccatcaaggcccctccctctcactgcctcccatgattattttgttccccagtctatgtgggactgaagcatccccacttgggccttccttcttgttaaactttttatggtttctgggttgaatcataggtattctgtactttttggctaatatccaattatctgtgtatatgccatacatgtccttttgggtctgggttaccttactcaagatgatattttctagctacatccatttgtctgcaaaatgcatcatgtcttcctttttaatagctgaatagtatcccattgtgtaaatgaaccacattttctgtatctgctcttcagttgagggacatctgggttgtttcgtttctggctattatgagtaaggctgctaggaatcgagtggagcacatgtccttgtggtaaaggtagagtatcttttgggtatatgcccagtagtagtattgctgggtcttcgggtagaactatttccaattttctgaggaactgccagattgatttccagagtggttgtactagtttgcaatcttaccagcaatggaggagtgttcctctttctctatatcctcatcagcatgtgctgtcacctgagttatggatcttagccattctgattggtgtaaggtagaatctcaggatcattgtgatttgtttttccctgatgactaaggatgttgaacatttctttaggtgcttcttggccatttgtgtttcctcagttgagaactctttgtttagctctgtacccattttttaaattaggttatttggtttttttggagtctaacttctttatatatctatacatatatctatacatatatatatatatatatatatatatatacatacatacacatatacacatacacatatatgtatatatatgatattaatcctatatttgatatagtattagtgaagatcttttcccaatctgtagactgccattttgttctattgacagatgtttttagtttcatgaggtcccatttatcaattgttgagcttagagcctgagcagtagaacagatttttttaattgtcaccacagaaaactcttatgcatatgcatctcccataccctaacttcacttctcaactcatgctggaaaaaggttctatgactcattatttaataccattcctgacaatagtagttccatgggaaatgatacatgtatgtatgaaaacataagtgagtaagtgaatggcttcatggtcatgggcaaatgttggtgtcaaagaaaagccttttgacatgatctgaggcccataccatttatcccagcactgaagaagaggcaggtggatctctgtaagtttgaggccagaccagttttcataatgagttctaggccaaccagggttatatagagaggacttctctttacagaaaagggaagttctttcaccagaatctacttcaagcactgttctaaagattgagtgggccatcactgttcaactcccaggacagactggtttgtacctgggagtttgtacaccatcacaacaccatcacccatcatgcatttctttggcctggctagtactcatgtactgatctgtgccccaagagtaaagatgaaatatctagggcatgaataccaatgatgtaggaacagctcatctgccatcttgaagttaagtcactttctgtaatagatgttatgtgttcatgttgatggagttttctctggccctgaagcttagatctgttcagtggcatatcttgaatatatagtatcttgagtaatgagctcgcttttcaggctagggtcagaaccattgacttcatcttgctcctatatcttgccctgtctagagagagagagagagagagagagagagagagagagagagaacttggttacctgctcttggaatcattcagaattccatccaacctcctccctttttccctgttatcatctccaagtcatcttgcctctctccacccagtttatttattccaaaggtcagagtggtatttgtgacattcacttttgattttcagcttgataaaattttttacattgcctagacagggaggccttagtgaggcacagcattgggtatgtctatgaggatcagagaagataactaaagagagaagacacaccctcacacaccctgaatgtgggttggcattcttaatagcgttctcacgcccggccaggaagaacacaacagaccagaatcttctgcggcaaaactttattgcttacatcttcaggagctaggagcgcaaacccccagccccaaaagcgaaagccaccccaatcttacatctttaggagccagagctccggcgcgccaaagcgcagagcgcgctctattgtttacatctttaggagcgagcgagcaggcgccagagccagagagagatgccagcgagagagaatggcggaaaacccgtccccttttttaggagcgttatatttcgcctaggacgcatcactccctgattggctgcagcccatggccgagctgacgttcacgggaaaggcagagtacaagtagtcgtaaaatacccttggcacatgcgcagattatttgtttaccacttagaacacaggatgtcagcgccatcttgtgacggcgaatgtgggggcggctcccaacatctcccccttttcttttaataagagcaaataggccacccatattaatgagagtggagatagaggtcaaatccccagtgtgtaggtaaaggagccgtacacataacctcctcccaggctcatcacccagaggggtcctggtctggtcccgtgttgtttttcctgggggaaggacacttgaacactcaaccttcttgaaagatgacatgtctccctagaataggctcattttatgccgcagagcccttctattgcagtgcttagccgtgcaactctctcgggctgctgaagcacactcactctatcccgtgcaatgagactagcctcatgggatataagagctgagtggccagcgacctattgcctaagcatagatatatcaggggaagctccatgttctagtcctgcaagcgcctgggcaataaccaccttgtctctcctagtttgggccttaagcttacagaccaatcaaagaagcaacactaatccacagcaaagtgtatctccaaataatatcaatcccacccatactttaaagaaggaaaatgctgaggagatccaattgggtaatcctttggtcagggacaggtccaagcgcgtggagttgacctgaagtctcaattcccgaaggatctgttcaaattcagccatccaattctgtaacatatactgaaaaagactttttgacaaattagctgccctagtaaatttaacatactgaatggaagtaacacacaatcccggaaacttttgtttacaccccagctgagctatttgccataatacatctagttgtatctggacaagatctatgagttaaaagacaacttgaggacaagaacagagaacctgaagttcccctttataatcctgatctacaactccagggtggacaataagaccttgtaggctgcaagagcctgcctctgtcattattgtccagtggcttcacctgctcgggagagcgccttccaggccctaatagccttttcatctgattcagaactactaagaactggcttctctaattgatcttttttcttttcttttttcttctccttccttctaatctctccccaggtattcttacctgacctaaacttttcctcaggttcaagacccgtggaaaggcctgtatacttattttgtgtaccatattttctctttgctcctactctctctccccgctttacttctgatagattgtcctgaatttcatctagaatccgccctgccttaaccacttgataacatgtgaaaaggaacaaaagggctcctaacactagaaaaaatttaaggccaaacattttccactttacttctgatagactgtcttgaatttccttagaaagttcaagaccagacttacctcgtaaagctgtactcactggtactctcgttccccagctgaaaagttctgaattcatgcagttgaatccttctcaacagtctgctttacgggaacctttattaccgcgacccgcagttctggttctggaatgagggatcttccttgcgccggtcccgagttttcttgtattttttcgtcccggattttttctcgtcccggatttcagcaccaattcttaatcgcgttctcacgcccggccaggaagaacacaacagaccagaatcttctgcggcaaaactttattgcttacatcttcaggagctaggagcgcaaacccccagccccaaaagcgaaagccaccccaatcttacatctttaggagccagagctccggcgcgccaaagcgcagagcgcgctctattgtttacatctttaggagcgagcgagcaggcgccagagccagaagagatgccagcgagagagaatggcggaaaacccgtcccctttaaggaggagttatccttcgcttaggacgcatcactccctgattggctgcagcccatggccgagctgacgttcacgggaaaggcagagtacaagtagtcgtaaaatacccttggcacatgcgcagattatttgtttaccacttagaacacaggatgtcagcgccatcttgtgacggcgaatgtgggggcggctcccaacaggcatcatgggctgaaggaaaaggggggaaggtccatgggtaaatggaaaggcaggagtgtggttgggggtaagggataggagaattggggaccagctaagtgctaatgttatgctaatttttgttcctttgtttcctaatccattaagatgtcaacatatagccacttactaccatgggcaggtcccacccccagttcatccttgcaaccaaggcctgtatgccttaaactgtgggccatttcctcctttaaaaggtttcctatcaggaacttgatcacaacacactttaggttcccccttcccaccccattcccctccacttcatcaattgctataaatttacagttgtcctggcaatcaggatgaagaaatgaaagacttagctcctttctttctagaagctgataacagagttcaggagacagacagatgtgcaaataagtaagagtcatacagagtgcaaacgcccaaaatggaaggttgtaccaaaggttgtctgggagtgctcactacagacagtcaaagaaggcatcatccaagagcaaataagaaaatagcacctggccagtggcataagcaagtaaaacactctatttacacagaagaacaaatgactaatatcagaccctctcccgagtacaatgtgagaacggagcaggaaagcatccagtgtctggagaggatggctagatgacacgaacatactttctccttggttttgtttacatgccatcctgcaaagaactgaaatgcaatttgtccaactgagtcctttgccttcaggtcttgtacctcagagatagctcatgagccttgaagcagtctcgtcaggaccctgtgctttaccacagtgaatgaatgtctcaaaagaaaaggatgagactgcagcaaataaaaaacagccttggaattcacagatttgggttcccatgtgcatctgatgttagctggacaggagacaatgatgaggtaggacctctcatctctcttggcctcagccttcatctgcagcatgatagatttccattacaggaataataattgaaaattcttcatccttagatatttagaatgcccaaagaagagcttgtgaaatttcagatttctagtccctacttccaaagactttgattcatttgtatggagtagagcacaagagtcacacttgaagtgaacacgttgtcagtttggatgcatgtgtttcctaaatggaagaaccaggagtctatgatataagacacgaagacgggagttaccattatattctgtctcacattcacaacgttttctttaatttaataagaagcctaatctttgacataaaactgcattcacagacattcctgcgtcatgggtgatcgatcattcagtggatcatagcgataattgcgtaaagggtgttctaaaatattttactcatcaaagccaaactaagaggtatctaaaagtgaaggtctgtgagggtattgactttatcgggctaagtcacatacatggttttggggaggggcttgcaagcatgctttgtgatatttcacagtgaagtgtgtcactctcagaagctttcatggagatttatgaccctgggagggctggctagttcagataatcgccaagggttccagaatgcttgtttaatccttttcaacttcatacttcagtgctctttgggaagattgaaactcccacaactgcatgggcagagtgaggaggcaagctttgtagcccttcattgtattgccagtcactatgtctcagactgtgtcgctgtcttctacagagtttatatgaataaggcttatccaagaagctggaatttgatctgtgacctgacaggtgattggactaagagaattccccgtggaaatgtgatttactagagaacatgggacaatccagttggttgctggagtggaaggcataccattttcagcatctgaataagcagttattttcctctatgccacatggcctgttgattcaccactgagtatgtttttgttgaggatatgctatgttttatgcaattttggggggcatgcttgcatgataattgagacagttgctgggaactaaccattagtccttcgtaagagcataaaacactcttacttgctgagccagatcttcatgcattttacttatattgttatgaagtcagtccatcccagtatttatcaagtaccagcgtattctacagaatccttgttgggttatctgtgtagagacaatttagagaggaaaggcatttggactagaggaataccatattccgataacaaatttagaaacttcatttgtgctattaaatacagaatgaagaagtggtacaggaaatagaagcccactgaggacttggggtaaataaatctgaaaaggttataaaaggaccaaggaagtggaagctagaggtctcaatatctgagtgagtgctaggacagagggagaagaaaaaaatggagaaagcaattgaagattttcctcaaacaactaggcttggataactgagtgtaccactcacaaaatgagattcccacagagagcagtctgaggaccagagggtagtttagcatttggccacaaagagcccacactcttgacctctagtaaacacaatgattttcggatcccatgacaggtaatcattgtttcttctagaaaaatgcctgtgtctctgacactaaatgagccatgttgcggaaggtttattgattgctataatttgatgccaggagacaacctcctgtttagtctctggggtgggggaaggcacttgaagacctgagaaagaacagatgacttcatttgtatggcttaatcagtatggaaaccgcaagttggtggtgtggcatttgctgccagcctggaagaagtcttgacatagtcaggcaacttgatgactgtgcccttctaagataagcccacttactcacttctcttgttcagttattgccaatgaaactaccataggtatttgagaattggaggattttcatgaaaggaaaaaaatcctaaaatcataggatccaatttcacaaaatgattcacacagaccagttttgcaaggaccatattcaagccaaaagtgaatatctaagaaggactgaccacctatccatcagatgatacaaaggaaactcaagtattccacttagattcataaaaaattgttgtagaccatattttatcacagctattgattttgacctctgcccaggtctaagtgtccataatgcttcactgatttgcttggaatacacatctcatttatcattgagaactataacattacacccttgaagtttaagactttgggaggcccagttaactgttgtggttttttttttttaattttttagggtagcaatcatagatgttcagatcggaatctctgggtctaattgagaataactgcctggggctttgtatagacttactccaggaactctctaaataattgaaaacaaagtctagggtgatccagtaatccttttccagaagggcatatgcacatagatgagcatttgtgtatggatgaacttgtgtgcatgtgtgtttgtatatgtgtagaggccaaaagtcaacccctgctgctgttcctcagaaactgcccattctatgttttgagaggaatcttatgtgtctgaagctcaccaagtaggcttgactgacaggtcagcaagccccagggagccaccaagggtctctccattgctaagatgagtgcacaccaccacatttggctgttttttttttccttatggaagtcaaattcaggtttgcatgattgccatgcaaatactttaccagcttaactatctccctagcccccaatattctttttaaagataatttatttgattatgtatttatttactgactgatatggtgttgtttcatcccatagccttcctatcttaattcacccattcatgggcaacttcactgaattatcatgctttctttgctagtgtatctaagacagtttggaaagtcccagatgacatgaaaaaactaaaagtttacactcatttgttaaggctgaaatttctaccagttgttctttgtcaaaaagagtcaattctcatttagaggcagactctaaagaatatttccttatgagatagaaggatttgattccatgaaccagccaggaaggcaccccatctcttccatccagataaagtcaaacacatattcgtaagatggacatgaggagaacaagcttttgacagtgttaagtagggtcactgacctatctcatcaggctattacaccagtaattgaacttttcttctcattcaattcctattactggactcttggatagctttatttgtctttgaggatatggaacacatcttgtttgcccagaggtaaaagcccatccattcaccagtgggaatggccctccttgtaactggtcctctgataactactttgggaaaacaacaaaaagtatgggaactcaattagacagttccctggctgctataacattcgctatcttttcaaagatagatttgaaaaatggacccaccttttcatcaaaattccactctctgcatcaaggctaccatttgcaaaggaaaaatcaaattgaaatctattcacatatcctggcaatgcattttgaaaagtttacttcacaaagcatcaattttatgggaggttaataagtattaataacaagaaagaaggactgcagtcgggcatggtggtgcacgtatttaatcccagctcttggggtgggtgtggggggggcagaaacaggcggatttctgagttcgaagccagcctagtctacaaagtgagtttcaggacagccagggatacacagagaaaccctgtctcgaaaaactcaaaaacctcaaaaaagaaaaggaaggaaggaaggaaggaaggaaggaaggaaggaaggaaggaaggaaggactgcatcttcaagtacatgtaggttgccttgggacagaagtcaacccatttgactctcgcaggaactcggagcgtttggcgtgtcagcgtgcaaagcacagtaattggatgagaagcaccatctgtcagcttaagcagctgctcatgctcagagaagctgtaggtacaggcatcgcatgcacgtgaagctgagggtgaccgtttcctccagttcctcattccagttcctcattccagttcctcatgctgttcattgtctatttgttttttctatggccagatcctaccaaagtacaatgggagtaattttcaagtttggatcataataatacacaatcttcccccacattatttagccaaggaacgtgtatgtgaatatttgcatttagatacaactggccatgagactgccttgtgaaaaagattttgagaaagaaattaattgtttgtttctttattcaatcaatgctatcgggtgtctgctatgtggcaaaaataatgacagagtattgggataggaaagtgaagagctctctttctttcaagaagaccaaataaatcaaggataaaaatctaatgtgtgctaggctggaaggtgcatttcagatggggtactgggaggttggaagagtttcaggaaagatactgaggtgttcataatagagttgattaggaaagctccatttgggataaagttgcagtgagtactggcctgtgaaagaatgataaaacttccgggcacagggaacggtaagtgtgtgctgtatgcaggaaggtgtgagcctcctatgcctgagaagctccatgatatcgatcgtgacccctgagacacccagaagatacaaatggaagtgtccctgagaccaactatcattaaacagaccacgattaaggttcagtataaaggggaacagaggatgtgaattgtataaagttaatacatgtttgtcaatacccttcatagagcaatgtgcacccattggatacaggacacacacagtaagagatccctagagctggtttcaagattgccagataaattccaactccttcaaaaatgttagctccacgaggcagcaactgtgtccatttcacctaccattttatgtatagcggctaattccgaatttttagatttttaagtacttaataatttaaagttttttgcttaaaaacataatctcatgtagatcagactcacctttaactcactgtagagctgaaaatgacttttaactcctcctcttcttacctttccttctgattaataacaaatatttgctgaatagtagagttgttagctagtcattgacatttatactcttcttgtggagaagacctcaaattcaatcacagaacagttggttgcccctataacagtcaggctactgttgacacaataggtacattttgcctactgtgttaatattatggttcatagaagtcatagccaagtaagaccattggttgatttactttgtcagcagcctgcatggaaccatccagcactaagaaaactagccagcaaagcagagtctttcagctgagtaccaacttaatttctctatattttgtatccaaagtgtgaggaatcttcagaattatggtcttatcagctagttcttgtgggcaaccaagaaatggcaagagcttgtattgtttggaggtcttcaaggttctccatagtcaacaattactacagaggtatcctgcatctggcaccaacgtgttttgttttgttttgtttttgtcttattttgttgttttttttttcttgtgacccattacttttaagactggcattgtctagtcttgtaggagatctgcctttgaactctcttttcttatattttattttattgttttactgaacagtgggattccaagagtcttatctatacccagttcatttcaattaactcccttgccccatccctttacacacatgccccatttctctccctgtttaaattttcatggatattttttgaagactctgtagactaaccatgggtcaagttctaggtgtctcactgatgataagtgatgaacaagccatggcttctctcatgatgaggcttaaaatccataggaaagagagatcattagctcagcaattataaaacagcatgatagattttctcatagagcatctttaaatgttataaaaatttttcagattcagtgaggcaaatattatcaatacacatcacctgtgtcacacctgtatttccttagtatttggtgacacagctgcccccacatttctttctcctttaacatccagtacctatatctaaatgggaggactagcctaaggctgccgagacagcctcactgcatggttgacctgaaatgcttagagaaacactttatcagtgattgacccacaccaggggcttaagtgtccaatcctgagttagaactagtagcttattcctataatcctagcacttgagtggctgaggcaggaggattgaggtaagtttatggccatcctgagctacagagtgagatcatgttttgttctcctccccagaaaacttcagttccaaggtatgagttctgttttcagacatacctgagagacagagtcaaaattcccttctcagggggctgcagttgggatataaagagaattaatgaatgaacgaaaataaaaataaacctcaaaaaaagaaatatttgtttgtgtcctcttctgctctgacctggttttccagtctcatctaagttgtttctagaaacacctttccgtgtgtcattttcatgggttatttcctggaggaccccatcacaagacaggcacttcaccaagtccagtactcagggaagacttctcagaagataaacctcggcagatgaacagtcactcgggtacattgaagtggtgcaaataagagtcttttggggataggtggctgacaatctggtattcctttggaaagacttcagttaggtatacatgacctccaacttccatcttatcagtccatttttgacaaatgttatggcgagcccacgtttctttcaggctgtatcttagtgctatgaaatccatattgcttcacgatcagcacttatcaagattaaagaaaaacaaactccatttatttttcctttattgacagattcatggcctacatccctgtgaataaatgagctggcaagaaggggaatgggacagccagtaagcttggtgacataaattacccttgatagggaaggctgatgtgggcatgtcatcaaattaatagctgaatgctaaggaccattacatttagcactgtttgccatatccttctatataataatgcctgagaataatgtgtaattaactctgtggctgactgacaaggccaaatgcagggcaatcaatcatattgtataaacacacgtccctgagtacacatgggaggcaaagggtgacttaaaatgtctcagcactttctgcctagattatggctctgagcttttgtgaggccagcagtcatagagactcttatctatagatctaagctgcctacagcatcttggtatatagtcttccttgctatttatcttgaccttttacttgtgttctttgagggggtgacaaaaaagagatccccagtttccctttgtcttgagtggctttcaatggaggtgttcacaatgcataagcttttcctgcagccaccagcccctgtgtcactcactattctttctgcagattgctttgagcattagctgtttagaatctctgtgacagcttccactcctctgactatgtgtataatgcttctctagtaactgatgaggaatgataaatgcttcttaatgatcttcaccatgagcaagtgtggatgagaccgattcggacctttcctcttatgggttgttttctaaaatttacagtggcccagaagaatcatctgctctgcccaggatagttacttatagcttcagaatcttccaaggtctgtgtggtaacaaggaaggtcaagacaatagctacaattcatttgagagagaaaattattttaaaaaaatatttccagccgggcgtggtggcgcatgcctttaatcccagcactcaggaggcacaagcaggcggatttctgagtttgaggccagcctggtctacagagtgagttccaggacagccagagctatacagagaaaccctgtctcaaaaaaccaaaaaaaaaaaaattcctttattagtgtgaaatttttctatgaggctactatgcaatattctcatattcagacccatttgtttaggagtgtgtgtgtgtgtgtgtgtgtgtgtgtgtgtgtgcattctttgaagtgaggaagaattattttatttatccatcatggaagagaaaccaagtcctcagagctatgacagtggctgtgcatctctctctctctctctctctctctctctctctctctctctctctccatctcagaactagatttagctacagtgtaaaataccttgtaaaagtattgccaccctccccttctgcccccctcttcctgcctattctcttatcttctccccctgaagatgctaccaatcaaacagaccctttcctcaataatgaatcaattgtccacctccttgattcagagtcctagtcagacattatctatcagtcagagttgtagtaaaagataaagcagcaactaagcatgtgtgcatgccacagacacactgctagtacgatgggtgctaggagggaagagctacctgcatggcatcaccttagacactggtgcagaactgcaaagatagagaatgagcctctctgtgaatcagatcattttaactttgtgctactcttgggttaatttcatctttgttctctctgatggtttagaggtttggctttccatgtccagtctttttatagccagccaggtcacaaagtaccagcagagttgacacttgggttagctgggttgctatggaaatgaaacacacctgaggctactaattagcatctctaggtcccacagttcagccactttctctcattccgagatccttcctcctgctgacaggttagtcaccttgggtgttctttactcaagatggcagctttccttttatttacattgccaagaggttggggatttagctcagtgatagagtgcttggctagcaagtgcaaggccctgggtttgatcctcagctctggagaaaagaaaagaaaaaaagaatatgtaatgggacatcaagaaactactttctttacaaaattgccctgctgactggctctcttcctctagcctcctgccccatttttcaaagtcatgcattttgtgtatcaagttcttctagttttatagattactaaagccagatgattaggaagcaaataccaaggtgatgtaagaccaccaccacccccagactccacatctcagttgcctcggggtaagttcctaagaagcttagagatcttcccgccttcctgttctgtctttaactagaagcatagctttaaaaaaaagttttgatatatgggctttctgagtaaaccaagctggtcttgaactcaaaattctcctgcttaaatcccaattactagattatagtcatataccatcctgcctatctagaagtgttattgcttttagggtgttctcggggtctgggtgagatggcttacttctgtatttatagctcttggaaacctgaggtaggatgatcatgaaattgaggccacccaaactacatggtgaattccagaccagtccagggaaagggggaaaaatgttctctggatctttgatctcttgaagggagaaaactgcaaagcatgggcctttcatagtgttgtgcatatttgcaaagtcacctctatgggctgggatgtgctctgagcattgctttgattgctttgacatgtgactcacaaaggaatttgtaggtaaccctgcatagctgcattgggagaatatattataatttgcaatgtaacctcgttcacctgaaagatttgagaacacaatcattgctaaacagattaccactctcctctgggtctctcttgtcatgtacaagtcatttgcttggcaggttctttgtaccctgagaattgagtttctgagtcagcactctgtgaaatgtttcttaaagctccaagcatcatcacaaccaaagtcactatggcacactaagatttatctttaaccagagatctaactaccagcaaatcatctgtggataacaaaataaaaccaatttcaggtgttaaagagatatgtgcacccatatgtttattgtagctttacctacagtcaccaagatatggaagcgacctagaagtccatcaaagatagatgataaagaaaacacactatacactgttctggtttagatcttaggtgtatccccctgccaaagatcatgcgttgaaggcttagtactcagatgctggtgtctttgggagttagtaggtgagaccccattgaaggaaggaaggacgttacagagggcaaatgcttgtgaagaggatgttaggaccccagctccttcctctttttctttcatttctttgcttcccagatagcttgtaatgagtcacttcactacccctccccgcatgcttctgctgcaatgtactaccttcccacaggtgtaacggccaagcaaccatggactgaagccatgaatccaaatctttttctgaggtcatttgacatgatgtcatcaaagataactgatgccaggtgacaaaaggacccttcagtgaaatttttcttattttcaatttataaatgatagctcctcaggtgttcctcttgttaacagttacttatactcaaaatattatttttcttgatgcagtaatattgtgaatagagctcaagcctccagtttattatacaagcttgggctacttggaaatatacgaaaagttctcagtggtataacacacagtcgcagaaacataatactacctcagtagtaactactagctaaacaaaatacaatcttggaagtatgtagttattctgtcccacagataatccttagaattgatatagctactaaactttgttagattttattgttaatttggtaggccatgttctcctgtatcctccatctcttctggttcctatactgtctctcctgcccctcttccagaatgggcccacagagactgaaagagcaagcttagggcctgcatgggtctgccccaggtcctctgcatatacatcacagctattattagcttgatggttttgtgggactcctaagagtgggagctggtgtttctctgagtctttggctggcacttgacattctttccctcttattgggttgcctcgtccagccttaataggagggttttgccttgtctggtggcatcttgctttgtcctgttgggtgttgtgtcttggaggcctgtcctttttggaagatgaaatggagggggtatgactctgggggagagggaatgtgaagagcactgggaggggaaactgtggttcggatgtattgtatgaaagaataaagtattctcagtaaaagttaaaattttaacaaagatttttctgtcttttaacacattaggaactccaactactaaaacccgttcaccaaaaaagaaaaaaagtaaaataatataggatgaattataaaagaaagaaatggtctataaaggagctcttgaaacctttgcttaagtattttgaaggtagacttcgttttcattgactgtagtttttctgcttggagagcagttggagttgtactggcctctcaggccttgctagggcattagctctacacctttgactggacagttggagcttccaaacatctgtcatgcccacagctccatttcaaagggatccctgttggaaagtcaccattggtgtctcatgcccgtgcttccttgagaacagataaaaggacagggcatggctaagtttgcccacacaagacctccatgagatcaagcctatcagaattgcagcatatatagaagcagagatttctgagtccccattccaagtagagaatctattggcagttgatggccaatgagagaaagagtaaattttcttttttctttgcaggtgctgtctggtaggttgcacatgctgtaatgaataattccttatccatgcacatgtggtcagaactaactggatttagggaggatgatgatggtggtggtggtgtgatgatgatgatgatagttattattttttaaacctcatgaagttaaaatagtgatagtctagaagctccgaggaaaagttatagagaagtactaagtaatgcatatgatcaaaatacattgcatacatgtataaaattttcaaagaataaatacatatcgaattttatttaaaaaaataagaagttgatagtttacattaggatagccaagctgagggttggccaagaggctatggagtgccttgaaatataatattagtcatcatagatagcctgcttttctgtacgacctagcttttcagccaaaagaagcaaagctgcccattgagtttattttgcaccctgcaactagaactaatgttgccatgcccaaaacacacacatacacacacacacacacacacacacacacacacacgcacacacttctatttggatatttatagcaatgaagcagaatccctgtgaacatattatttgggctttgagaaaatgtaattcttagtaagtattgtttactgcctccttttcaaacttctggtttgtatatatatatatatatatatatatatatatatatttggagttacaatcaatagcaagtcgttgtcttatgtcccatgccataagtggtcctcagcagactgtacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncacacacactcacacacacacacagagacacacacacacacacagagacacacacagagacacacacacaggcacacacacagacagacacacacacagacacacacacactcagacacacacacactcacagagacacacacacacagacatacagacactcgcgcgcacacacacacagagagacacacacacacagacatacacacacacacactcacacacacagacatacacacactcacacacacacacacttctatgtaacacatacatagacatgtatactcaaaaacaaacactcgatactacacataaagaatgagaatccttatcactacaatatttcatgacctcgacagtgcttgtgtggtgtcagctactcaaactcagctaccagccccacctccccactcctgattaccactcaactctcagtcactgctgtaggacatctcattctgctttctagtctgtttccagaacatgaatatgatgctctttattctgcaagtaaccatcagcacgaatgctgctgtgggtaccacactgacagcagtcccagggttaacaggagacaagacgttgtgaggggcaccagggaatccgacgtcattgcttccagtggtttttgtttgtttttgttttgttttgtttagcttgcctcctccctcctcatttgctggatctgtatgttagtcgatattcagtcactctgacaaaattacctgagataatcaagtaaataagaggaaagatttgtttgtgcttacaggtttggaatctggagtacatggtcaataggcccatgaacatcctggtgacagcatatgaccaaggagacctgctcatctcaaggtggctaggaaacagagaaaaaggagcgtctgaggtcttgtgcttcttcaaatgaaaagtgtctcctataggctcccatatttgaatacttggcccctggttggtgacaatgtttggaaaggttgttgatcctttagaaagtggagtcttgtcagaggaagtatgtcacagaggaaggctttaaaactatatagtcttgtcacagttccagtttactctgttgcttgtgatcactcagcttcctgctccaacaaccatgccaatttgctgccatgtctcctcaccattagagattctccctctggagctatgagctaaagtctttcacaggtcaattttggccatgctgttttatcaaagcaatgaaaataactaatacagatctgacaatctacgttcagagcacacattagtcacctaactttcttctcctgaaagttccaccatgttctaataatgtcagaggatagaggccaagcttgggtcttcaatgcctgggtctctgaagaacattcaagagctaaggcatagcagttcagtctcagccttttgatggaaactgtccaaattgttctcagtccttaaccctgcttatcaactaggagtttccttattgtttcaagcaaagtacttccctttgtcctcacctcttccatcctgggctgtgctgatggatgcattctttattcactggtagtaatattattgttttctaagcaaaaggcttatctaacaaattttccatgctcaaggtgagaaaaactgagaaattagattgtttttcaagatgcctcaaacagaaaaataagtcttagggaaacaagtgttttatacagtcccaccaaccttactttttattagtaaagaaagtttttaaaaatattctaagcatggattataaagtgtaaatttggggagactgatggtgatcagattgtgaaagatcttggaagacctattaatactcacttttattcaaatcaagtaattagcataattaatggatcataaacttaggggaatacaagggaggctaggaagccagctgggtggctattgtagttagtggttaagaagaaatagagaagggaagagaagagaagagaagagaagagaagagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaatctagtcactgtaggaattgtttcccaggacaccccaagaatctcacctaaaacagcagtagatgaatctctctggttagacatagaccagcccccagctaaagtgatggatgtggaatattgttcaccgtcatccatccatttctcctgcatgtaccatgaaagctttcactttttaaccttttcatttggttttgttggcattgtacttttatcatcaagaaaatagaaaaaaataagactaatatcactcaatcaaaatcactagcaggctactgttctggaaactgcaaattctcgaactcagacatcttccagctataaacctgatactgtctgtggtttgttttttgttttgttttgttttgttttgtttttgatttttgtttttgtttttatcagagctggggagaaaaggcatttgaatctcagcaggacagctaccttcatgactcaggctgtcattcactaggtgtcccttccagagagtcatcccttccttctctgggacttactcgtttcttctgagaacacggataaattatcacagtgactgatgtgtcacagggctgtctggaggttgtggccaacgtagccaaagaaaaagctctggactccaaagggatattacgtcaccacattgagcttttgttccagaccaagcatctgtcacatactcttcctcattaagtcctcattgctggaagctgctgggataagagtcttggaaaagaatcatccttttgtcttgcagtgcatagtgtgggactgggactccaacggcaagcatgacttcatcggagagttcacctccaccttcaaggagatgagaggagccatggaagggaaacaggtaggtggttttgccccagacactgtctaggattcacctttagctaaaagtggaaaggctaacagcaagtcttccatatatgaatgagcccgataaaaagggaagatggtgggatttgattctagaaccttcccaacccaaagccattctgcaaccctgaaatagcaattcctccatggggaaaccagagtggttcaatgagtgtaggtctaatttcctttagctatgcagtcttgggcattgctttcccaagggccacaattaaagtcaactctaaattatcagccatcactccttgaataataaaggacacagcgagagaaactgctgctgcattaaatgtacagagccaggccctatcgagctaataagtcaatgccagcttaccaatgccaccctctgtagttgtaaagtgtctcataaagttgtatcttgccctcctctataaacagaaataggcaaatcaataaatattgaaaacattgcatctttgggttcccgagatgccattaaaagtaagattataacatatatcatcattgaagaccaccatggctagatgcttccagataaacaaagataaatctgcaattcccattgaggccatgaagtgcaggccactgtactttctgtatctgtgagatgctagtaaaatttagttccacatcaagactccatgctgacacatttatttgttgggaacgattctcctcttcggtgatttttacaacatccagtgtgcttggctttagatgcacaatggccaatcctgccaacattgtctctgttctcctaaagctaacagactgatgggagtcaaagtatgatctaaacatgaacgaagtaaacaaaaattaaaaggcaattacaacttgtgacaaatgttatttaaaaaggaaagataggactgcaaagatgacgcctctgattaaggtattgctgccaagcctggaggcctgagtttgatccctgagatccaaagaagtaggaggagaaaaacaactcctgtaagtcgtcctcttattttcccacatatgcatggatcattttcatgtgcacacacacacacatatacatgcacacacatgcatacacacacacctgcattcacaagtgcatgcacttatgcatatatgcacacatacacacatatgtactcagataaataaatgtaagtttctgaaatataggatagaaaccctccaattagggagtggattacaagttattagctggaaaggtcacatttaatgtcagaccctttaaggatgagagaaggcaagtctggcagtgagtaagggaaaaacatttcaggcagagagaacattcttaggtactgatgcaggaacgagctggtgtgctggagtacttggaaagggatcagtatatcgggtgcagagagtgtggggtgaccttgcatgggaagcaatcaaagacagagcagaggtcaggaagaactgactctaatacagtcctccaaatgttaggaagacataattaaactgtgctctccaaaactatggtggccaccagccacgtgtgactatattttgattagttaaaattagattaagaaacactgttagatccatctaatgaagctggtggctgtggtattggatgacaaggacacagagtatcccaaccactgtagaaagcttcattgagtgatgctgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgtcagtaaatgtctaatctcaaagtaatgggatggattgctcctgaggaccaatacctgaaggggatctatggcctgcacatacatgtacatgtgtgttcatgtacaagtatacacacacacacatacgcacacatgtatattcagagaatgctttggctaccgtgtaagtatcatttaaagagagaggaggaagaagcaggtcaatcagatgagtgagaggataggaaccttgaacctgaggaccctagtatacctatatcagagggaaaaagaggagacccatcgttaatctccctttccctgcctgggtcatgatgctgacagaatgcagtgatttaactaatcattaattcttgaccacccccataaatagctttagattgaaactgatcagtgggaaatttttataataccaaataggagggccctctccaacaccctcctggaaggaatcaatgtggtcggaagatctggagtggtcctgatgtgtgaggcttacagtgactagggaagtggttcagtcactgatggactctgtgagacactactgtgatctcttgctgagtaatgagttgcccactaacttcctgcccccaaacagtcatcattccttgacattttcttggttgtcaatttcatcttgttcacccaggatagctcctctctgcctattatggagccgtggaacgctcacactttcgtgcctaagcagcagagatggctagtgcatctctgtggtagtggtggtggttttatcctctaatgtataattttttttcacaaggtggtaaaataaaacttagaagcaagaaaaggcaacttcagaacactggttttccccagcttctgttctcaccacatgtttaatgacctattggctaaaacaagtcacatgactaatacattggcaccaaggtcattggaggccattgtgtcagtttatcctgctcacatctgcctccaaagctgctttttcaggcattttttgaatgtcaggaataaagttaggtctcctgagcagaagcctaaggtcccagctccttcaggatcagtaacagaaatgtccagtgaccgctgggtgcttgccttgcagttgcttctacctgtgagtcaattgtctatagtctagaagagatggaaactgttttagctactaccagttaatccatcggttctcagtgtctcccaaggcttttatcctgtccttcaaagagtatcttctggaatgagtgccaaggaaagggctgagaactgaggaatcataaggtcagctttagagatgagaaatccaaggcatagaggagtctagcagcccatcaaaggacacaaagcggggcaatgaaggcataagaatatccactaggcagtccattgtctgtcaatcacttccccttgtcattttcatggataccaacggtaccacctagagaccattttccaaccatccagatccatgtgtatgtccccaaaagcatgtaggatcttggcctcattcgatgacttgactttcttttgaagatgctcattttgacccttttggtgtaggtacagtgggaatgcatcaaccccaagtacaaagccaagaagaaaaattacaagaactcaggcatggtgattctaaaccagtgcaaggtaggtataatcccctctccaccaggagcataatgctaaacttgccttgtgggagaatttcaagtcatgtgatcaaaggggaagtgtttccacaagggagtgaccttctcaaagaaaagaaaatccacaaaatcaatatagtgctggacagaggaaatcaaatatgattgtgagtggcctaaaagctgtgacagcccaatgtcaccttccccttcccagggacagtcttgccctgaaaggcaagtgcaggtcatagctcaggctcttctgtgcacagggcagatctagaggaagatgctcaagtggtgtgggtgaagagactaagtatgagatattccttactctaaagtagtaatgactcttgaaaataaggtttgggtcttctccaaagggcagatgatgtcaattaaagcaatacatagactgaaataaagtggagcaaggggtgagaatctgcagatatcttgggcccatctgtattgatgttgaagactcaccacagatttctttctaccctttgtcttggcttaccagcctgtctctgaagtgcaggccttcaatctgtagggaaagcagagcatagtgttattaatccaggccctctttcatgcagatccacaagatgcattccttcttggactacatcatgggcggctgtcaaatccagtttacagtaagctgcttttgtgtttatcctttttggagcaatgaggggtgggaatggtattgggtttgtgaacatgcagatacaaaagatcctaaaagtcttgagcttttaagaactatggctgaaatattgtgtgggcccctgtttcttaaatgagtccatattccatctccttctggtgagtatgatccttgctcctcagcctcggagggtttagaaatccctcctaggatttttcccttttttaagtacctacatgtgacatgaggtgcaaggcaggctatagatttccagatcccatagctgggcaagaaggatgaaaaatgagccacgctgctctattccactgaactcagacagatgccttaattgtgcacatataaccagaacccaggcatccatgccatatccaataatcagtaccaaaggagtgctgtccaaatgctttctcaggcaatgagagtgtgcatacacacacacacacacacacacacacacacacacacacacacacacaaattgtgtctatccactctggggtaacttgtgttcactcagtcaatattcaaaatgttctgagatataggcagatttaactttcagaaagaacatacccacataacaaaatgtaggtgtgctggaaacaaaagaaaacgctatagattatagtacagaaaaggtggaatttgtacaatgcttacctctcatcttacaaaactatatttgtgaagctcagtcctctttagttcactctaccaaatcatccatgtgagaaaagcatgaaaaatgagtttaggttttgtatatgtttgagtccaacacaattgacaaaatccatgcgttcccagaaccaaggataatgctggtctcagaactagaaaggagaatcaagataaatggacatttaatggtccagtgtgtcattagcaaaagacttgtgtggtgatttgaatgaaaatggcccccatagtctcataggaagtggcataattagaaaagattagaacacgagtcctggttggagtatgtgtgccttgttggtggaagtgtgtcactggggatggtctttgaggtttcagaagttcaagccaggccaacagtcactctctctcttccttatgtctgctgatccagatgcagagctcttggctcctttccagcaccgtgtctcctacatggtgtcacacttcccaccatgatactaatggtctaagtctctgaactgtaagccagccccaactaaacgttttcctttataggagttgctgtggtcatgatgtctcctcacatgtaaagaacactaagataacttgttctaatgtaaagaaaagtcaacctatgttctgtctcaactcagcattgctcaccttacttttgaatacttacatcacttccttaaagtctaagattctacagtgacggagccacctgccctcctacacacacactggtacataaagaacacaaccagagcaagtcctgtgggcacacccatccaacactacctgtgtagcacacttattgctgatccaagtctatctgcagggcagtagcaaaacaagaagttttccaaggagagctactgaaatagtttcccaagataataggcaaaggagtgatgtcaagaagctatttataggttttcaagggaaagctctattgatttcggtttgttttggattctgtagatcctaggctcttgaacaactccttattcaaccttcacaggcttgctttgcccttggggctgtgctggatagcctcagccacccccacagcattcccagaccacatcctgactgattgttacttctttgagaatttcatataatgtgttttgattatatttaccctccttccttagttccctccaagattcaacccatttctcttcccattcacctttgagtgtccccctgaaatttcccataaaggccaatttgtgctacccagttcttcggaatgtgtgactttccaccagttggctcacaggatatgtactcttggatattcctgtagctgcttgactttgaaaggttgcttttcctgctctgttttcctcaattttctcttcttactaaccctccccaactgagtagaggctacctcaaaatttgccaccagcagcaccccaagtcctagctctctccatgttcatccccaccctcgtctcctccagtgccaactaatagtagacttgtgtgaggatctcagtcaggagcaataggaaggagaatgtaaaataatgctgagaaggggcagggccattgagggttccatcacaagccccttcctcctaaagatctcaggttagatactcaaaggataataagagttctggatgctctgtccaagaaaatgccccagtctcttatgccagtggcatttacttccaaaatgaagtcagctttctcattatgaagttcttgctgcttaaatagtacaatgttatgcaaattttaagctctagtacagttaattaaaaatagtgtgtggtttaattctgcctactagtgcttatgtaccacccagtaacttttttgcagcatggaaatgagtggcagagagtggagatatgggggtgggatgtgggcctccctggcatggagagggcagggaagagagaaggaggaggaaagtcattagaacctgtgcaccacccagaggcaaagattctcactggttcacgaagctgtgcatggctgctgagcaagacaggtagctttaggcacaagaaacttgggtcctaaagagtgatattcaagtgacaccaagttctagatgttctccacttcatcctacagacctactcttcgtttctcacccctgcctgagccccaagcacctgcactagccaggtcctcctacgttgagctgttgcttgggtatgttcattgataggaatcaatcagagatcaaacaggaaacccaatgcagaagaattattctagatttctgctttctaggtctgaaccatagagaccttgttgtttcataaaaggtctccattcttaccacatgccccgtccttaatatgctcttcttcctgagttctagaaacagttttatctaccctctgtaattgatttcatataatcttttctaaacatttgtggtctgtccctttattaaactctccatacttacctcttctgagtctctccaagagagactctgtctcatgtggccttcaggagtagagagaaacctttgtgtcttccatggggattgtgatgcaaaataagagggttaaagctggggaaactgtgcccaacaacagactgcctgagatacttttatttaaccccaaactgtctaggaagaacagtttgggtggatttttagatggattgacaaagttctaggaatttggtttgcagaatatcccccatggattatgtatgtatgtacataaattcaagtgataaatgctggaaacttacttgtgttaatatgaatggcaggtgtgttcaggagtgtggtgagaggtatctttgggtcagagtttgagatgacttgagttttgagagaatgttgtatgtacataacagaatgttcaaatggaccaagaagagtacaggaagcaataggcatgtgctttagaggcgaaaatctggagatgtttatcaagcactatttatcaaacgcaagtgatagcaatgaaggagtatggagagctgaagcatgaggtgaaagcaggggcaacaggcccaacagtaagagccattgcaacagacccagtggacgatgacaagaagggaacctaatgtggcagcgagagaaggggcgtgtggaagagaaagcaatgtgcctgggcctgggatacaaaaaaaggagatttagaaagcaaatgagtctagtatgacttggacttgctgcctgtctgacaaagcctagcagatgttgttcacagagaaatgcaagtcaagagagatctaaaccaaaggatggattcactttggggaatgctggaaggatgtttgagtatcccattgcatggcgtctacaaaggtaagccttgatcccaataaacaggtggaactgaatgtacctggatctggaggagaaagaaaagaatacagaaagacaaggtacccaatgacaagaagtcgtataagacctccgtgtgcaagagaaaagacaggaaaggaggcccagaatcccaaatggccagatggccagtcagggatcaggaggagaaagatacaagaccaaggcaacaatcctgatgttaaaaggagccttagtcagttatttctttttggtcaccaggacatctgagaacctgagacatgccaaagattctcccagtagaaaatgcgtacttgactttgcacataaccatagaaaattcagagcgtcccccaggtgagctccatatatacctcatgagaatcctggaggcacaagaacgaagataactgtggtgttgcagtcttagaggaggtgaatagaggtgaaacagatgacagagagaggcacatggcttggcacatggctgtgtatctaaaaataaaaccacatactagaacttcatagacaaaatgtaattatagacaattcggaagagacagatgctgtaagatgtctggaaaggagatggtggaagaattaaaggcttcctttgaaagctgtgacttttatagatgcatagaaatgttaattgtagcatagatttttcacagataggaacttctacagcttaaatgtccaacagtaaaacaactgtgtaaattacagcacttcatctaaatggactatgataaagccattttaaattataatttcaatggcaaggtaatcacatagagccatgtctatgatagcactgagtataaagaaaaccagaatgactctgtgagtacaactacgtactatgtactagatttcactatagtatgcgtctatgtgtgatttttatatattttatagtttgggtgtgtccccatgaagcatgtgctgaatccccaaagcaacagaattgggaagtgagagataggatctttctggaggtttataggtcatgaggaattataatataattataatatgaattataaaagagagtacatctgtgttctctcttacacattctcttctgccttccacaatgaaatactcctagagagattccagcagtgagcctatctttgggtgagcgttccagtcttctcagactgggcaacagtttgagtaacagagcaactctgggcaacagaggcaggcttgggtactccagcctctacaactatgaaccaattctatctctattatctgtaaatgacccagtctatagtattctgatatggcagtgcaaaatggatgggagaaatatataaaacaactagaaagtaaaataaaattacttactaagatatagagtcctgagcagtaacttttattaatatattttggcatggctactcatgatttgttgttgtaaaaatttaaaggtgatgttttccacttccctctgattttatgttgtttagtaatatggtattatagacatgaagccagatatgggttctctcatcctgaccatcaaatctaaaatttgggttatctattcaagaccctcccaggaaatctttccttattctagaaaggattacttagcatgccttatagctcctggcttaagtttctaaatctctattttagacacctgatgaactgtgacacagaaaagtggtctctgtgtcctgaatgcccacacatagccagggtgcaatgggcagaggaggcaaatgttctatcatttccaagaaatgcactaagcactttcagggaaatagaatttattttttatttcatgaccaccccacagaattttgtgggaactgagaacaagagtttaggttatcacttaagaaatgtccaaagtccacatctcttactagacttattacctaagtccaaattgtgtggctgccttgggatatgacagtatacatgtgagttccaggtaacaagagagatccagcaactccctagattctgcttccagtggcttgtatccaacagagttccccccccccaatggccagttaggattgtttggtgtaaaaactaaaagtgtcagagacacattcattcttcacagttagccctctcccagatgcgccagagagacagcatctagagagtgccgggcctgctttctaggcctgggtttgcagagccactccacacatcctcaaaacataagctgcttcccaggagcctgctctctgctgcctgccgagaaggctggaacactcactaaagaccaggttttcataaagatttcccaacagaaaaggttcagcttgcttgctggcacttaggaatctgagtgtctgcagccacctcctgggacaggcattttcagtcttttttttctcaacttaatcccaacattcactgtctcccacttgttgctttctaaaataaatctaaccgttcattgcgttctcttcccaccatggctaactttaaagagcacagaactcctggtggaaggccacctcctgaaggtgggtattttatctccagcttccagagggatacttgggaaatggtttcaccatatagcccaggatagtctatagaactcgcagtccttctacctcagtcttccaagtacttacaccaatataccatcacaccaagttttgggttccctgcagttttaaagtgatcttctaggtagaaaggaaagcagtgatgtcatacttggccatcccagctctgatttaccttccaaacccaattgtatatgtaatgcatagtcttcattagggtttccattgctgtgaagaaactccatggccaaggcaactcttataaaggacatttaattggggtggttaagtgcaccagaggatgggggttcaattcccagcacccacaatgacatacttactccaacaagaccacaccttttccaacaaggcctcctaattgtgccgctccctgggataagtgttttcaaaccacaggtgttatcgtctctaagatttatctttttgagagaaaatggctgagaatggtgggtgtctgaaccaaactcatcccaggggtctagcatgatatgatgaatgccatctcctgccctgtagcccaggctgaccttgccttgcaaccctcatgtacccacatgcaacccatgtaccatgccttcccaagtgctggagtgaacagcaggtaccaacacccgcagactctgagcacctcctggatgttccttttaggaacatttttctagaattgcctgcacatattttgatcagaagtgtctgactggagcctcatgaatggatccctgggtgcttctgtctcttgcttagagttcatggaggttttaagtatcaccaccttgcatcccagtgttcaattggagggagcgctatgcactgtcttctctttctttgtgaagattagttctcacttcccggatgaaccccatctcaaaagacagaggcattagggtccctggggtcacctccatccatattcagtaaaacctcttcccactcttacccatctgccacatacattttgcttgtcctttctctccctccacaactggttagtcacagagaactaattggttcaagaccacttccccagaattgtcacagctacatcctgcctcccacctcaaagtttttctacctcctggccaggacccttcatttttcaatgggaattgttacatgagagattaaagattttaggactttttttattattgtcatatatttattgtacatagtggtagggttcataaagactttttcattctcacatagcgtgtattttgacagattcactgatcagacttcctctctctcctccctcagtagtcatcttccttcacagaatcagacaatcttacttcaatttctatatcctaaatgtgtataaatctatgtagccatctaaaatctaggctccacagaccagagaaaacatgcgatgtgctgtattctgcctctgagttattttgctttacatgatgaacaggatcccagtcccagccattttttctgcaggcaatgtaatttcattcctttttatgtctggaaaagactccatggtgcacatgtatccagtcatctactgatggattttatcttatttttttacatataagcaaatgtaataaattttcctatggcaaagatattgcttcaagaaactacagtcagatacacaagaaataaaaacttactagggaaaggttaaaatatcagtatatttttgtcctgaaaatgctcttttaggtgtataaaagaaggcatatagatgtaactttaagcccagccccatcatacagtacttgtatgtccttcactatctttgggaatcatggtaattaataaaaaagtaacaacaatttctatctacctgatagtttcatacaaagtaatgatgccaataaagcagcctacatggagaaaaagttttaacagcagttgttcctctctgttcatgataattcagagtcaggatgctttggggtgctaaattccctttccatgatcttccttatcacatctttgtactttgtaccttcattttatcagtagacatcccttgtcaaaattgaagaggtattctgaaaacagagttgaatccttcctgaaataattttaaactaagtcctgtaaagaagtaaggaagaaggggagtagcttcgttaaaaaaaaaaaaagcaaaataacttgtaaataaattgtagttagattattcttttcattttgattgattagaggactacaacctcagacaaagtcatatatttcttccaccatcattctctttaactatagcacttgttttccttctagatgcccccccctcacttctttgaaagtccagggaacattccagtcattgattataataaaattttctaaaattaacacagtgattcccatatcataatttccaagatcatgtgtggaaaatagagctttcttgctatcagggaaccagtgggcacattctagtatagtgcaaacagaaagaaaataagatgcaacatgaatattctactttcccccatgacttcacattgtatccttccccaccctaagctgaccagtctttgagatatctttgccgggttgactattctttcaatggcggtgctgttggaaagccaaggtgtttcctctcattttaacaccctaatcttaaagtattcattgctatattttgttgttaagaagtatttgataaagtttgcaagtccaatgggcctctctttccagtgatggccgactaggccatcttttgatatatatgcagctagagtcaagagctccagggtactggttagttcataatgttgttccacctatagggttgcagatccctttagctccttggctactttctctagctcctccattgggagccctatgatccatccattagctgactgtgagcatccacttctgtgtttgctaggccccggcatagtctcacaagagacagctacatctgggtcctttcaataaaatcttgctagtgtatgcaatggtgtcagcgtttggatgctgattatggggtggatccctggatatggcagtctctacatggtccatcctttcatctcagctccaaactttgtctctgtaactccttccatgggtgttttgttcccaaatctaaggaggggcatagtgtccacacttcagtcttcattcttcttgagtttcatgtgtttagcaaattatatcttatatcttgggtatcctaggtttggggctaatatccacttatcagtgagtacatattgtgtgagtttctttgtgaatgtgttacctcactcaggatgatgccctccaggtccatccatttggctaggaatttcataaattcattctttttaatagctgagtagtactccattgtgtagatgtaccacattttctgtatccattcctctgttgaggggcatctaggttctttcaagcttctggctattataaataaggctgctatgaacatagtggagcatgtgtccttcttaccagttggggcatcttctggatatatgcccaggagaggtattgctggatcctccggtagtactatgtccagttttctgaggaaccgccagactgatttccagagtggttgtacaagcctgcactcccaccaacaatggaggagtgttcctctttctccacatccacgccagcatctgctgtcacctgaatttttgatcttagccattctgactggtgtgaggtagaatctcagggttgttttgatttgcatttccctgatgattaaggatgttgaacattttttcaggtgcttctctgccattcggtattcctcaggtgagaattctttgttcagttctgagccccattttttaatggggttatttgattttctgaagtccaccttcttgagttctttatatatgttggatattagtcccctatctgatttaggataggtaaagatcctttcccgatctgttggtggtctttttgtcttattgacggtgtcttttgccttgcagaaactttggagtttcattaggtcccatttgtcaattctcgatcttacagcacaagccattgttgttctgttcaggaatttttcccctgtgcccatatcttcaaggcttttccccactttctcctctataagtttcagtgtctctggttttatgtgaagttccttgatccacttagatttgaccttagtacaaggagataagtatggatcgattcacattcttctacacgataacaaccagttgtgccagcaccaattgttaaaaatgctgtctttcttccactggatggttttagctcccttgtcgaagatcaagtgaccataggtgtgtgggttcatttatgccccagtacaggggaacaccagggccaaaaagggggagtgggtgggcaggggagtgggggtgggtggatatgggggacttttggtatagcattggaaatgtaattgagctgaatacctaataaaaaatggaaaaaaaaaagaagtatttgataaagagcagtacatagactccatcaaaaggttggccctctcttttggggctcgagagatggctcaatggttaagagcactagctgttctcccaagagatctaggttcaattcctagcacctacatgatggctcacaaccacctgtaattccatttataggagatccacaagatgatagcagtaatagaaatatctctcatcaaagagaagcccagatctactgccagattctaccaattttttaaagaggagccaatattattggcttctcaaatggttctatgaaataggaagacaaaggtccttcaattctaaaaccaaactcattacaaaccccagtaccactctgatgccaaactgtaaatgctcacaagtcaactacagttaactaccacgatgactatacctgttaaaattctcaataaaatgtctgcaaagtgaactcaagagcacatgaccaagttggtttcatcccagagaggaaatattggtttaatactcacaaaccaggaagcatgatcagcaaatgaataaatacacttgagggattgaaatcacatattaactcaagtaatgccaagagtcctgacaaacccaacactcctttatgataaaagtacccaagaaactaagaatagaaagaatacaaatcaacataaggaagactattataaaacaaacctaaaatgaacattatagtgaacagagaaaaactgagaccatttcttctaacatgtggaacaaaataggtgcccactctttcttactacagtgatcaaaaaccttatctacagcaataagataaaacaaatcaaggaaaggaagaagccaatttttttctatttttaaatgagacgaccctgtacttagctttggagatcttagctactttgccagaaaacttttagacctgatgaatacttttagcaagataacaggatacaaaatcaacacacaaaaatcagtatgcatatgtatatacaacttgacaacaaagaatctgggtgagttgggtgggagatggatatcattcacagtaggttaaaataactaaagaaaaatactaacaaaggacctgtaagggttctcaggaaaaagttgaagacagtagactttggatagacctccaatgctaagggattgccagaattaatgttgtgaataagaaggtggcagtgggaaaaggtttatatacagatccaatgtaataaaactctcaatgaccttttttatttttaaatattaaaaataatcttttactatatagaaaaaaattgctttaaattctaagcaagccaaaaatggaagccttagctcagctcatccaaggcctctcacacagtaggcaagcactccaacactacagtgctccctgacttagggagatacaggatttagatcccagaatgttaaatagtcacaactgtttctccaagagtgcaatgcattttggggggggcacattcttaaccaacgtttgccttgagctttcctgtaaccttggcttcatgggaacccttcaaaacatcgttgtgaagctgagtcagatgtctgacaatgccaacacaggcatagtgatgcttgcctttagtcacagcactacagaggcagaggcgggtggatctccgagttcagtgccaccttggactacataacagtgccccagaacatgccaattataaaattagtggttccagagaaaccctgcaagagatcaatggtaactattacagagcattgggaaatgaggtgatcagtggccttttcttcacagaagcaggaaaccaacataaagttcataaggaagaacaaagcatcccaaatggcgacactcttaacagaaagaacaatgctataagcactgcaattgctgccttccaattacatagagctatagtaggaaaacagcagctacagtgtggtgctggcacaaaaacaaacaagtaggccaagggaagagaattgaagacccagaattaagcctctactgttacagtcaccagtatctgacaacactggcaaaaacatccattagcaagaggacagcctccttgacaatggtctgagaccatttgattttcacatgcagatgaatgagacttattacttgccctacgcaaaaatgaattccaaatgagtcaaaaaccttaatttgagactcccaaactttgaaacttctagaggaaactacagagaaaagatttcaagatgtcgtaaccacagcagaaaacctgctgaaaaaagacatcaaaggaacagcaaataagctcaagaactgacaagtcgggaaggatgaaatggaaaggcttctgcactgccgagcaaacgataaccagagggaagagacaacacagagagtgggaagacagtctctcccaactccacatcagagaagggattaatatctagaatatataaagaactgcacaaataaaatgtcaaagaccatatcatgtgctaggtaaataggctaatgtctgatttgatagttctcaaaagaagaaatgcaagagcaggagaaatagctccaagggtcctcacacttgtgaggaccagagttcagatccccaaatccatgtgaaagccaaatgggtctagctgcaattctagtgcataggacacagatagggaatccctggaataagctagctagccagcctagtcaaacagcaagctctgggtttagcgaaagacacactgcctcaatatataaggtgcagagtgatcaagaaaggtatccagcattaaccttgggcatgtgcacatgtatacacacacacacacacacacgtgcacacacacacacacacacacacacacacacacgccatatacagggaaaaagaatacaaggggccaatattagatacttaaaaagctatccaacatctttagccatcaagagaatggagatttaaactgctctgagatttcatcccatcccagtcagaatggccatcatcaagaaaacaagtagcaaatgtggatgagggtgtggggagagagggatccttattcaatcttggtggggaatatagactcatatagtcactatggaaaccagtatggaggctcatcataccactgaaaacagaaccaccatacagccaatctataccactcttggcaatatacctgaagggttccaagtcagcatcctacagaggtgccacacccctgtgtttatagttgcaccatttaccataactaggcaatatagtcagatgtccccaacatatcaatggataaaaatatgaggtacatattagagtctgattcaggcaaaatgaaaagttgaataataaccctagccggacacaaggtggaaatcattatatgaagtgaaataaccaaactcagagaaactagaaaatggaccaagatgggaagaagaagtcttaagggacaggaggaagagaaggtaatagaataaatgtgataagcaagcagaggcggttgtctggggaagagtggaaatcagccagcagggtccacaaaacacagggaagaacagtttggaagaaggataattaagataaaatatgatggtgtttatgtagaaaaggacattaaagaaactcattgaattttatgataacttaaaatatattgtttttaaagaatgagttgggagttagaataatctcagaaagctgaaggagaaagactatttgatggctagacaaaggctgctcttctctcgtccccacctgcgatgacaagctatccaggtgtgttctgcattacagccaggagtcctcacatgcatgggagatgcttcactgtgtggctcctggaggcattttgttaaaaccaccccaatgcatatctctgcaactgactgcatagaaattagacagcagctttctcggggagtcgggattctctacacagaatttggccataagggttcttgtccttcacagatggagctctttagcccagggggcacagtagccttttcttggtggattatgaaattggagacagatgccccacccttacccttgatgcttggtgatgtgaatcaatagtgattggattttctgaactaccgtctcaagtcccatttagataggaagaagcgggggctattcaagacagcaaatctgacttcagtcaaattaataacgaggttttcaggaaactaacttctcttactttccttatcagccagatatgtcatatactcttgtttttctctatccgaggccatgtctccaggttggttatggttcctaacagtgcatttattcttatgctttccctcttccaggtagctatagacttcactgcctctaatggggaccccagaaacagctgttccctgcattatatccacccttaccagcctaatgagtacctaaaggccttggtggctgtgggagagatttgccaagactatgacaggtaagagacttcagacatcagctgtggtcttatctctgaggtgggaggtcctatggcccttggctgactcatggccaaagagtggcagtcagtttcggcatctcttgaaagaacggaatannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccctccctccctccctctctctctctctctctctctctctctctctctctctctgtgctctgctcttattaggttggtgaagtagatagatagcaaatctaagcttcattgtgtggactaagtgtgaaggtgtccttgctcctcacagtttgttcatgagccagcagcaccccgtcccgctgaattggattttacaacttgaagagattcttagacgtgtggtgtacacatctgagttttagatgcatggttttattggatgctcctgcatccatcctctgtattctatgcatcttatataatagccatgattattaaaagaataagactataggaaatataagcaatttgtatactgccccataaacagaaatggtatttgaaccacagtctttcaggttctacatattgagtacaaaatctttgtgttttacctatcttgggagctactggtaacattaacagacagatatgtctgcccaggtgcacatcaatgtggacaggaaagtgtgtgtgtgtgtgtgtgtgtgtgtgtgtgtgtgtgtgtgcgcgcgcgcgcgcgcgtgcgcttacatatatgcagagatgatcttaagattcaatcactattatttatttcttctagcaagctggatttgctgtcactcctgtgtcactggataaagggaaggagcacagatgtttacctaaggtttctggaggtggaaccaatgtaaacacaaaggtgcacctctcagaggactccctagtgtgatggggaaacaagcttagttggtaaggagctgtaagcagctgaccttttaatccaagaagataaacaaagcatctctgtgctctggttgtagagaaacatgagcacatatcgttatttctgttcttcctgagctcattactggtaacaaccactctaaaaacctgtttctgccagagcacagtaaaggacacacccttgtgaaacctccagcatgagctataggaaaggtccagtcagtctcctgcctgctgagatctctattcaatgtggtcagcaaaataccttagtgtagcatagagacacttagggattggcttgccacaccctatgcaatcactgagcagtaagcacccccccccaaactttccagtggctcttgctgcacacctaaagcatacttcagtaaccattttaaatcattgaggatctgtgatggccattcttggctgtcaactgaaccccaagcagctagggacacctatgggaggaatttcttcttgatttaagtcatttaaagtagaaagacttactttcagtctggatcttttgaggtggaaaaaaaatatacctttattttgacccacatcttctgatggcagcctatataaaggacatagaagaaggaagcttttttccctttgcctgcttgctctcactagcagctccattccttcactggcattagagccttcttcttcagaattccagtgaatactgacaactagctgagtcattcagcctcaagaaccaagcaactagtggattcttgggccttctgctggaagacagcgattgttgaactagctggacagcagcctgtgattctaataaatccctatacagagatagacagatagatagatagatagatagatagatagatagatagatagatagatgatagatagatagatagatagatagatagatagatagatagatattcattatataggctctgttcctctagagaaccctgactaatacaaagtgacacccagaatacttgaccttgaggtattgactgtgacaataatgagtttcagctctgacttcttcaggctctaattcagggacaatttctagtaaggtttgaagcagatggggtttttactagcgaggaaagagtttgataaattacatctacagtgtgtcagagacttcttcaagacttgggagtgggaatcctctcttttcctttacttgtgcataatcatgttaatgatgtagtgtaatatagtgtacatgtttggagataagactggaggaagtgttagcaggatccccaatgtttggaccttaagatgcatataatagaaggtaccttgcccagggcagtgatatgtactgtgctcaaccccaacttaagcaacatagtaaggcccccatgtaaaatagaagttaaataaatagataaaagaactgaatacaatacatatgtattgtatatatacatatatacaatatatacatatatatattataagaaccatgaacctgcagagaagaagacatccaatattgaattccacagagcagagaggccagttttctaaaaaccaagatgaggttcagagtctgcatcataatcctatatcaccttcatttgctcatctgggcaatggtccattatcaggaagcatttactggctaattcctgcagagagtgtccattccctggtggcttcccatgcagaatacagacacccttagtcagagccattggatgccgtaaagcattcatccctttcaaatgcaaaccagacaaaagttgacagatatgttgtattccctcaaaaacacatattgaaacatattcactatgtcaccctgggagttatatgaggtcatcagaaattattccttttaaaattttcgtagtgtaattctgaagtcatcattcccagatgaacaagaaattcaacttttggcaggccaacagagcaacacttttatttccgttttaaaaggcaactgaacattaaaatgggaaaattctaaagaagaaagggaaggttgaaaaaaacctctatgctcttttaagagactccctgggagagcttggaaggcaagcagctcccatgaaagctgacaaggttcaccagtttctgttttgtgtgggtggacagacaggagacaggcagagtcagaaaatttcaagtcggggttctggaattaatttattcctgcgtcaaagtcagggaggttggtgcttaaaaagaaacacttgcataaaaactgacagaagccactctccccctcccacaaccacacagaggtttgcagttcccatgagccttagcaactcctctctgcctctgacagccaaggactgtctctctgccctgtatactcatggctccagggtcactagcaggtgacccactgaacagagcagcttgagaggtacataaagctcttctccagatggccttgaagggaggttcccccaaccacaagataacagttcccaaagccagtgttgcccacactatacttcaccatctgcaaaggcatttcaggctatctgcctctcatgaaaacacatgtgaacaaaaacacacatgcaagtaatcacatggccccacacatcccagagtatgtgtacacatacacacgcacacacatacacacacacacacacacacacacacacacacacacacacactcacatttccctgctgtagctggcttccaggaagtgctatcaaagttaaaaccacagctcccatctttttttttaagatttatttatttattatatgtaagtacattgtagctgtcttcagacactacagaaaagggcatcagatctcattacagatggttgtgagccaccatatggttgctgggctttgaactcatgcagtagagcagtcggtgctcttacccactgagccatctcactagccccacagctcccatcttaaagggaatgaatgagcctttattttaaggccatattgaaggaccatggccttaaatttaggttaccctaaatgactggttccaaagaaagtcaaaaatcaaggcaaatttaaaatacacctgtgggtatatctacaaagagcttcttttcaagaattttcgttcacagctttcatattccttgtggacctcagtgccaacgtggcacgctttgcttggggccaggaatgttatgggtctcagacaaccttaactgtcttctaatgaaaagcctggtctgctcctgttggcataggcctgcaatctctgtgactttggaatgtgagacaggaaaactacaagttcaaagccagcctgggcaacttagtgatatcctgtctcatattttctaaaaataaaaacagagctagacatattttggtggtagagcacttacttggcatgcatgagaccctgagttcagtccctgataccatgaaggaaagggggaaggagggaggaaaaggcagcctgtctgtgatctaacgctgcaaacacagtgccagtttaaagaaatggccaactctgaatgcatttgggacacaagaaagcaaggcaggagtgtgctaggtcctgtactgggggagaacttgaagctgaaactcaagctgacacgagttttggtatgtagggcactgggttggtcagcagatgatgtgggttttctcaatacagcctctgtcacaccagaccttgtcgcatcaggattcttaccttgtctgcatgccaaaaccacttgggaagtttcaaaaaattttgatacttgggcctcactcccataggctgatttcattatctgctgtgcccctagaaatctgttgttgtgtggttgttgatgttgttgttgctgctgctgctgttgctgtcactgttgtcatgataggtatccagagttggaatccaccattaactcgcctgcagcctagataccactcttttgtgtgggacagcaaagatttaacatggcagaatttccccatgtcactcacagtctagaggaacacagaggcatgtcagtaagtcatggtgattcaggtgctgtggctcattcctgaaagcatagccagactgaagccagaggaccccaagagtccaaggtcagcctggaatacatcgaaagactatatctcagaacaacaaagcctagccccagctcagcataacccagaaacccttcctgtgtaaggataagaatggaaagtatgtaaggggaggaagggctcccacctcctccctgctgaaggaagagtgggaaggaagagaatcttgacagtagttattgggtcaatgagagagagagagagacagacagacagacagagacagacagacggagacagagacagagagagagagacagagagagacagagagagagagacagagagagacagacagagacagacagagacagacagagagagacagagagagacagagagagacagacagagagagagagagagagagagagagagagagagagattattagaacataggtgtataaatgtgcttattattctggatcattagaccagataagcctcctgtggttaatggagtctacaaggatgatttaaagaatgtgaggtcccaatgacaagtagatctaggttcatatcccagagccacacccctattctcatgagatttatttctttgattgcaaatcagaggcacatctaatttcctttgcagtgctcaggcagttctgcctgtggtaaataatcaatggtggaaagttttatctttaagattcagaatccaatctttaaaaataaactgaacacaaaaagagaaaggaatgtagtgtaggatctaaaggtcatgttggacaaatgacatctgggggtcttgttcctttgtttgttttgttcatttgcctttaaaaggattatgtaaaaatgcatagccttcacacattctttcatagataacatctaactttcttcatcatgactttaaataacgataagaattgaaaactctggagtgttataagtacttaaatacacttaaaaaataaactctaatgtaactcttgtagctgcccattggaatgtctatattatgccatgtagactagctattggcaatcatcctggattttttttttctcaccaaaaaatacctgaaccagctcttcagtttcaaatgtgtgaacttagattttttaacctacagtattactcaattctttcaatgatataacccacccaccaccccaaaaataacagtaatcaaaaactactacttagggtatagagtctggagagatggctcagcaattaagagatagatatcttagcagttaagagcacacatgctgctcttgcagaggaactaagttcagttcccacaatccacagcaggaggctcacagcacctgtaactctagcttcaggagagcgccctcttctggccttcacaggaacctattctcatgtgcacatgccaacagacaaacatacacatagattattaaaaagggggaaatcttttaaatctttttattacagatgtggaggtcagaggacagctatcaggagttgcttatctgcttctaccatgtgtgcctcaagaatagatcaaattcaggtagtcagattcaatgccaagcatatttaccgactgatctatcttaccagtccccaaaaatatatttttaataacttaccaactgacagtaatccatcctaagttctttcttttatacagtgctagaaatttaacccaaagtcttttacatggtaggtagatgttctacgactgagctacacccccaagcaatttttaaaagtgaaaatggacaataacctgggttacagaagatttggttgttactgaatttcgtagaatttttcttttatctgatgtttgaatcttgtgcttgagagttgaatctcagtacttggttgttggtacttgaatcctgcagaatagttctttcttgatattcagtttttactctctgaagcaatacagcatagcagcacagtggatacaactcagaagaggtaaagaaaaaagtagttgtgaagggagatgcatggatgagaccaggcaccgctaacacagctgctcccagaagagctgggatgtgctcagcagacaatggagaagtagaagaactgaatactgattgcccgtttccaaaagaaagctacactctcatatccccagaagagtgttgcatctctatccataggattgttttaagatgactgtttgaaagactgttttcagccaacatccatgtcctctgagaggccaccttgtttgagttgacctccgttggcatgtagattgggaatttccttgacgtgtattagccccttgctttagctcagtgttttccttaatggagcgagtgaaaagcgtgcttcaaatcaacttctcacatggagatacttggacacagccatttcctgtgaatctaagggcaactggcatgtcactagggaagagcatgggcccttttgttgtgtttaccattgttttagtctgacaataagaaatgtggcctttcccagtgtggacatatacttctgaaatttcccagtggacagtgtttgcctgtctttttctcctgacagctgctaatggcccttatgctctgtggccaatggatccagttctgacttctttgaagtgttctcatattaaaagttttcttttgttcaacttccttcccttagtccttgcataagactcctctctggctcattttatttttaaacaggaggaatggactttaaatctattgtgctaggcttggatttttttccccttcagtatatttattaggtagctttctagtggttgacttcagagaattcagccttctggcgcattaattattctccttgtaggtgaggcattttccctacccttcctctggaaacttaattacataacagtgcatgaagctcagcaaactccaaatccccaaggagggtttagctggtttaaaaagaatatcattaaagcacatgattggtgattggaagtagatgcaacattatatctacccttcctcaagagagggagggagggagagagagagagagagagagagagagagagagagagagagagagagaagaaaatccatcagaagaaagcagagggtgtggcatctcccaggggcctagttctcactcctgaggtatccctgcagtggaagacccatgactcatgttccatcctggaaagttcttctcaacaaagatgaaaatgtagacactttgccccttcttagaattgggagcaaaacacccatggaaggagttacagagacaaagtttggagatgagtctaaaggatggaccatctagagactgccatacccggggatccatcccataatcagcctccaaacgctgacaccattgcacacactagcaagattttgctgaaaggaccctgatatagctgtctcttgtgaggctatgccggggcctagcaaacacagaagtggatgctcacagtcagctattggatggatcacagggcccctaatggaggagctagagaaagtacccaaagagctaaaggggtctgcaaccctataggtggaacaacaatatgaactaaccagtaccccccggagctcgtgtctctagctgcatatgtatcagaagatggcctagtcggccatcagtggaaagagaggcccattggtcgtgcaaactttatatgtcccagtacaggggaactccagggccaagaagtgggagtgggggtgaggggagtgggggggagggtatgggggaacatttggaaatgtaaatgaagaaaatacctgaataaaataaaataaagttcttctcacttagccagcaagatcctccctggtcttccactcatttaagctaaggaggaagggctgaggcaaagtcttccaacctttccaagaaccaggaggttttgtgtctcctatttatcaccagtagtactttctctaacagatgtgatacaacagagcctggcttgacacagcaatgaggagacgagggagtgtgtggttttatggcggacttaaacctttacttcagagaactctggtttctctaagtctgtaaccccatctgtgtggacctaactgtgttggaaggttttgtcaaagctgtcatcagttgctagggacttctaagtcaattaggaagggctgggtaggaatctagctttgttgcttggattttctcaaagttgcttgagtttgctcagaaagaggggttaatgtcctcatttcctacagaagatattcagtggtaaacacctaacctgaactgaattcctttttttttttttttttttttttttgcccttgactaattctgtaaagaactgaaaaatgtagaaaccgttccaagaacaaacctcagttgtgttcttaataagagattaaaaaaaaaaagaaaaacaaaaaagaaaaaccaaaccaaacaaacaaacaaaccaaaggcagatgacttctgccaaggttcaatattccagaatgccacagcggcacatatgttgcttaagaaaggtctcattggttgcccactcagtgacctagatactgccattgccagtagatgattaatactacctatagctattacattatgatggcaattagaaaggcatgggcttgggaatcctatattcctctctggtgatcacttttttctgtctttctaagcacagagtaagtagaactcccaggattgtggataagtctgtctaacccctggggcagtggtatcagtcatgactcccttctccattctcttaactacagtgcaggttagttagggttaaggtactgaactgaaactcagtggtaaaggtgagaaggatacagtgcagtcagggttagggggtgctggaatgtgagatggtgatagagctggccacatgtctgcaagctagaggactgccatgtgttaggagctagtctaaattaatgtgcaatttccagaccaatctgggctacagagtgaggcccagcctaagaaacctaaggacaaacaccacaacaagaacttaacacaaaagacagtgtccctttgagttcaggaagtaagaaaagacatgcaaataatttcttgctgtttgtgtataagtttaatgtggacgatacagtgaatcctatcaacatgctttgttgggtagcagctatcaacgtccccgctgccttctgatggctccttagattccggagtgtctgtgtttgaaccctggctctaatcagcagcacaatcttgactgatacctctcctccaggtgtctgcctacaccaaagagagagagagagagagagagagagagagagagagaggggagagagaaagactaagctctttctttagttaaaatatatatgtgtgtgtgtgtgtgtgtgtgtgtgtgtgtgcgcgtgcgtgtatacacacacatatatatgaaatatcctaattcagtcaatgattggagttgccaaactcctcatcactatttcaagaaaacagaacatcataattggggggtggggggtaggatctgtataaatctgaggtccgtttactcttggctatctagcttagtaaaaactttaaggggagagactgtacattaatcagtaatgaacattaatgattgtttcttaattttgattaaccacgctattgcatgactcagcacttggcttggcgacatgccctggtgaggttacacaggctcctgtttctcttccttcttagatgaataaatgaaacagcttctttttatatttaattccagtgacaaaatgttcccagcttttgggtttggcgccaggatacccccggaatacacggtgagtgagtggacctaggatcttgtaactgcacacatccttgctctctgtgtaactgtggatgtctaacccagagagcagagtgttctgggtatgttgttcaaaggcccagccagagggtctcttggtttaaactcactattaatatgatacgagatggagaaaacaccccccaaaacgtttaactccgagaactcaaacaatatctattcagatctccgtagagattgtcagtgccagcgtgtatagtatatagctaggacagacaaaggaagacttgaggtaagtaaaccaaggagggaagctggaagtcagctcacttgtctggaatctgcggaggataaagggacagtgggcacacaccagctgcttcacctgtgacctcccactaagaaaggaggtgtctgtcttttaatgaggtgacctacttttttagcatccaagagacccaacgatcagaaatagcctttgaaatggaattttccatgaaatttcaagtgatttaataaaactgtccagatgccagaatagcccattcctttttatcagatcttagggggaagaaaatagcaagcggtgtgtcgcctaaccttacgcttaggcacggccaggcagggcggtttgtggtggaagattacagggtagatggcttttgtcacttattttttcagaagtagaagacactcgatttcacctgtgtgtacatgaaaatccccatgcactgtaattctggatatcagaatgattcttaaatgtcaacagcttagatagcacctctataagccgcaccatgtccttcgggcatcttgagttgaattctttttttaattggtggtacaagtaagcgcccattcaactttccattcaactttaacccttcagtccgtatccagttgaatctagaaaccaattaaggctactttttccgaagccttttctttctttttttttctttcctttttctttctttctttttcaatatgttatactttccccctccggtgagcatttatctgatcctaaaaaaatcttcctgtcacctcagcaccacagggagctgagacttcaccctccatctcagattgattgtataatggcttaaaatggtacccgctgcttaactcataatgaatgtaacgctatttgtttgcaaaccctaaacctccagtgcctccttaatggattcaagttgtaattctcctttcttcctcttttaaaattttcatcggtgtctaggtctctcatgactttgcaatcaactttaatgaagacaacccggagtgtgcaggtaagtcataaatgtgcagaaagccagtgtctcagagtctgtgacgctgtgcacatttccaggtccggcatctctctagtgaggcacatgggttgtttgcgtcaaagcacagaaatcagctctgaaaacccaaataagccacagtgctccacagggagctgagaaacacattataaggtaagcccacgcaccctcaaagagacagacagactggctaggagaaagtgagctgtcagcaagatcatggatccctccagccaaaacaaagttaatctattaattaaataaaattaatttattcttgattaaaatttcattttagctttgtttatttttgtttgtttgtttgttccttccttttttctttctttctttctttcttccttccttcctttctttctttctttctttctttctttctttctttctttctttctttcttttctttttttgaatgagagagtagcctatgatggaccaagctaagacattcctctttctgcttctctgcttttcacctgtgttttccacagtttcttttctgtgcaggtttaaggaaaggggggaggatgtggaaatcacttgatgctgccagcacattaacaatgctgacttggaataaatacgttggagagagagagagcaaagactcaacatcttggtccagaccattttactttgttttctcctggctagaaatgcctgaacttgatctcatgagataatgatgcttggggaacaatgataaggatgatcccatctgctctgaagaagtaacaaattaagctgagagcctctgtggctgtgatgttgacatttatagggtgtcaatgtccacactcctctcctcctccttattgagggagaagtgagatgaagtgaagggcgcagaacattctgcagtttctttcatgaacttggcatttactaagactaggatcatcagtgtctttggctctgagcacagtgccctcaaagtcaggatctctgctatcgtagtatttcctcccccatcactcaaaaccagtttattccggtttaagctcctctattctcctgatatccccagtctagctgaaaccctgagcttccaggtcaggaaaagactctgtcaaagacagtaaggtggtttcccaccaaaggagactggggtacataccgtagtgtttaccagctcacactctcagagttcaagtccccgatagtattgaaaaggaaatcaaacttccttctctaaggcaaaagtttgtgtgtgccccgcacccctcgcgccccccccccaaaaaaaaaacaaaaactcagcttcattttgcttcttttccatgtcgtaaaataatttggtttctttggaatggcaggcatctgtgtttcaggctgtcctaggtgggcggagtgttttcaaaaaggtgagaaacccatataaggcagaacagaagagaacttgctcatccgaattgttcacaggctgatttgcagtatatgatggctatggagaacaatttcaacagtgactcctgtgactccctacagtcaaaatcaagagcagtgtgctactttggtaccaagaaggagctaaagcaggggaaagcaaatgtcgcatgggcaacaacagcatccatgtgaataaaatggatttataacggcaatttatttctaatggtctttcatggggccaaagatcgcaggcagaaggacctctcccagcaaaacccctggcttttctttctcctgagaaccatgtgacctcagggtgaacacccgtccttaaatgagcagttgacctcagtcatctcgtaacacccagcgtataggcttgaaggctgtgtccacgtccatggtacactcagtgtcctctcagcactgctgcaagctcttctgtgggggatactgaaatggatgagttatgatccttgcccttactgggtgtggtatctggagagagggtcacaggtgcctgtgacagctacaggcagcagtgtttactctaaaatcaacaaggcgataaacaaacaaacggacctctagagccaactcacttagtggttctttcagctcaaacacctgtatttatacactgagtctgtaactcactttttctggcacctggggcactttctcttaacctctgcttctccacccatgaaactggagcagcttctgcctcctcaaaccttagtgagctaataaaagcttctgaggggtgaaatttgtgggaaaggttgcttttgaccacccattgtgatctgatctcagtgggggaggggaggcaagaaatactgacccagcatttccttttgtcttgagatcctacaagtggtatgaagtattattctggagaaagttaatgtgttgctttcgtgtgtatacaaatatatttgaatggaccacggaactgttgggtttttttttttttcaaatctcatcttaggaattcaaggagtcgtggaagcctatcagagctgtcttcccaagctccagctttatggtcccaccaacatcgctcccatcattcagaaggttgccaagtcagcctcagaggagacaaacaccaaggaagcatcggtaaggagagagacaggattcaccttgcttcttttgattattggtcatactgcccattttagcctgacagtcaattctagttttcctaaatggcttaacttctctatcttcacagtctctttattggaggaaacatgacgttaattaaactctcttctgctgggatgtgaagcttagggtggacacaaatgtcaagtgtctgcctctttgcctgaacacagacactcactagcagaagctactatgttcactgcgttgtgacaatgctcaactcctggccttcctggtctctacactaccatcatgcaacgagctgcttaggctataaccctgaagtaatccgagttccttgacttatgttgtgtttttttcttttcatttcttcttgctgaatgacacacagccttaaccagtttaaagccacaacaaacattcattgtctctgtgaaccagagactcaagcacagctggcctgtgtggactgggcttaggtctcccaaggtttcagctaagatactggccaggagtgaggtcctttgaagagtggcctgaagttgaatgctctgctaatagatggcttagtcccattcctaccatgtggttgctggtctctggtcagagacctcatttcctcattgcttgggataactactaaagaaagtttcccatggcatagcatctggccccacccaggtgatccaagagaagacaaaggagtaactgtgcctcataacttaccacagaagactcacttcatcatctcatgataccctgataatcacacagactagccaactcagtatgaaaaaagaacacacaaggacattaactaggaagtaagagtggctggctgccatcttgaaattctgttaacaccccttccccatccaattgatcagcaagttatgatgctagtctatcttcaaactatatcccatgtgttaccacctctgaataccttcatggacactgttcagggccaacaactgttttcacttacatcaaagcaaattctatgtagaatctgtacttcatctttccccatgaagtgtatcatgcttcatgcagaaaacagactcatcttttggaaacataaataagatattggcagtgaaactcagtggacagagtgcttagcttgcacaaacaaaaccccgagcttaatccctagtaccccatgatgtaggtatgatggtggacacgcataagatcagcatccaggaagtggagacaggagaattagaaaggtatgctcatcctcagctctatactctgttcaaggccatcatgaaatagataaggtagctaagatagattttttaaaaaatgaaaccaaaaccacattctttataaaatcaggcaaggggaaactgagaaaacctgtcccttttcctttgttgacaagagtatctgtgatatctttggcgtttcctgcagcttaatatccttctaggataccaggacctacacaagtaaagggagaatagcaaagacacgggtgtggattctgtgcgattacaagccaacaatgtggtgatggccatcactaacaactccaggaccagatgagtctgctcttgcagagaccgcatagtccaaaggcagaactgcatgtaataaagcaaccataaacaaagtatcagataaataagacctcctggcaacgtggggaatttacgttctctctagaagttcctcccattgttggacactgtgagctagggtcccttgttagcactaggaaagggcattagtttaagcccctcagacaagctgtgtcagaggatcttgcaacaggatttttctctttgataattatagaattcttctaggggtataaatgccccatagacctgatcacacatgagcactttcctaagctgaccttggaatgagctgttattactgctttatttgggaatttccatctggtttgctacaatagtctgtagcttgttaaagttagtacactaaacctggaagaaacaggttctagaatagtcacacttccttgactccaaagagctcttttgttgttgttgttgttgtgagttagcatgtttatgttcattcttactcatgtattagtctttgtaatgctgaggacaaaacccaggacttcctgtgcctgacaagtgttccaccagagctatacctccgctcagaatgtcttaggctcccacacttacttcctgcaaccatcaggcatatttctggaactgcatggaaagtcctcttaggtttgacctgtgtttaatctccctaaacctctttcaacccatgtcacagtggagctagcgtagcgtgctcttgatgggcaacacttgctctcagttgcaatggctcttcctgcactgacaggtttaagagtctttactccaatccccatctcagccccgtggcagcctctccacagggagagggaagaggaaggctgaaaaccaagagccaggacagttttcacatgtgtgctgagagaaccatcataatgacccttaaccagtcatctcctagcagggagttccaccatcataatccaaagggaatacagtaaaagtcctagagactattttaaattctgaggtaaccagatttacaaagtaaaaagaaacaaggagacctattttaataccctttactactaataaaatcccaactagccaacatattggctcattagcatctgattcgtataaaaattatacaaatatgagacattctgggaatttttgtactaagactttaaaatgtttgtgtattttacatttaatgacatctcagttttgggtgctgagttatgacaaacatttggtctttatttagatattataagttgatagatgaaaatatcatacatttaatttggtttgttctaaatttacttttaaaatgttcaataactgaaatgggtctatttttttatttaaaattcaactcctcttttactctagccacatttgaaatgctcaatattttcatgaggttactagctattacacaagacagcacagccctagattttcaaaggtcttcaagctgaaggagatcatataatggtcttgtccctctcagcttttaagaaataaggtatctgagaccaaggcacaaagaggtatttcagacatcacagaacaaagcttggaatccagtactcctgactcccaggcgcctgcttcctacctatcttgagctttataatagtcaataagattatttttatgatgatgatgctacaattattgtggctccattcatcatgaccttaaggctttagagctaccctacataggcttaacatatgtctgttgttgacatgaagccgagatcagatagggcagagctaagaacccaaaaagatacagaggcaacacaggttttgaggtctctctaaagtcaattggaagacagagggcaaacaaataggctggaaggatgggagattgtctagaaggtagacgctggaagactcaatgtcctaagtgtgctagtgatgatgaccagctttggtgaggctgtgagctgacatgaagctgaggcgagggtttacagaagtggagaaggacggacattgatggtctaggagcagagatacaacagtcatctaaagtcaaggccaacattgcatttgggatagtcaccaaggtggtagataagaacaaacaagaagcattaaaggagccagaacttttgggattggtggagggtatctacttggaatctaatttggagaccatttgtggggaaaaaaccctgtaccggaaacatgagtggccagagaatgtttcttgagaccataggttttagtttaaggcagaaattgaaatcacagggagaagcttttctacagcaaagcacaaataccccgtggctttgttcagtaggttatacattttagtttcacacataggatattgttttattagtaaaattttcatctttgtgcatattgcatatggaaatgctgtgatacacagaatatgattcaaaaaatagtacaaagtcagcaggaaaggccaataaataaagcaaggttgaccatatgttgataattgttgatgccaagtaatgaccccacagaggtgcccaggctattttggttttgctctggaattttcttaataaaaagttgaagaaataaacaaaaacttctattgtccctgctgttgtggtcgttctgcaaggagaccacctagatatagatacctaactaatagtgtattgcatttttctctcccacctgccacctgacttctgactccagcaatacttcatcctgctgatcctgacagacggggtcatcacagacatggctgacacccgggaggccatcgtccacgcctcccacctccccatgtcagtcatcatcgtgggggtggggaacgctgacttcagtgacatgcagatgctggacggtgacgacggaattctaaggtcacccaagggagagcctgtccttcgagacatcgtccagtttgtgcccttccggaacttcaaacacgtatgcatagatatcacgggggcatcctcacatctcccatatgtctgtcaatgttgtttgtgatctgttgttcttaaagcagcatcagcagcccctatctaggctgaacaaatcctataggaaggatatacaaatcataactatttggggaagaaagcaaatattgagttacaaatatagtcatggtaaatatagttaccaaaattttgaaaatgcttgcctttgctcatgaagtttagggttgttgtttccttcaggggtgttctaaaaagctggacagcttattgattactcaaggatacctgggaaagaagcaaggatgagctgaaattcagcctggccctgccaacagaagattatctctgcttggcaaaagtcatgagcaaaatgataagacacttaagccatctcagtatagtgaatgacattggcaatttagtctgctcactcaggagcaagatgattgagctagtacaaatgaatgtggaagtagtttagtgtggtcagagatgggagaaaatgctggaataagctcatcaaagcggactggtccgtggccaagaacatacaaacccataatctttaaatcacttctctgccggacgaaagtcacctgtattctattggtctgtgcagtcgtgagccattatccatagtaagtaatgaagcagagttgtgcttcctggttggctggagcaagcaaacactcaagataattgcctagtatgatattgagaagattctcataacactcttagttctggggataatcactaagcccatagagtcagaagtagattgagattgccacaaaccccaccccaacacagattgtgatatccaacattaagactttcttgggttcatttaaggcttttcagagatgcccaggatatgtctgggagaccattacgtatagtaggtagacatatagactgcaaatgactgtattctttagtttgcaggcccttgtaagcatcatcgaacaacagagcacatctatagcccttgctctccactaaatccctggattttcttctgctgctgttgccactattgagggtggggaggggtgtctaaacatgagctcctagcagaaggaaatgtgcaagtcttcagtgtcctttgctttgtctcctcagtacaggttaccatgaatgcacaaatgcatgtttccttctggaaagagccctgttagcttctacggcagctcctccctatgtgggtagggctccattgctcttgagatacaagagagggaggcatggtgccatgcaatccagtgcaggcttttccacagctctgtgtaatccaatgcaggctctctccactagctgcatagttggaaaagccagtttgctccaaagactctccctcaagtgaacttccaacattcttcacagccaacttactggttgtgtccaagaacatcaaatccaatttgggcttaccctgggacctagccacactaagtagtgacaatctcagcaacagagctattctcagttgtcctattttctgcatgtgctctccaggcatggctgcctgcacctctgtctttctgtgacaggcagaatgacagtgtcattctcttctagcaccagccaaatagcctcagctgaaccctcggtcctatgacctgtccaacttctaaaagaagagactgtacactccaggcctccccaagtctcttccttgccatactgccacgtgatcactcttctctttttaaagagggcctcagtgtaattaaaatcatcaagcaagcaggaaatcaatccgctgctgcagatctgagtgtagagggcattttcaagtggcaggatgaagctgatctcaccatgagatctaaggtcagtgctgtaggaaagaataactgcccagcatcccatcttccactttcccaaggagagagtttctaaagaaaggtatctgaggctcgtccaaaatttcaagttgtctgctacagacagcaaagtatggcatcaaaaaggtctagcattgttcacatggaagggtatcctggggccgactcaatctgctgcagctatgtcacatggcattcttcttcctaacacccctaggggagagggaaggctgatctcacagggtttgctggtcttccatcagccatgccaaatcccatggggctgaagcactggggttctttgcatggccacacccatgccaacaatgcacattgactcaggactttacatactcaggttccgctgctctgcacccactgggacccaagtgagataagaaagcatgagtccaggttttggagaattttctggagacttgcaaaaaatccatatgctaagcagcccatgggtggataataacctacagttattcccagcgtgtatgtgtgtatagtatgtgatgtatatttgtatgtatgtgtacatatgtgcatgtgtgtaggttggtatgcctgtgtctatggaggccagtcactgacattaggaatcttcttctatcactttccaccttaatttttgagagagtctctgactgaacccaagcttatttgccaagctggtcaaggagctccaagaatctgcatatctccctccccacccagcacaccacagcccagcattgcaattacaggtgcacaggaatgcattccgcactatttacatgagggctggggatacaaatgcaggtccctgtgctggcctggcaagcacgttgttgactgagacatccctccagctctgtgtccaacgttctgacattgcagcatgatatagagtttatgtctgagaaccatgcagtggaattccaaaaactgcaaaggaaaccctcatgatttgaagtttattaccttagcttgattgccttcatccccaccctcagctacatgcagctacacgtcgctgctgtgacctgcagctcgcgggtcctatacccctgaaatgacttcagagcagagacagacccccagacaacaccttccagtttaagctaggcattgccaaaaaaaaaaaaaaaaaaaaaagggaagattgttgacaagaactgaagggggactggaaacaaaagaattgtcccaagggagaactgccccaagcaggacaaggacacggtgcccatcttatactctgcaccgtgtgtgcatttgcagtctccctggggtgacacaggcagagtgacaggaggattttcacctaccttatcttcatgggtttcaaattagattttgaaaaacatttcattatccaaactaatctactcagaattcaataagccataaataaaagggaggcgaggagctgatatttcatagacaccagtaacccatgagttgcctttcttttgttgctctgtgtgctaacatggtgcattaaagtgcatagggacaggctctgaactgtggttctgggcagattgcttaacttctcagtgacacagacttttagtgagatgaggcaaatgctatagatgcattggatggtagaaggtagagtttcttctgtacaatggttagtgtatactgcccatattactgctattaattgccaactgactttgtggttttgccttttttttctatccaactcatgttcctacaacaagcacccatgccagcacagatatacaaggagctccattaggcccagagctttccaatgagctagccactaaccacaagtggatctttgcattcagattcattaaaattagagctggagaaatgacacagtctgtaaagtgcttgttgtgcaaatgttaggacctagttcaatctctagcactcatgtacatgtatttagggcagagcacacaggactggggagctccctggagaaaaccatccctctcaacagccatcaatgtccagtagtttttcatccagggacagggtcttctgagattccacctatctgcactggcatgtcaactggtgttattcatcagctcttgtttaggtgaccatattgttgagctctaaggagtacagctcccctctcatgtatgaacgacactatctcagcagacctcctggtcatctgtctcttataatctgaccacccctcttctgagatctgggtgtagggattgtgttgtgattacatcaactggggctggcctttgactgtactttgcattttgaccagttatgactagaaagcaactgtcacagaaggttacaggggaaaaaaatgtctttgatgaggagtgagcaaacctattcatatgaagctaaatattaacaatgatggctcagatcactcctttcttggttaattccagggtgtggaaatcagtgctgtatggcctcctttcatgggtcttcatgatgataatagggaagtctgtttccaagaattatcattctcattgaagggaaaaaagaaaaggaagaggaaaacagagacaactaagtctgttcccctgaatcaggaagaaaggagttctaaaattcatctatgaaaaatcctcttatatctcataggccaaattaggtcatgtggcatcaatccctagatgtagaaaaagctgggaaaccaagttgggttttggccttctaaactttgtaatcaaggaaaggatggagatgaattctgctcctgcctccatgcctgtgtgaccattagaaaccaaaactcttcatgatgcttctgggcttctcagctaccaggttttttcattcgtttgtttgttttgttgggttttttcatactccattagacagcatggcttctgtttccttcttattttgcttctgagatcagagctaggtgttgaatagtttaagaaagagaagattagaagcacagtccctaggccagctctcctttcttgacagtctcaaatatttgttaaatggtcactctgccaaccttccaattccttcgatagctaacatggtggctcagaccattgaaacaaattgaacaggggttatgaagtcaataccaagggtcagatccaagagtcaggccagctatctatgaccctagagtccactatgctcttgacctcaatcattctctgctacagaatcaatactataagggcattcaagatcctcaccacaatctcactttctaattgaatgactacccaaaccgagtccctactaccactaccacaaccaccaccaccaccaccaccaccaccaccaccacaatcaccttcacaatccaccccaccttccaccaccacccctcacataggaaggagcattctttcttcagatgaatttcttcattagatactttgctgtctctagaatcctcaaatcccacacccgactccccaaaatgttaaatacgtgtccaagttaaatattggaggcatgctggcatttcttctgtgatgacttggtctcacagtgtttgtgactttctataacagcacatctcagatttcagtaggaatcactagagcattgtgttagaaatacagatccccatccaggggcatctgactgtttggaagtgtctgatgcgataacactggtgggcagcctgtacaacctgacacctcatagaagggttgaacttggccatgccaagtcaccttcacacgacttttactcattccagagttccaccacttctggcatagcaaccggaacataggtatctaaaaatgaatgcaaattttaaaacaaagcaaaaccctgcaggacagttcatcctcagatgtgggtttacatttgcagacacagagcgtgaacactgagtgggtgatggttggatgactgagggaaggaagctggccactcagggcagggctcagatctttgcatctgtgtctcatccgcttcaaatgatggttgtttctttttccctgcaggcatcgccagctgcccttgccaagagtgtgttggctgaagtcccaaatcaagtcgtagactattacaatggtaaagggattaaaccaaagtgctcatcggaagtatatgaatcgtcccggacactggcaccgtgaactacacttttacagaattctgaagcactgtttatctattcctgtactttaaataacaacaaaaacaaacaaaaaaaacccaataatatacatttaaagatagcacgttttggtgatttttaattaactgactttttattttattttattttttgcatgtgtagcccaaggcctggatctgttaaacccttgaattgttaaagactttttacaatgaaatacagttataacatactctttacagcatgtcgccttggaattaaaatggtatatgtatccatttttataccggtttgttgaaattttgctaaatttcttattatctttacactgtaaagcattttgaaacatttcgtgaatgtcgatagccaaaacgtatatttggcttaatctcctataggatgagagatttttcaaaatggcagatgcatggactgtattttgcatgtttaaaataattataataaaaataaccttacactgtttttgcagttgttatctataatctctccctgctgagaatggtctctctctactaaataaatttatgtacctagaggtagtcttttttgaagcgggcttgggttatttatcccagtacccatctttacacactcccattgacacaaattcctggacaatcttgttctaatgaagctttctaatgcggggcctgaggttctgcacatctcacaaggtcctcaatgatgctagtgcatcccttgcatggcatgaggactaatggggctctgaacttgaggctttcaccacagagatcatgccaaacagaacaactcctagcctgtttgcccatggcacctcttccacccaccaggctccccagtagcttagaggaccagcctgtctccaagatgagactagaaagtaaggagactgattccagaagctgtccacccgacatcccagcctcgctgttttatagccccgcctcttcctcatccggactgaggagcacgccttctggtttgctcctgcttggctaaaaggggcagcacagctccctgcatgggtggttccattttttatgccagttcctagaaattatttcccaagattcctcccttggatctttgagtgggatcctcttcatgccaaatagcaacatggctgtccaactttccgttctaatcgcttggtctttgagctcactgtgggggccttttttgaccgcttttgtatcactcctgagtacaatttccataagcagaagtgccctggaattgtgtagggtggagatattttgtctgaatctaaggaagtctaaaaccaaaataatgacttcctcttctcttatgatattctctccaagaaatggacaaatgttttataagctataaaaggcacaaaatgtaacttatttttggtcagaaaaatagagaagtgtatccaaagcaaaagaaatctgttgttggggtagtttgggttctttttctttttttttgaagcggaaacaataataattaattaagcaaatcaaatgtcttgtacgatttccagagttataattatagattatcttgcaaatacatgtcaaccaaatgcataacattttgggaatgatggtttaaaaaatgtacgacagaaaaaaacagtcacaaatgtttaaattgtattgttttctgaataaattgggtactaacagaatctttctaagagttgtgctcttcttcctctttttgaagcaatttcctgtcagtgagttgtgtatgtcacatgcttgaggggccatcaggggacactggtgcttcaccattgcttctaacttgaaatagttaagctctatattacagaaatacctaacgactgtttctaaccccaagccggtgtgtgaacagtcatgtctatgtacctggtatgtaggaagtactcagctagttaggcaatgcagaggtgaacaataacatgaatgaataaacaattagacttatcaatgccgcctctgatctatatatctgacctgtgatagatttaatatgtgggatgagtgtttgtgactgtccttaagtggcggcgtgccatgttgtcccatgatatcctccaatatctcctgggatgtcttcactcagtgtagactccctgggatgtcgaattagtaaggacagagtccaatttgcctgacagacatttaggaagtttacttccctttacatagccagactcaagttcaggccccttccctgcccccaaatagtaaaaatagtactgaacgatcatttaagggtatctcatcccagatttctacagcaaaataacacacagtagcttgaatagcagaattttatttttcatggtttaggagtctaggaagaccaagatcaaggtgtcagccatttggattctaatgggacctctctttctttctttttttttaaaattaggtatttatttcatttacatttccaatgctatcccaaaagtcctccacatgctcccccacctactcccccacccacccactcccacttcttggccctggcgttcccctgtactgggacatataaagtttacaagaccaatgggcctctctttccactgatggccgactaggccatcttctgatacatatgcagctagagacacgagctccaggggagtactggttagttcattttgttgttccatctatagggttgcagttccctttagctccttgggtactttctctagctcctccactgggggccctgtgatccatccaatagctgactgtgagcatccacttctgtgtttgctaggccccggcatagcctcacaagagacagctatatcagggtcctttcagcaaaatcttgctagtgtgtgcaatggtgtcagcgtttggaggctgattatgggatggatccccggatatggcagtctctagatggtccatcctttcatctcagctccaaactttgtctctgtaactctctttctaactcacagttagacatttaactttgccttagcttccatgatatagaaaaaaaaaaagagttctctgtttttacaagaacactaatccccccacaagaatgtcttcctcattacctagccatctcacaaagcgtctacctgctaatagtatcacagtgggtaccaggtctcccatatgtgaactgtggaagggcacaaacatggtcagtaacaagaggtgactgtgaaactgatgtcactctaagttctttttttttttccttttttttaaaattaggtattttcctcgtttacattttcaatgctatcccaaaggtcccccatacccatcccccaatcccctacccacccactccccccttttggccctggcgttcccctgtactggggcatataaagtttgcaagtccaatgggcctctctttgcagtgatggccgactaggccatcttttgatacgtatgcagctaaagacaagagctcccgggtactggttagttcatattgttgttccacctacagggttgcagttccctttagctccttgggtaatttctctagctagggctccattgggggccctgtgacccatccaatagctgnnnnnnnnnnnnnnnnnnnntatttcatttacatttccaatgctatcccaaaagtcctccacatgctcccccacctactcccccacccacccactcccacttcttggccctggcgttcccctgtactgggacatataaagtttacaagaccaatgggcctctctttccactgatggccgactaggccatcttctgatacatatgcagctagagacacgagctccaggggagtactggttagttcattttgttgttccatctatagggttgcagttccctttagctccttgggtactttctctagctcctccactgggggccctgtgatccatccaatagctgactgtgagcatccacttctgtgtttgctaggccccggcatagcctcacaagagacagctatatcagggtcctttcagcaaaatcttgctagtgtgtgcaatggtgtcagcatttggaggctgattatgggatggatccctgcatatggcaatcactagatggtccatcctttcgtcacagctccaaattttgtctctgtaactccttccatgggtgttttgttcccatttctaagaaagggtaaagtgtccacactttggtctttgttcttcttgaatttaatgcgtttggcaagttgtatcttatatcttgggtatcctaagtttctgggctaatatccacttatcagtgagtacatattgtgtgagttcctttgtgattgggttacttcactcaggatgataccctccaggtccatccatttgcctaggaatttcataaattcatttttttaatagctgagtagtattccattgtgtaaatgtaccacattttctgtatccattcctctgttgaggggcatctgggttctttccagcttctggctattataaacaaggctgctatgaacatagtggagcatgtgttcttcttaccggttaggacatcttctggatatatgcccaggagaggtattgctggatcctccggtagtactatgtccaattttctgagggactgccagactgatttgcagagtggttgtacaagcttgcaatcccaccaacaatggaggagtgttcccctttctccacatcctcgccagcatctgctgtcacctgaatttttgatcttagccattctgactggagtgaagtgggatctcagggttgttttgatttgcatttccctgatgattaaggatgttcttgttgcgtatgactcacttatttctctggagtttcggggatcatagtatcaggttctctatgaggagtggaaattggattttacccacttgccacccatctcccagggcaggcttctcaatccataccttctaaatagagaactcacaggcaaaccctctactgaaactgggtgggacagagtcagcttttcaggccctggtagcaatttggctaaatcttgtcttctggagtgagtgctcagaggagtctggggagccgagccctccatgctgtaagccaactactgttctcttcgacaacagtgctccaaaatcagatataaaagccagacaccattgatgtctttggttctcttcttaaaccttagatattgaaggctgtctctttttttgtgaccagttttagcaggcaaaaagaaaccaaagaaatacatatatgtgtagttcatataagtaacatgtgaacatattttatactcacatgcgcacacacacacttgggggtaggggtaaagggggtatgcaaatctaaagagttatcacgtgaccccaaagaaaggtggcatccacaacacatatacagccagaacaaaaagggcacctgtttaatatctgaatattccttactaatttgtttggcagaggggaagctatccccaggtctctgcccttgtcagctaagcagactgatatcagttaaaaacagtttttgctctaagttgagccccacccccttttaactgaaatcagctggcttctggcagtcacgtgcttctgactacccagaatggaagccttggctttaaggcaaatgtggaagcaaaggatatccaccgacactatgaagtacatagagtcaaaggaagaagtctagcaaagactggaaagacatgtactgcaggcaaaactgaggcagaaaagctccctctgaattcagtgcccacgtggttttcacatggtgctctaaaacagcaaaacaaggcaaaactgttcccttgattgacaggcagcagcacaatgaggaaaaattttagtgaaatgagatagatcaaaaaagaatgagcaagaactcaggaaaaacaaggttttagggagaaatagcttaaatggaggaatgctgtcactagattggaaatgtccatggcttccttagtgaagcaagaatctgaatggctactctggatcctgaatccaaattcacgtagaaatctccatctctaccctcttggcactgtactcagccatgcttatattaataacagacccttaggaaatctgtaagaaagtgggttaaattgcttgtcatgcatcaaagcctcgaattcaaatccacagaacctaattgaagtgatacatgacagcttgtgtctgtaatcatgacacttctactgtgacatggaaggtggagacaagagactcctgggggttcacagtctagctatcctgctttacacatcagcaaactctggaagacagcctctgagtagaagatgatgacggacatccagaattgtctccaatgttgtgtgcacacacctgcattcatcgatacaaacatatatacgtacacatgcacacgccaaacacacacacaaagacctttgcccccaattttggaacatctctctcatctgaggattgccatcttcctctcatgggctcttctctttcccccagcatgggagcagcagatcctcaggacactgccaggtctttccaccatctaggcacatatagaccacatatagacacatataagggtaccatatagaccagacactacatatgtggatgcttcagggatctgagcaagccatatgagtaatgcaggaccagagggtaggaacggagggccaagggaaagcctgtgcccaaaagacggcagccacagctcaggggaccaagcagaaatgtggacccagtgcagactgtctatcttcttttcagcaaaatcgtaaactctgtggctttgcatgaaacccgttaatattacctattagaaacaggataggagtcaaacaatgccagtcaaaagagaactaacactaggtttaagttgactctgggggctagtatgacaacaaggggtcatctggcctcctccccatcgggtctcatgactctcgaagactactagtgttcttttctgagtttgtgtctcttgatatttgtattagaaagagaaactggaagtcaagcatggcgctgcccacttgtctagagacagacccatgaagcctatctagcaagttggagattagtctgtgttacatgagagctttgtgtcagaagaagggggaagttgaaattgaaaatgtagtaagtaacaaaagtcaactcattatatctttttttaaaatttttttagtgtggaatagagtttatttagggcatggggaggggaattaagagagtattagaggcaaagaaaggcagagagaaggagagagtagagaagtagaggctggccatggccacatggagagagggggaaagggaattcagagagaagggacacaagggggaaagaggcaagaaagcatcaagagtgtaagagggtaagagcaactcattatgtcttatcagcaataaatacttaagagactgaagagatgggtcagtggttaaagagtaaagcaagggccatgtaagtttgaggaccagagttcagatccccagaaccaatatcaatgccaggtagacatgacaccccacctgtatctctactctctgaaagtggagaagagagatcccccgagcaggctggctagtgagactagccatattgggtttgatggcgaaactctgcctcaaagaacaggatgggagggctatcaagagtgatgcctagctagcattgacctcagctttccacaagcatgctcacacacatgttgtgagcaccccccaacacacacacacacacacacacatacacatgcccacacacatgcaacacacatacacataaaaatggaaaaagaaataaatattataattttattttaaaactattttcaaaagataagaggaattagactgatagtcttcaaatttggcaaatcttcagtgatgttctcatttctactttgcattcaatctcttgttgggtttttgttgttgttgttgttgttgttttatatttataagcacatattagtggaacatatttatatggtgcagggagatgtttcaatacatttttctatgattaaatcatggtaaatgttgttccaggaagcatttgtgaaccccaaagaccaccaaggagccatctctgatgtaatagcattagggtctctactacaagctcaggcttgtgctctcctccaactcaaccctgacacagcagaataggaagggaaggcagagcagccttgaacactcagcaggacaaggttgtatagggaatgggagcaagtgagggggtgtccatcttgccaagcatctaactggatgtctattgtaagcagacaggtgggtgctctgaagcaagaacatgaactaattacatctgaaagagtcagactaatctgttgctagaaagtagctatggagtaactctttggtatagaccaaggacaagtcatggggtccttcctggtagttaggtgcagcttgggttctgttgcaggtcaagttctcagggtttttaatttttctttaagatggaggccagtcccaagatggtataggtttggcctctcatgatgagcatatccatcactttcaatggttattctgtactgcaataattcagtcaaaaattttaattctattctttgaggtaagataggtgaaccctgaggacactgtgttaactgacataggccaggcacagaaagacaagggctacatgatctccagtgactgtggagtctaacacaggcggtcttccagaaggaaggaatagaacgtgattacccaaagctggggctgtagaaaggtgtagcagataggatagacagcaagagacatgatgctctgtgtgaactccaacactgaaagtcacaaaccacgtgtgtctcgggctttctagtgctgtgacagaacaccatgaccagaagcaacttggaaaggaacaggtttatttcagatgataatcctcaagtcacactcttcactgagagaagttggtgtagaaacttctggcaggaacctggaggcaggaactgaggtagagaccatggaggaatgctgttttctggcttgttctctgtgacttgcccagcctgctttcttatagaacccaggaacatctctccaggggtggcactgtcctcatgcttgcccacatcagtcatgaaccaagaaaatgcccccaaagagtgcctgaaaggtgagtcagtctggtgaaggcaatttcttaactgatggtcctatttttagcttttggttgtaatcaatcacattatgtttccatctcattcaaagtcaatccagcgcaggattgtaaatgtcgaacaggagatcatagcaataaaatttacctggcatttgtcaatagcttctttgcttatgaaggattttgtaatgtcatgcattggtaatctagaaaatgttagttcactcagatgtatcagatagtctaaacgcttacacagttgatttaacaacatcaaaacatcgcatgacctactgctgtctaatagcactttatctcatcaagaaagtattgagaatctgtcaaatattggcagcacatttaattttttttaaatcctaatccttgctagaaagctcaaatgttaccattggcaataagccctgtcagatgttcttcttggagcgacaggctcacttcactcaacttcaagaaaaatgtatccaaacattcatgtctggataatctgtcaatccttctttttaaaatgttttttggaagagtgatgctctgtgggggaaatccactatcccaatcccaatacaatcatgggcttacttttcctgtggggatcgttttaggtagaaatgaaatccaagtacttatgtgtgttttgcaatttatcaccaagcctattaaatggacatggacttgggaacaccaatacttaaagaaattgttgtgtgagaagatgtttcctgggtaaatgcttcacaaatccacttataccagatagggagcctatgagagaccaacatgtagataccacacaagtctgacttggtgaaccgtgagttttcctgaggttactgatgggaatatgagcaagagattatttgcaggagcagaaatgactcaaagatatctgcaccaccaaaacccaccccagcatggtgacagctcacagacgctgggaacctggagaacaccggtggcaaagcctgtaggcagctcaataggttagagagtgtcctttccaagggatttaggacacctcttctgggcagctcttaggcatatgccccacctacctcttgtgtgtgaaggtcacagcaaagcatcagagcttgtagggaaatgatgcacacaaggtaaaatgaaaactagaaactcttagttgggctggttcaacctgctagagtctgacaccagatggttcatgttagacatattttaagtacactattactttggggtaaaagtttcctggtaataattatcaatcttacctgcacaataaggcttaaggtgtgtgaacacattgaaactcttctgcaaaatgcatgagacagagaagatgtgttccatagtttaaggacctaggatctgatgtgctctctgagcgagatagtgtagtagtcagcaggctatgaagtacaggtgacatctcccctaagggtgagttatattgactataagacaaagataaagatctagggagggagagtctgggatacacattctgagggatttgggtgaagtctggtcctacagatagcaaaggtcaccaggtcattaaaaaatccacttccaccttctgagtggaaaacagctatacatttcctccattgaggagacagccctgatgactaatggggtggtttctccagtacttaactgtgaacacctgtgtcctctacacttgggtgcctgccccacctaccccttggttatgtgatgctgttattttcttagcaaaccccatttatgtgacccttctgaaattctttcctgtggtacactgtccttgctacacctgagtgaagtctcggaggagaaaagggtgtctccttggtatgtttaatgatagggccagattctgttttcctagcttgtctgtgacaggatgcttacctgagcttccttcaaaacctaggatagatgaaaaaatatgatacatcaaaataacgttaaaactggacactgtgcttattgtaaatagttatggttcgttaagtgcactgtcagtaaatcctgggagaaaagtaaaatttacataaaacctttacttatttatcttatattttctgataacatacatttatccccaaaattctagcctcctgtgtcagtgtcaaaatgaattttattagtcagcattctctagagtcgtagaacttatggaagaatttctctatatattaagggagtttattgtgatgacttacagtctatagtccaactaaacacaacaatgggcagctgtggatgggaattcaaaaaatctagtagttgctcagtcccacaggctagatgtctcagctggtcttctgtagaagtaggttccaacagatgtgctggcaggtaagtgcaagcagttgaagaagagtgaatcttccttcttccaacgtctttatgtaggtccccagtagaaggtgtggcccagattaatgtgtgtaccaccacacctgaatcagggacttgttttgtcccaggctgatcttgaactcagagatctccttgtctcagtctcctggaattaaaggagcgtgcatactaccttccctgggcctaagctttccatagcca

SEQ ID NO: 416 - DNA, 3103 bp, Mus musculus
ttcaggtggacaggacggaggtgattcgtacctgcataaacccagtgtactcaaagctgtttacagtggacttttattttgaagaggtccaacgtctccggtttgaagttcatgacatcagcagcaaccacaatggactgaaggaggctgacttccttggtggcatggagtgcacacttggccagattgtctcacagagaaagctctccaagtccttgctgaagcatgggaacacagcagggaaatcctccatcacggtgattgctgaagaattatcgggcaatgacgactatgttgagcttgcattcaatgcacggaaattggatgataaggatttcttcagtaaatcagacccatttctggaaattttcagaatgaacgatgacgcgactcaacagcttgtgcatcgaacagaggttgtgatgaataacttaagcccagcctggaagtcattcaaagtatcggtaaactctctatgcagtggagatccagaccgcaggctgaagtgcatagtgtgggactgggactccaacggcaagcatgacttcatcggagagttcacctccaccttcaaggagatgagaggagccatggaagggaaacaggtacagtgggaatgcatcaaccccaagtacaaagccaagaagaaaaattacaagaactcaggcatggtgattctaaaccagtgcaaggtagctatagacttcactgcctctaatggggaccccagaaacagctgttccctgcattatatccacccttaccagcctaatgagtacctaaaggccttggtggctgtgggagagatttgccaagactatgacagtgacaaaatgttcccagcttttgggtttggcgccaggatacccccggaatacacggtctctcatgactttgcaatcaactttaatgaagacaacccggagtgtgcaggaattcaaggagtcgtggaagcctatcagagctgtcttcccaagctccagctttatggtcccaccaacatcgctcccatcattcagaaggttgccaagtcagcctcagaggagacaaacaccaaggaagcatcgcaatacttcatcctgctgatcctgacagacggggtcatcacagacatggctgacacccgggaggccatcgtccacgcctcccacctccccatgtcagtcatcatcgtgggggtggggaacgctgacttcagtgacatgcagatgctggacggtgacgacggaattctaaggtcacccaagggagagcctgtccttcgagacatcgtccagtttgtgcccttccggaacttcaaacacgcatcgccagctgcccttgccaagagtgtgttggctgaagtcccaaatcaagtcgtagactattacaatggtaaagggattaaaccaaagtgctcatcggaagtatatgaatcgtcccggacactggcaccgtgaactacacttttacagaattctgaagcactgtttatctattcctgtactttaaataacaacaaaaacaaacaaaaaaaacccaataatatacatttaaagatagcacgttttggtgatttttaattaactgactttttattttattttattttttgcatgtgtagcccaaggcctggatctgttaaacccttgaattgttaaagactttttacaatgaaatacagttataacatactctttacagcatgtcgccttggaattaaaatggtatatgtatccatttttataccggtttgttgaaattttgctaaatttcttattatctttacactgtaaagcattttgaaacatttcgtgaatgtcgatagccaaaacgtatatttggcttaatctcctataggatgagagatttttcaaaatggcagatgcatggactgtattttgcatgtttaaaataattataataaaaataaccttacactgtttttgcagttgttatctataatctctccctgctgagaatggtctctctctactaaataaatttatgtacctagaggtagtcttttttgaagcgggcttgggttatttatcccagtacccatctttacacactcccattgacacaaattcctggacaatcttgttctaatgaagctttctaatgcggggcctgaggttctgcacatctcacaaggtcctcaatgatgctagtgcatcccttgcatggcatgaggactaatggggctctgaacttgaggctttcaccacagagatcatgccaaacagaacaactcctagcctgtttgcccatggcacctcttccacccaccaggctccccagtagcttagaggaccagcctgtctccaagatgagactagaaagtaaggagactgattccagaagctgtccacccgacatcccagcctcgctgttttatagccccgcctcttcctcatccggactgaggagcacgccttctggtttgctcctgcttggctaaaaggggcagcacagctccctgcatgggtggttccattttttatgccagttcctagaaattatttcccaagattcctcccttggatctttgagtgggatcctcttcatgccaaatagcaacatggctgtccaactttccgttctaatcgcttggtctttgagctcactgtgggggccttttttgaccgcttttgtatcactcctgagtacaatttccataagcagaagtgccctggaattgtgtagggtggagatattttgtctgaatctaaggaagtctaaaaccaaaataatgacttcctcttctcttatgatattctctccaagaaatggacaaatgttttataagctataaaaggcacaaaatgtaacttatttttggtcagaaaaatagagaagtgtatccaaagcaaaagaaatctgttgttggggtagtttgggttctttttctttttttttgaagcggaaacaataataattaattaagcaaatcaaatgtcttgtacgatttccagagttataattatagattatcttgcaaatacatgtcaaccaaatgcataacattttgggaatgatggtttaaaaaatgtacgacagaaaaaaacagtcacaaatgtttaaattgtattgttttctgaataaattgggtactaacaga

SEQ ID NO: 417 - protein, 391 aa, Mus musculus
QVDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGMVILNQCKVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIV

SEQ ID NO: 418 - DNA, 209484 bp, Homo sapiens
  misc_feature (1)...(209484): n = A,T,C or G
cttcactatttttaaacatcaattaataagaaaaccaaggctctccatcctcgggtgacctctctggaggactccacagctgtaacagagaaatgagatggtgggaacatcctgttaataaccaacatctgagtgaagtgaaaattgctttacacttgtgtgggattagactcctagcttctataaactgaggatctgacagtcactgcaagttcgagtgactgcaatccaacaccttcctgctcccaatcttggcaggctctgcctgcttttagcaggcaggcatgaattttgtgaggcagtttctgattgcttgatatttatgtgccagcttacagctggagttggggggtatacggcagttgatttaggactgaaaaacatcttctatgttatagaatcatatcttgtcctctggcctggaacattttgatttctcatgagatattctaggggggctttagccaagtggaaggaacttaaagagcaaaatataacaagaggaggaagagaaagtttgaagattggtaaacactgtgctggacactcaacagtcacactgaagagacttttcagggtttgttgcccagacgatggtgtttggagcattgagcattctgaatggccccacttgaaaaattgctgtggtcagatggtacctgaatatatttgtcttcttcaagagaggtgctatgtcatgggaaacagctttaagggaaatctcaagtagttccatcactcgacagctgggtgaccttaggcaagttaacctttttggttctaagtttcctcatgtgtaaaacagtaagtcataatatatagttgttgggatgattaagtggaataaggtatgtaaagtggtttaaataattcttggtgcatacccattgctcagtaaatgctccttatgatccattgttgagtaacattgggaaatatggtgttgtcactaacaggaagttaccacaaaaatcacatatggattacaagttttcaaagttttaaaagcccataattcattaatcatgaaccatcagaatggacacaatttcacctgcccttgagatttagaagctcttccaggttctgtaatatcttgaaacatttttaagagcattaaggaatcaatcaaagttccagcagaaaaagagatgttcatgaagggaccgcttcaagatgtgtgggcaaggttaaaggaaccagcaagagactctgagatgccctgggactagcaatagtcagaagctactattagagggacttggtgggcagacagcggtggcagtgttactggaacccagggagagctggagctttgcaggaagggcggctaggagggcctgtagacagagggtacaccatgggttcctcctgtcttctagtctcctactggtgctttccattggctgaaagaaggtgagctgggccaagaaacctgaatgaaacaatccacatgtgggctggtctcctggtacatagcagagcagaaagacctggggatgtaaaggagaatggataccatattcactaactcttgtttcacaaatagggagtgtgccagttaatggagtgcttgattggataaaacatccaaataaaccaactttgcccataatacgattatttctttcattcattccttatgtcctatagtgacataagcagcagtcaaaatggcagctttcaaagaagcaggaaagtattagcatataaggtctgatccagaggttggggtgtggtattcagagtagatcacacactagccctggttcctggttgtcatccactttggagctgagccataacagttggaatatagtattattggttctacaacttaactgtgcattggaatcacctgggtagatttttaaattgctgatgcattggttccccgccacccccacacagtttccaaattaattggtttggagatccccaggtggtttcgatgcaagaaaagtttgagaattactagtatatatgttgacatcacctgggaatctccaggccaattaaatgtgtgtgtactatacaggatttcactaaactacagcaagatagagctggcacaggctagaacagtactgtccccatgtggctatttaaatttaaatttaaaattccattcttcagtcccactagccacatttcaagtgctgaatacctacatgtggctagtttggaccatgaagaacatcatggaaagttctatcacacagcactaggacagtgacaaacccctcaagctgagtggactggggcaaaagacaatgaggcatacaaaccgagaaatcagaaaacagcctcacaaactggacactcacactggggaaaaggaacagctatagaggacacgcagcatttggcactggaagatgtagctgagatctacgcttctgtggcaaatcaggcaggatttgctcatgctctgtgtggatggagccagcagcttgaaggtactgaggaggccaacgaaggaaggggaagacccagaacatattagcacttgagacctctctgatggtgcctacgggggatactcatttcatttacttctgagccacattcctaagcaaggatgcaaccctgctgtctgctttgaatagcataagtaccaggctatgtctactggtgaaacgaatgtctagctctaggttctccggcatgttcatcccaggggatccataagcagaacccagtgtgccagaggccctgttacttgagaaccaggttaactgcatggcaggaggatgaaggcagggttcaatggattgaaagtgggagaaagacacttgtcatgctggatcactcgttcagtttaatctggagtatttgaaggttttactgcttgatgggtgaagagtgcttttttggagatatatccattaagtggtgctgccagtctggatgtttcttaagtagaatggtgtatttgtttaccagggttgccatagcaaagtaccataaactgggtggcttaaacaacagaaatttattccttcacagttctggaggctagaagtccaagatcaagacatcagaatgtcagcagaactggttctctctggggttactaggaagaaattgcttaatgctcctctcctggcttttggtagttttgctggaaatctttggcatttcttggcttgtgctgaggaacaagagattgcaccactctgctctcttcctttgtgttcacatggcattctccctgtgttcatgtctgtgtcaaaatttcccatttttataaggacattagtcatatcaaatcagaaaccgaccatactccagtatgaccttatcctaagttaattacttctgccacaatcctatttccatatgaagtcacattctaagacactggtatatgaattttgagggataaaactcaacctataacaaatgacatagtataataaaaagagcatatattctagagtgagaaagactggagttgagtcttacctttgccactacttttctgatacacagttttattttatcatttgcaaagttagaatgatatatttaataggatcatttgtaaaattataaatcagtgttaaaatgaaccattatttttatgtttccctaggaaagaaaaaaattgtttccaattatactatgacatatcaattataatatgcatcccaatttcaaagatattccaattaaacaatatatcatcaattacaacatgcatcccaatttcagagatattccaattaaacaatggtatatcattaattataacatgcactccaatttcaaatatattccaattaaacaatggcatataattaaaacacacataccaatttcaaatatatcaaactgtgaaataaaagtatgttttaaagttgatgagggtaaggcttgaagaagataacatgtaagtgccttctgcctgagcagaaaagttaccatcactgtcggtcaccacctaatttgccatccatttcaagaaggaatttaataatttactaggcaggaggcagcttccacccaagttgttaaggagaaacaaaggctgtcaaatactcaggcatttttttagtcctaggaactagtgagcaggaacccctggtccatgtggcagatcagccagacagccagaaatgatgcaacctcagtatgtagacatatcacacagaaatggcacaaatcaattcaagtttccacatgagactttttacacaaccagcaaactgttaaggagttttaatcctaacaaagtagaaaatccatttaaattgaaaattaaaaccatgtctcatcagcaccaacctatctctctctgttgagtgattttgagatctgcaacttgtttgttgcagctacagaacaagccactaactctgaggccagtcacttaaaatcagcagtcacaagcagctgaaatcctgaaattgaataatgctatttctggtggcttggtgattcattttattatctaacttttgtgtggtttaatatgtctccttggaagttacatggtttgaaaaattgcctgtaataaatcctttatttttaaacataaagccattctttattcagagaaaattagtttctccctaccctcactaaataaatattgacaaaatatttaaagaatatcagtttgaaggaatacctaattataagcctgccctgagggcctcttgtctctctctggcctatgatgtcattctttaccaagacctattacccatgggatgataagggcctgaatttctccaggaaaccttagagcattcagtgactgacaataattttggcttttgccttcacctcctccccactgatagcatcacacgatttagctctcacctctcccgcaactttgcctgtggcagttccagcccttggaagtcccagagaatagatggccattgtacaaatagtcttgaattgtttgttgatgacacattgccccgcacacaagccaatttttttttttttttttttttttttgaggctctgttgcccaggctggagtgcagtggcctgatctctgttcactgcaagctccgcctcccgggttcacgccattctcctgcctcagcctcccgagtagctgggactacaggcgcctgccaccacgaccggctaatttttttttttgtaagtagagacggggtttcaccatgttagccaggatggtctccatctcctgacctcgtgatccgcccgcctcggcctcccaaagtgctgggattataggcgtgagccactgcgcccggccacacaatccaatttctatgggcagtgtttagggcccccactgtatctcaaatatgtccagtggataaatcagatctccagagacacaactgcagcctcaatcattgactttccctatcagttccacattttatgtttgtcgtctggatgatgcattactttgagcaacagtgtttatgaaaaaatgcttcaaatttgcataactatatagcatagaggttaaacacacaggttctggagcttaactacataggttcacatcccacctctgctacctacaagttgtgtaaaatcggaaaagttatggcggtctctctatctcccagtaagagaggataataacagtacctacctcatattgttataagaatgaaaacagagtgcttgtcaaaagatttgaaaagctgcttcatcaaagaagatacacaggtggcaagtaagcatacgaaaagagcctcagcatcattagttttaggaaaacgaaaattaaaaccacaatgagagaccactccacacctactagaacttaaaaagttaagcaaaaatctctttcactcctacatatttacccaaaagaagaggaaatacatgcccatacaaaggattgtacatgaatatgtcatgcagttttatatgtaatagccaaaaactgtaaacaattcaaatgtccatctgtaattgactgggggcaataaaaggataaactactgataggaccacatgaataaatctcaaaataattgcgtgaaagattaaagacaataaaagaccacagattatgatatacatttatataatattataaagaatacaaactagactgtagtctcagaaagcagatcagtagtttcttgggaatggaaggagggaaggttgagaggatgaggatacataggagtaagagaaaaatttgggtgcatggatatgctcactctcttgattgtggtgatgttttcacaagtatatatgtgtcaaaacatattgaattgtatactttaaatagatatatactttaaatagatgtggtttattatatgcaaattatgcctcaataatgctgttttttttaaatgagcaccatgatagcaggccttccaaaagtgttagttgttattgactttattattagactgaaaaatgttttagatttttttttcttttttttgagacggagtcttgctctgtcgcccaggctggagtgcagtggcggggtttcaccatgttaggcaggatggtcttgatttcctgactttgtgatccaccctcctcggcctccaaaagtgctgggattacaggcttgagccactgcgcctggccgtgttttagatatttttaaaagcttctcatgagaagcaatattcaatggttgagtctctcaccatcacaccataatctagctgcctttttcctttctaaggatgctcatgaattgaggaaagtagtccagactttgaggtcagaaggcatgagttcaagtgcccactctgacattcaataccttgtgctgatatttaaccttgagttttctcatttgtaaaatagtatacaactatatcacatgatagccataagaatcaaattttaaaaatggatgtgagcatgttctgtaaacaataaagcaatgtgaatttatcagtcatcacgattagggaagagagaagataagcattcacatttttgcagactggataacagagggtaagcaagattaaaataaaacttgacctcacacaagagcatgagatagactctacatctcctcatttcccctaggactgatgttcccacaccagaattctctagaacacttttttagagatttctgggtcctaccatatactcactaaatcagaatgacctggggttaggaaacaggaatctgagttttaaagaaagcccccccgccccccccagttgattaggatgcagctggtagcaccagtaagtgaatgatcttttgggaaaaactgccttgaccctgatgcctctcaatgagaaatgaacaatcctaggccctgttgctcatgtgaaacctggattaggcaccagaaaaaaataatgcatcttccataataactggaaatgcataatattttaaaacatctttcaaatatgcatttattattgcaagcacttcgcttattgtcattttcctgcttttcctgagcagttatattcaggattcttagtggctttctgattatccttggaaatcgtctgtcttgctaatacaaatgtttatcacttaatgtctttccatcttgtcatttcgctcaaaaaaccaagtcactcagtgctggcagcttaccttgtatagtgtgtatgaggtgtgtggcttgatgccaacatgaactttataagggaatgccactggaaaatcaagaagttagaagaaaagtaccagaattggtgcacatcacttatttgtgccctttggggcagttaaaggagaataacaaagactagagtttccatcacctgtcttctatcatctaaacctattcagcactctcttccagcaacaaggagagcaggtgccctttttgtgtcttgaggatgtcaaatgcacccacagcatacttcttggggttatttccaaatcctctatcaaaagatacaatataaatataattaaatctcttatatggctcattatttcatgaatttggaccagatgttgcaaaaaatgcctctaggggccaggaagagaaattaaatgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcaacacccctgtgttaattgaaatgaatgggctgaacattatacacttaataaagggcatactcgagaccaaaggcagttattgtcttatctattctcatggtttttctacttcattatgctggaaatcatggattaggaaacttagagttggctaaaatgagacacctacatagcactttctccattactgtgcccaccagacatttttaatcaattacagatttctttcctcctgagcctagatgtgacctcaggcacattaggcgggacaaggttgaatcaatcatgaaatgcatcaatcaatcatttatgcacctgcataaacccagtgtactcaaaaatttttactgttcataatgttcacccactcatttcaattccctggacctcagttttcccatcaacaaaatgacataatgatataatgatacaattttgtataatgcaaactcatacaatgagctctaaatcttcaagttatttacatgtctaacattattttcttccctaaaactcgtctcattctctgaaggtattgcctgtactttgtacttttggactgcccacccaatgacttgctggggagcatttatggttgggaagaagggaagtgctctgagatgaattttcttgaacggtaataataaaaataatccttatctctgataggttttctctttctccttgcaggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccaggtgggtcaacagacatcccttcctcctccttgccatcctagggcctttcttcctgccccctttccctctcttccttcatctaatccttgctttttcctattgattgtattttctttaacatgcagcattttacaacttcccaggtggtgtcatatccattatgtttatgtagagatgattctgcaagtctgtacgatttcttattttgaaaaattcagaactttctcttctgaattcccccactgtgtcactcatttattcaacaactattattgagcacttatgtgtctggctctatgctcttttcacatgtctgttatagccttatcctgtttcactataaatttccatctccaactcagctgtgagaacccctatgcagcaagtatttctcattcacatttagtcgacatctctggtaccaaaaatagcccaaggcagaggctaaatggatactcagtgaatgaataaaagctcttaattttccaacaataatatgaaataaatatcagtattatatccattttatcagtgagaaacctgagactcagagaggttaagtgatttgatgaaggctctacctaataagtagcagtgttaggactctactaggtcttcctgactctaaacttcatcattttgcttctgtaatacttttccttttttcctttcctttttgttgtacccagaaatgcagtaagtgagtcaaaaagtaaaaacagtccctgtgcccagatagtggataatcttactggagaaggcatagtaatatgcacttcaaatagagcagttcattacaaaataccctgggctctctatacaaggtcgtagaccttaaaggaagagagagcttttttctactgggtagagtcaaagaaggcattgtggcaccaaaatctgaaaaaaacattatctagggattgcagaagaaagaggaggggagacttccaagtaagaaagcaatataagcaactcataggggtcagaacaaacgtgggggggtatggggtgggaagagaccactttccctgactgaatcaagatgctgatttactgtgaaattgatgaagctttaacatcagatcccctctctcatgtgggccccttccatggctctgtgtcacatttttattttgtactttttttctcaaagagagattccaaattatatgtcttaagacccacaaaatctgggttcacctcctgtcaaggtaagggtcaggtttaaggatttgtcaggaagagtctacctgacaaagagatggcaagcatatatatttgcttgttcatttgtgcttaccttgcttcatgccacttatcactaaaagaaatttctcccagtgagcactaagagacaaaatagacagtgtcctctgttccccttttccagaaaatatagtgattaattttcttattcctttaatgaaagtcaaaagcccaatactgaaatacagttgaggggagacagaaagagaatctgaaatattctccattaacatatgttctctaatgacttttgaagagttgatggcagatagttcaaaggatcttgccaggtacaatgtccactaagtaggtattaaatgaataaatgcattgtggatttgagatgaaatcctgtttctatttaaaaatgattaaaatggcatcttttatagacatgtaagccatgccaagattctcccttaaacaatgggcatccctcctatgcataaattttatattttgtcacaagaaataaaggtagatccggccaggcgcggtggctcacaccagtaatcctagcactttgggaagccaaggagggcagatcacgaggccaggagatcgagaccatcctggataacacggtgaaaccccgtctctactaaaaatacaaaaaaatagccgggtgtggtggcaggtgcctatagtcccagctactcgtgaggctgaggcaggaggatggcgtgaacccggaaggcggagcttgcagtgagccgagatcgtgccagtgcgctccagcctgggtgacagagcaagactccgtctcaaaaaaaaaaaaaaaatggtagatccgtgtgggaatcatgtggactaaagatctttttttttttttttttttggtccaaagctttgataattttatctgtttgaatgaccctcaaactcaaatctttagtccctcacaaggctcatctttccaaaagccagtaagtccttaaccttgcaagtaagacaggcattatgctaggtgccagtgacactgtggtgagccaaaaaacataatccttgccttcaagcagcagtttagttggggataaagatggaatgaaaataattacacaacaattaattaaatggcgattatcataagctttgttacagagaagtacagaataagagagcaagcattgggagactggcatcaggcagagagagggatcaaataaggctttctaagagaagtgacatttatactgacttgaagggagagtgagagtgcatcaggtgagaagaaagagaaacacattctaagcagatgggaacattatacacaaagcctctgtattcaggaaggagtttggcatatggtgcagagcatcttcatttggtttttccaagaagccaaatctgaggtaagaagtcaaaggaggtgaaggaaacgccatagtggagaggaaaagtgagacaggataagcagcctacaagggaaagtggtcaagtagataccaccgtacgtaactggagcttaactctgctggggaaattctgagagcagtgtaatgcaaacattacagatatttcatcctgtggatgagggaactgggacatttatacactttgtgtatatatactcacatcagccatgaagaaccattcctagccgggcgcggtggctcacgcctgtaatcccagcactttgggaagccgaggcaggcggatcacaaggtcaggagatcgagaccatcctggctaacacggtgaaaccccatctctactaaaaatgcaaaaaattagctgggcgtggtggtgcatgcctgtagtcccagctactcgggaggctgaggcaggagaatcacttgaacccaggaggcagaggttgcattgagccgagatcatgccactgcactccagcctgggtgacagtgagactccgtctcaaaaaaaaaaaaaaaaaaacccattcctgttcctaaggtgggaacattaatcctccagtcctccaacatttctggcctactgtgcaggtagcaaactccaaatatcacaaagagcttgcaagcaaagaaatacagatgccggtggtcaaagtcagtgatgggcactcaagtcatagggcctgggaatatgagtggggagctgacagcatctgtggattgcctatttaatacccaatcacccactcttgtagctgttgactctgatcactttctgatcattttataccatctgtctatgtagaaaagagccctatccctagctcaagagtgaatcctgagtgatctcagctaatcacatgaatctcatcacccacttgcaagagtttggtttagaggtaggcgtgtgtccagtaagacatgtggatttttcttggaaaggtttcctagcctaaaacaagagacacgcatgaagaaacagttcttctttgcctgtgattcctggaaccactacagccatcttgcagcaaggctgaggatgagagtgacccttaggggaggtcagacccaaaagatgtggagggatgggcctgacattctttacctgggacccactctatctatggatgccttattatgggaaaataaaatgtcctgtcattgaagctgtttgacatgggaatttttattccttgaactgaaaacatcatgatggagatagcacatatgaggaactaaaaagaaggacaggctggctggagtggggtgaacaaagggaaactagggggttgtgttggattaattttcttaatctttcaaaagaaggaatgtgtggaagtgagcactgagaatgagattacaaatagtcctttcaagatacgtttttggtacttttgaaagaacttatatactgatcatttcatttgaccctcttgacagcctgggaaggacaggaatcattatctacattttataactgaggaaactgaagatcagaaagatttaatgtcttgacagggcctaaactggaagtcaggagcttttgattcttaatccagagcttgcttctgtcatgacctagggaaggatgagaggaggtcacctgttctgagaactccttcaagatcatggcctagatgaagcaaatgagcagcaagtgacttgttcagtgtatctctaaaccatgtttcccaaactgtactgatccactttgaggtgacatgctggcctctctggatatctcgcatgttctttggcaaccaccctctcatattgtcagccaggtgattggtggggttggcctttcccacacttttgggtaggcacagaatattacatttgtgtggccacagtgattggctcaaggaaagacatgatgactcctttaacactatagatttcattcattcgtttatttcttcttttaatgacatagcaattgcatgccaagctttcataacaaacgtttagcaagcaccctggatatgccaagtatacctggctgggtgctggagacacaaagatgaaaaaggaagacagaggccctgcctcagaaaagcttataattatctgagaaacacagactggtaaataaatactcaaaatgcatattactaagcactacaatagaaatgtgaatccaagggctgtaggggaaagacctctacctaaagtgaagcaggggagtctcacaggaaaggtgtctctggatctgaatccctaaggataagtaggaattcaccaacagagaaaagaaataaggactcttgggacaaaatgactggtacacgcaaagacacagcagcatgaagggaacgacagagaactcttaagtgacttagcgtgggtgagcggtcaagtgaggatgtgaaaaggatagaggatgccagatagaaaagaaaaagcctggtcctgatgcttttaagtgtttttctctaaactttagagagactggacttgatgcactgaggtcctaactggggaaaggacaagattggatgtgtatattagaaagatcactttggccgggtgcagtggctcacgcctgtaatccaagcacgctgaggctggcagatcatgaggtcaggagtttgagaccagcctggacaacatagtgaaacccatctctactaaaaatacaaaatattagccaggcatggtggcaggcgcctgtaattccagctacttgaaaggctgaggcaggagaattgcttgaacccgggaggcagaggttgcagttagccgagatcatgcccagcccaggcaacagtgcaatactctgtctcaaaagaaagaaagaaagagagagagacagagagagagagagagacagagagagagaaagaacagaaaggagagaaagaaaagaaagaaagaaagaaaagaaagaaagaaagaaagaaagaaagaaagaaagagaaagaaaagaaagaaagaaaggagggagggaggaaagaaagggagcgaggaaggaaggaaggaaggaagaaagatcactttggcattccccataaacggtggatggcagggaaaccaattaggatactagtgcaataacaggaaggaaatgcgggcggcagtagttatgtaaactgaaaagagggggccagaaaagagcctgtccaagagcagaatcaacaagccttggagatgaggtgagggaggcggagtttgcaggtgtctggcttagctaactgggggagcgatttggctgtctttaaggggaaatcaatcttgcccaggatgggggtgaggaatataacatgatgctggcctattaaatgcagatatctgtggagaattcagaggagggtgacaatcggcagctgacatgaatatagaatagacaatatagatgtgggagcttaatccctataggtgatagctgctaatattagagtggatgagattcttcgaggaggctgttttatctttacttttgaaaggaaattttttgaacgtgccatatataaacaaataataaagaattaaaaaatcaaggcatatgtaaggacatctctttccactttcagataaaagtgtgaactcgatgttgtctttaagaaaaaaaaaaaaaacctttgttgagtgttttttacatggagtaatatgccagacaaatgcatttgtactaaaagctttgtgaaggacaggcagaactttttaccctttgtggtttcacaggttttgacactttggcgtgaatgggggttttgctcttttcgctaaattgctcctctccagtatgatcaagcaaaaagaaaaaacatcaacattttccttctttaaaactccagagtaaaaagaaggtccttcttcctgtgttctgcctagataggcaaggaatggctagatgcagatgttgggcacccccgggcagggcagggtcagagtctgaggcactgtttcctagtgctgacgtgtacatggtgtggggtctgatggtctggggtcaaatcccagctcagctgctctcaacttgtttgtccagaggcaaattcttgcagccacttaagcctcagtttcttcatttgaaaaatggaaataataatagtgctgacttcaagaaaaattgcaaggatcaagtagaataatgcacataaaatgcttaacagagcccccggcatggagggagcactcgggatggggaagctgttattactgtggcaagaatctaggaaatgatgggaagaggcaatgcttgtagagaccaacatgttttcagaacaaagggggaaacatacagcgtgaaaacattgtgagagagcacctacgtcctgggcgagtataatagtaaaactgaacttacattgctcaggtttgtcaagtattttactgagttggattttaaatattgtgtgtgtacacacacgtacacgtgtatttattcttctgatactatttttaagtaaaaattgttttaaatcaggtctctgaaataatttggggcaattattttaatttgggccttaactgtggcaagatagggattgccacagttaaggccctaaaggaaagataaagtgacttccccaaagccacacaggaactcacacattcagagtctgcctcctgaaggctgctgtagtactcgctctgtctggctgagtttgccacattctcactcagccttgtgaaacagcaggactcctggcctttaggaaaggaaaatagaagccttaagcatgctagaaactggcattggtcataaagctgagtataagcacagcaagtgacttcacactgagcaaaaatgccaaataaagcaaagaaggctgaggtcctcagggaaactcaaggagaattgaccattcttgacagatggatgagggggatgcatcacgaggacatagggtactcagaagctgcctctttctgggtaagttttgagaccttccttagatttctgttgcccaaaagaaatcaaggagctaagcccctcttctgctacatccagtagtgggtacgccaaagagagatgtgatccttcactgcctagaacagcaagctgaccttctttcatgtgatgcatttattttctctttcactgcttattaactcattcattcatcctcatattttcccacttcatccaccaaagacagtggaactgagtcataaataagaaaaataattaaagaaatttttaaactccaggcacttttatttagtaggcactgggtgaagctgttgctatactgcacttcatttaatcagcacaacatccctgagaggtaggcactaccattattaccattttacagctgaggaaactgagactgagtaaagctcagtaagttatccaaggtcacacagcaagttgtcgatctctttagctccaaagccctgtataatcttttccatctattctaatagcttgtcactaactagtataaatgatcaagtagcatctatgaatgcaaagtcaaattggagttgacctggctagtttttggtgtcttgtttcttcttaagtttatttgtcttacacagagctgatagaggcagactaggaatccttttgcagataaatgggcttgatcatcttccctctgggcttctctactgaatttactttaaatataatatggcttcttaaaaaatggcagtgtgtcaacctccgaaaaccaaaatcttacaaactcagcacccagaaggtgcattgctctggccttcctttcaccttcaaccatgatgaaaaatcccttatcaaaattcagtggttgcacctgggtttcatcattgcttttcttgcaggcattttctcttctcagtggtttggaggacagttatgactgtgtgaagtcatcttctcttcattgttgtgtggctgttcttcagtgtatgtctcctccagaagttcagaggacacctgtcaaagccaagaacttcctgctttctgtcatcataagtggggctgggaaatccctgacaccttgaagaagtcctgggctgtcaggagtcctctgacccttattcatgagagagagattatataccatcttctctcagggcagtggttctcaaacttgagcatgtggcagaatcacctggaggcatattaaaatacaaattgctaggcctcacccccagagttatgattcaaaagatctagggagagattcaataatctgcattttctaagttcccaggtgatgcttattctgcaggtccagacatcacactttgagaagccctgccccaatgcctcatgtaagaggatgctaatgaatcttggacactgtattactagtttcaatcaagaaaggaaccagtgttttgggtaattatctggagaaattgaagaggacatagaaaacatctggtgaacagaaaaaagttgctttataaagtttacactacaaaaaggccaatgtacacagctttcagtttatgctcttggtaaagattttgagtgccaaagttttttctcccattcattaaatgaagttaaatggacttattatccattggtttccttcctgacataagtgaatgttaggattatgtcaggcacagtggtccctgaaagagtgggcagaccacaagctattgatcaatgggtattaggtttagtgtcgggatgagccaggttgctgaacactgggtgttatgatgatgctgagggtggtacccaaactcaatgtaatgcccacagtaagattccacaggttagcattttgttgcatactatctaatatcctcatggtataaaattgatgacccagggaagtcaaatttacacattacagcagggaagtcattctccttctgcttctcacatgcaaagcttgcccttactttgcagaattactgcaagcagaagccacgtgagtgatgaatgatgtcataagtaatcacatcatctcagctcccgtggactagataagaaatcctgggaagtagtgccatttttttttttacggctgtctgttctgctcataggcagctgggatttaagtagggtggttgtgggtgagaaggccccatttctacagggagaatataattaattcttgctctttttttctaacttctaaacaggcaaggaatcataactttggatcctagaaacatccctctgctttctctggagtcctccttttatactttgaaatctcctttagtgtcctggattggagtcatgagtcctatgtcttgatctgccatcaactctctgtatggccttgggcagtttgcttaacctctctgtgatatggtgacttcatctatagaacaaacattttgcattgattcatctctaagttccttccagttctaatagtcaatgattctcattcatctctttccttttcttgttttcgaaattcagcatctctccacacattctcatttcttttcaagacactctctcccccttccactaccctttctcatctcatctcatctcagcatgaagtatttatctcatgtaaagtcatagatgtcgttcagtcatagatggtatcattctacctacctggtagcccccaggaaaacaactgtatttaatttcaaagatagttataaaaagatgtatttagtgacaattaacacaggcccttttccatatacactcacattcattagtatgatacttctacaagctcaatattggtgcagaggagggcaagagctttggagctggatgacaatttgcaaggactagtgtatcaatgctaaaaaaaaaacagctacaggagcctgtcctgatcctaatcctttaagccaggctggtgcagggcacccagcccccagaccaccctatcagtgtgccctgggcctacctactcatccagggagccacttatgccacctgggttggcaggtggcataaggcagtttctcaggacctctcccacagctcccacttttgttgtttccaaccagctttcatttcaatcccatttccaccagctcagaagtactggctgtaaatctaatttagatcgctatctccatggcatttacacatactcttccaatcattcagcccttgtgtttcccctacaaatgctgccatgctgcaccttctcgattgtcagcatcctggctgctttaaataaaaatgtatgtccttgtcctagccctaaagcatgaaacactccaacactataaactgaattcatagtatggcaaacggccagtttgttgaagtctaataaccaaaaagccaattcacgaaataatatattaacccccaaaccaactctcttccaattacttttatttactaaaaactagatttcttgaactattgataaagtttactacaattattttagaagttgtgaagatttcgggaatatttgttggtttagactgcttatgaaatttagttattggttatcatgaatgtttctgaatatcaaatgtagccattaaaaagctaacctgtcccaacaggggattaaaaatatggtcctaactattaaagtacccatttctttacaggccaagagactgggaggatatatttttaaatgttaacggtgatgacatctaggttgtgggattatagatgatgtaggaaattacatctgtgcttttgtatttctaaaaggaaactatatcacatctatgattagaaaaatattataataaatgttaggcaaaacatcataataagacccgcatgctgacttcaaagaactcacactcaggtggaggagtaagacacgtaaacattgtgtagatttttaaacaaatgtggaagaactttaaaacttgtaaagaattctaatttgggaaatttacaggaaatccttttgggggaggcatttgctgaagctgtgctttctgtgaggtttttgaaagatcaatttgcagatgttagtccccacccctttgtccacagggaggagagttggctgggctaatttgattctgatcttttgaaatattatttttgattacagaagagacccaggagggcttggggcacgaagaacaaataagttaaggaacatctctggaactgaaaatgaggttctgagattcctccaaagtctagactcctcatttcaagctttatttgggaaagagaatagttttactttaaattaacctaataaagttgagggggaggaaaacaataactgcttggtttacaaaagcattcccacgagtcttggtttcagattcacagacaaaatgaggccgggtatgaattaattagctttgttttgcatggaacatgagccgtcaagggcccttcccatgtgagcacaggtcagcaaaggtgcatgctcttgggcctaatctccatccaggtaagcccagggtgggctgattactcgtgcttccctcactcttcttcagcatctgctcatcaggatgctcaggccagcacacgttttcaagccagttatcagaaacaaaggaaaacatatcccccaaacttctctctccccactgagattcaaaccagtaaaactggtattacagtgaatgtgctgacagggcaccagtcagcaagaccgaatcagaaaagcttaaaattgagaagacaaaagcagtgctgagtttagccaaccagagcaggcatctctgtgctgctctctggtgctcctggacaatgcttaaatactctttaagggggaattcacttttacatatcaggtattgtgagaatgatagggtaacctatgactcagtttgcccctgcctgtccggtttacacttactatcatggcttaattattaacactgttccctctcactttcaaaagtgtcccaatttggacaatatattttacgaccacttgatgataatcattttcatagctagtatttagtaagagctgatcacatgccaggcaatcatgagcttggtgctatcaacactatcatcatcattattatcatcactaggccaagattacatgcctcctgaagtggcaaaggaagggcttaacacctaacatttggattcagtcagagtgctaagctacttttcccttacctttaagctacattacctctgagcttttgttttataaacttaatgagaaaaagattcttgtccctttatgaatgccccaggtcttcccactgacttcctccttggttgtcaatcgaagggaagaaactgattttcagggggtcttgttatatctcagatattatgttatgtgaagccccgcttgataaattatgaattaggctctgggagctcaactgattcaccaaagagtacactgacagtaagttgcagagcgaaatttcaaacctaagttgttctgatttcaatacctgccttctcattatactaccttgcctactaagccactttcaatttctacaagcctgtgtaaatttgaaaaggtagagtagcagttcttcccatatgctgtcactgtaaaactgcccacagagaggataaaagtatccttcctcacaagttgataaattgactcctatatctaaaaagtgtctttttcccagctcaggcagacctgtaacatctatctgcaaatggacactccaccaaaatactcttggaccaaaaggtctaagaaatgtatagcagttagaccccatctttcccttgacatggatctattgtttatatggcagttaagggtaacaataatctgaaaataactgatatgtattcaatgaataatgcatctatctaatgctctcaataataatcaaaagctaatatacatgtactcacttattcaaataaatatatatggattctttatccacttattggaacttactatgtgccagacactcttgtaggcactgcagattcagttgtgaacaaaggaggcaaagccctgcctcatggagcttacctattcctacatgatacaataacagataataatgatctcattgaaagaaagcacacatgggataagaaatagagggtggcgggaaaggactgggtgctaatttaggtaggaatgtcaggaagtcagaagaaaatgtaaaagtgtgggcatgagccatgtaaagacatccagaaaagtgttccaggcagagggaagagcaagagttcttatattctgccagaccctatgctgaaagcttcgtacaaattatctcatttaatcctcacaaaccccctgagggtaagtgtcattatttcttcattttgctgctaagcatttgaaccttgaagtaacttgcttaggagcacacgattttctaatgagggaggcatgagttaaactgagccttctggctctgagataacatccccacctcaactactaaacagttccatgctttggtcagtctgcaacaacctctttgccagcacttttaacacaagatttagagaatggctgattgctgagaaacaacatctgcaaagcctgcatcaccaatggatccacagggatagggcatttaaatgattgggtccccatgttcaccagatacggcactctagcaactgctgggatctcttgctgctatgactctccttcagctctgttagaggctgtgggaccagcatcccaggctcttcctccggacacccaagaaattctcccacatgacgtcagtttaagccaagcaagaattttccgtccctccattgcattatttgtaggaaatggctttattgtttttctgtatgcaaagataatataggctcattgcaaaaactatttagaaatagaaaaaataaaatcaccaccattgagagataactaataaaaagcctaccattaagagataactactaaacatcctgatatcagaattcatgtaatgtgtccacttaccgtggacattaaggctgtttccagttttttagaattataacatttttatgagtattatattattatgtgtgtatgtatatatatatatatatatatatatatatatatatatatctttatgccctcagacactgattttttttagaatgaattagtaacagtgtattatttgagcattcattttaaggtccttgctataaactgccaaatatccccaaagaaaaactgtagcaacttacactgcccctttcagtgcacaaaggtgccttttttcctgcatcctcagtaacacctccaacttttcactttcttttgaagcttctatcaccacaaaaacaaggatacagcctctgtcctagttgaatgtccccccacagagccttcgccatccccagcctgagcagagaagacacagaggagagtgtgtcatccctcagctcccccttggccttggggactggtcccatcagaaggtttattcagaggctgagggtacagtgaagacaggagacatcactgtggttctcagcttggaagactgcctcactctcacacccttttctttctttatacattcctccatcagctcctgcccttccatttatcatctatacttggagactcttagctcaggactcttctttgagcccagactcatgtattcagcattctctagatattaattccacttgtatgactcacagacatctcaaactcagcagcccaaaacaaagctcttcatctcctcttgccctctccacaccccttgccatcttccccttcctctaatgtgtcctactcactcagtagctccttcttcttcccaggagccagaggtccagaccctaggagcttttcctcatggctctcattcactctctatcccacagcccatcaatcagtcatgaaggcccatcaattcagtgtctcaaatatctctactatccaccccttttcaccccttccacagccaggaccccagtctaagccaataggtgactataattatctctacatggggatttattgaatgggagagaaaagaagaggaaaatagcatttcccaaacatttgtatatgcctgatgctgggatcttgttaatgctcattagatatacaataaacccatggagtagtaccatttcacagatgaggaaactgaggctcagagaggttaatctgcccagggttccataccagggagactatttggagccttatatgtgatgcttgctgtaccattctatagcaagagtgaagctagggggctggttcagtggcccttgtagtggtttgagtaagagggaactctcctcaatggtaagttcattgaggataaagagtgagtgtgaatttctttgtgtatcttgtaaggtttagctcagggcctgatcaagtcctgcctctgtcatttatcagagacaggagagtttagcagttaagggaatgaactctggaactggactgtctggattcaaaccccagctctgctaattactggctatggaaccttgagcaagttactcagctctctgtagtgggctaaacagtggcccccaaaaatatatgtccataccctgagtcctaaatcctgtgaatatgaatttatttgaaagagcctttgcagatctaattaagtaaaggatctcaagacgagaaggtcatcctggattaaccaggtgggccccaattctagcgacacagaggagagacagaagagaaaaggaccacatgaagaaggaggtagagtgaggcagccacaagctgaggagctgcagcagccacaagatgctagaagagacaagaagcagaatctcccctaaagcctctggagagagtgtggctctgccaataccttgatttcaaactttttccctccagagccatgagcacatttctgttgttttaaaccacagagtttatggtcatttgttatggaggccctagcaagtgaatatatttggtcaatgaaaagagtcaaactatgtaaaatatttgaagggatttattctgagccaaatatgagtgcccaatggcccacgatacatccttcaggaaaacctgagaacatgagcccaaggtggtcaggctacaacattttagggagacataagacattaatcaatacatgtaagatatacatcggttcagtctggaaaggtgagacaactagaagtggggtggggggcattgggatcatagatagattcaaaaattttctggttggcagtgggttgaaacagttaagttattgtctaaagacttggaatcaatagaaacgaatgcctggattaagatacggggttggtgagaccaagattttatcatgcagatgaagcatccaggcagcaggcgtcaaagaaaagatggcaaatgtttcttatcagacttgaagagtcttaaagtctatgttgatgttaatgctggtcagctgggcctgaatcccaaaagggaggagggtataatgaggcatgtctgactcccccttcctatcatagcctaaactagttttcttaggttaactttggaatgcccttggccaagaggaggaatccattcagatggtcagggggcttagaattttaatttcggtttacgattctgtatacctcaattttctcattcatacgtaagcttataatacttaccttgcagagctgtcatgagaattaagtgaatcaatatacataaggcactttacagtggtagctgtcacataatcggtgttttcaaagtagtgtttattatgaccctttaatagttgtgtgaccttagttatttttgagcctgtggtctttttcccttgaaaaagtaataacaaaaatacttagcctaactatagtatctcaaagtgggagtttgcctctttcacttaaaaacggtcaaagaattccttcaagcatcttctgacctatgaactgctaacattcaggtgtcaagtctcactgaagacaactcacaacccaccaaaggcagtgattgaaaagataccatgtgcccttgacccgacaaaatgctctggccaggacattaggtgctaggggatgtgggtccttttctctttctcctggctgccacctggtgtggccgggggagggagatgagaagcggagatgggggtgaagtgtggggcagatggcctctgactaataactgagctgggtcatttgtaatgatgacaaggcattacccaagagatgaggcaaaggtgtataattaatacacaagcagtccttaaaactctctctgaaaccctccttccattccttcccttgctaatgaagtcagagacagggtaaaagcctgtaattacacttgaagtaattagaacgctgtgaaatggaaagcttaagacaggaagctcaaactaatggaatacctattgctcttgttattctgactcatccttcctaggatggtgcttttgtaggtctccactggggagctgaagactgtactgaatttgcataaaatgtagacacacatgcacatcaccctttccttccccagagtggccaagaaagtgtcagcattgtgccttcctcagtttctacaacttttacctattaatgaaagaccaaatcagcagaacagattaatttaaaagcccttccaaagataatttttaaaaatctgagcattttatatttaaactttttttacatgcaattctccctttctagctcagtgcttctcaacatcaatgtgcctgcagagcacctgagggtctccttaaaatgcagatttggattcagtgggtctggggtggggctgagattctgcatttctaacaagctccccagccttgctgctgctgttggacgggggagtggtacacaatgtgagtagcaaggataaagtccttcttggtcccacaagtgacttcactttcctccacagcaatgattccaaacttctcatgtagagcttgaaaaatgaataaaaattttcaattgaagggaaagaagagcaagtgaggaggaagagtggaggaagaagggaaaagtgggtgggaaggtaggaagggagggagggagggagggagagagaatgtgtgtgagttcgtgtatgtgcatgatcaggtgtctcttcttataaggacaccagtccaatcagattggggccctacccttatgacctcatttgaccttaattatctccttaaagtttttatctccaaatacagtgactctgggggttacagcttcaatatgggatacacaatttcatccataacactaagtgaccttagatgaactccttaatttctctaagacttgattccttcatcccaattgcttggagacaagaaagagttaaatcattaaatgacaagaaatgatcattaaatgacatttcataaatgatcattaaatgacaagaaatgagttcatctaattagcattaagtgttccacatatcatctgtcacagaataagtgtcttggttgtgttcttccagacacagtcaagcattggaggataagtagattatttgtgaggtgaaggaaacagcaggagagaaaaaagagaagtgagatagcaaagagaaaacagccaataaaataaagggtgcattagttaacaaatcaccactgggagaaactggagcttcatttcactgggacaagtcaggcacccatattgaacaaacacccagtgtcagccctcactactgagacaaaagagccgagatatttatgtaccaaagaccatcagtcactggttgagatctgcttccaagggatgactacctccccacttccatcttgctgtgcttgtggatagtagccatggataccagaggaaactttcaggcaaagagatgcctgaattggctgttggaagccctaccagctctgcaagagggaggcctgggaagttctgggcagtttttccttgcctgctacagtgagagaccaggaaaccttagttctccgtagtggttggtcctagtaattgtactaggagtttgcaaaacactagagagactcctgtaccaaagaaatctcaggccaaacaagtgtaaggaatgcttgtttcatgggattcacaactaaagctctgttgaagtcctgtagttgaaatgttaaactttgtataatcctataaattccaaactcatttacaccaacactttttcaaataatatgtatttaccttttaaggaataaaagttctataatgcatgttttggggctatcaaattaaagctagctgagatttcactacattgtaagatgtttttaatctgtttctactcaccattgtagcctatgaacagtaactggtacctagaaagtattcaataaatatctgttattgtaactgttttaaagaatataaaaaaaattctgaaaatattttcaataaaaacagcctcatgaaaaatgactctctagttccaaaaatgactgtttcgaaagacttcggaataaagttcagctgaatataaacttgttgaaatactgagcagtttattctccttgctttgttcccacttaatgaaacagtgcatttttctaaaattgaagacccatgctgttagaagccattgtccactttgctagagaagaaccacttctccccagatccgtgggtggatgcagataagagggctaatggtactaaggcctctctggtccaaccttgctaaaaagagtatttcaacttctaaatcctccctctacacttcacccttttgttgaatactaaggtttgcacctgtgaccccatcatagggtataaagaatcaaattaaggaacttctgacaaatggatcccttttaaccttgatgtcaggcacaatttgctatttgttggcctcaaatgtcagctgaagccagggtgagagtccttgtgactctgactttctcatcttctgtcaagacctaaagcatttttgagctgggtgcagttgctacagctgcagcaaagtgtacatgataagtgggatttgcaacaaataggcttttctctacagatcactgctccagttgggcttctttgctatttttgcccaactgtcctgagaatagcaacatcaatggcaactcatttcttgtccatcattattacaatgaaaaattcaaaaccctgattattactcattccttggagctgagatggaaacctcgaggctgtaaaacaccacttgtatacccaaatgcccatttcctaagaagggatatttcctgggaaattgcttatcttcctagcatttgcaaaaggcaaaagctggcatacagtagcattttcttcattccctgcaaatggaacattggtatttctagataagttaagagtgaggagagagaactatggccatccaggttctcttgggattagtctcctttactcttccttgaataaagataatgtgaatcttgtaagacactgtctgtaaaatggtctacccacacctgctaatgcaatgagtgggctattatagggccgagagggttgttggggtctcctgacatcaggggagtaggtgaccaatgcggatgaatcacaatgacaatggacattagtatttctgagaccagatttgtttgggaaatgggatacattgcctttctttagtcagatgttgtcctggctactgcttacagatgacccttgttttgtcacttactcatgtgtcttccccacttcccttgctggaaaaaacgtgcagagaaactgtaagctccgtgaggttagacattgcatcagattttacttaccactctattcttagtgcctaccaccaagtctagcatacagtgggggccaaataaatatttgtagaatgaataaagcatctgtaacataatatgtactccttaagtgagagtttccattgctacattgctatcattgttgtcatcatcatcacaaacatgatcatgatcatggtcatcattaccaggtgatttttttacagaaatattttctcttcagattatagcagactgaacatcaagatctttaaatctgcttgtcctagggaagttctctggacttcttgcatttggcactagtagagacttggtattttcattgctgtaacacagacaaaaataaatgaaaatttcaaagaatgagtttacctcctggcctttcatggtgatctcctttcctgtctttctgtgaataatatgtgtacagtatcattgctctctgctaataaaaaattacttcaaaacttaaaaaaagtacttcaaaagcttaaaaaaccaaacatttgttatctcagttgctgtatgtcaggaatcagggtacagcttttctgagtcctcttcatatatttttgtctctgtgttactgcaatgaaaacaccaagtctctactagtgccaaatgcaagggtttctcatgaagctgcaatcaaggtgcagttatctcaaggctcaacttagaggagaatcttcttccaggcttacgctcctggctgttagccagagacttcagtttcttgccacatggtctgtctataggactactcacaatctgtcagctagcttcctccagagcaaaggctctgagagagagaaagaatgagagatagtggtaagatataagatataagatagtgataagagataagtcacagtcattttgtaacctattctcagaagtgatatcccatcacttttgtattattctattttttagaagcaagtcgctgggtccatcccacacttgaggggagaatattacacaatagcatgaatattatgaagataggatcattgtggaccatgttaaatagaagcttccagccacaatggatgatgttgttccctctaagcatgagtgtagcttcaacttggttcttttttttttcttaattgtactttaagttctagggtacatgtgcacaacatgcaggttggttacatatgtatacatgtgccatgttgatgtgctgcacccattaactcatcatttacattaggtatatctcctaatgctatccctcctccctccccccaccccacaacaggccccagtgtgtgatgttccccttcctgtgtccaagtgttctcattgttcaattcccacctatgagtgagaacatgcagtgtttggttttttgtccttgcgatagtttgctgagaatcatggtttccagcttcatccatgtccctacaaaggacatgaactcatccttttttatggctgcatagtattccatggtgtatatgtgccacattttcttaatccagtctatcattgatggacatttgggttggttccaagtctttgctattgtgaatagtgccacaataaacatacatgtgcatgtgtctttatagcagcatgatttataatcctttgggtatgtacccagtaatgggatggctgggtcaaatggtatttctagttctagaccttttagcccttttctcctttgagaatcatgggttgccaaccaatcatggcttcaatgccttgtcaaacttctctttcaaaaaaggaagaaagaggaaaaagagaatgggacaagttctgctaggaatagctttcagtatgatgatgattttagttgtcattgcgcaggtgcattggcattgaatcatgaagagaaccgcaattacttctattgacttgtctgagcatcaattttctgatgacttactttatgacttcctaatgaatatattaaaaatagaactctagaagttatatttagccctttagttcctttccctccctgcaccccatcccccactttgcctggaggcttaatgatatatttgagatcattttgaaactttatctactttgtcttaacatacatgtttaaagttgtctgtctaattttaatatacatccttcatcaacaattaagccacctcccaattgactgcattatctgtaattcttcactcactaactctctcatatcacacaccataagaagaaagagaaaagggaataacctatattaggagaggctcattgacaaaccctgaaatataaattgacacaaacgtgaatgcagagttttgtaaaaaaaaaaaaaaaaaaaaaaggtttaaaaaatagatctacagttaaatgactagtatctctaccttttgttaccttttgtttccttttttgcagattgtttcccagagaaagctgtccaaatccttgctgaagcatgggaacacagcagggaaatcttccatcacggtaagcaggcactccctaagcagctgtctgcctgagtggagagcctgggcggactggccagcccaaaccagacacttgggaagcagactttctgatattgggagttggtgccacaactactgaactattgaaatcactcccttatttttctttctttctcttttctgacaatacaattttgatccttctaactctaggaaaaataaaaaaggaaaagcatttgaaagtaaggttatttaattctagtaagcacttctgcaattgcaagatagattttagtggaggagaaagatgtagttgttgagcacagtgagattacggaattgtctagcattttcacacaatcaaagcttcaaagctacgtgtcctcgtctctcatttattttgagaattaaaattttgctttgatagcatttacttcaaggtttggtttgtttcctgacaaacaaagagctcagcatttaacactcctctttgatataatagtttggaggtttactgtgtgattcagtagccactagccacatgtgattatttaaattttaataaaactatttaaaattaaagtaaatattcagttccttaatcacactggccacatatccagtgctcaatagttacaagtggttagcagctaccatatgggacagtgtagattataaaacatttctataattgcagaatgttctattgggtaatgctagaagtatttctaaataagagcttacatttttgaatggaatgcctggtatttgaaagttcgacatcttctattaagagaccttgaaaaaggtagaggatgttgtccaaccatttggatgtatggagtgaaaaaagaaacaaacaaaaagacaagcaaaagaaacaaggtagaaaaaactacaaggaaattctgaattgctagagaggcaaattgccagaaaacgaacctcttgagttattttgaacattcctttttaactagagagaaaccaattttttttttttttttttttttttgagacagtgtctcagcctgtcacccagactggagtgcaatggcacgatatcggcacactacaacctccacctcctgggttcaaatgattctcctgcctcagcctcccaagtagctgggattacaggtgcccaccaccacacccagctaatttttgtatttttagtagagatggagtttcactatgttggccaggttggtctccaactccttaccttgtgatccgcccccctcggcttcccaaagtgctgggattacaggtgtgagccactgcaccctgccctgatttttttttttttttttaagcacaggaaaaattcaaaagagctgtcagtgaaagttgtggccattctcacaagaacttacctgagtttgttgcttgaatattttaaatgacactgtcatgttaaagctttttcttgactgccatcttcagtcatgaatcaaagtgttctttgaagacactgatggtgctctgaaaagctatggacccacgggttcactcccaaagcccacaaaaccagtagatccaggtatgaatttgctatggttctttctcaaaagaacaaaatctcatcttgccatattttctctgagatatcctgagattttctttctccacatatccaagaaaagtttgatctttttcttttctttcttttttttttttttttttttgagacagagccttgcccctctcccaggctggagcacagtggcacgatctcatctcactacaagttccacctcccgggttcacgctattctcctgcctcagcctcccgagtagctgggactacaggcgcccaccaccacacctgtctaattttttttgtatttttttagtacagatggggtttcgccatgttagccaggatggtctcgatctcctgacctcgtgatccgcccgcctcacctcccaaagtgctgggattacaggcatgagccactgcccctggccccatttaattttaagtatttaaatgctcctcaactttgagtctttagatcaaaacattggctttaatagcttctagaaaacacttgaaaaggtgcatgaaattttctaggtctctgcagatggtgaaaatcataactttcatcagttttccaaaggtgtctgtgatcacaaaatacttaagggtcagtaatcaaatgaagtataagaggcattaaggtggtaagggacaaaagagaaccaaatgaaaaatacaaatatgatagttcttgggttatcaaccagttctagagtttttcctatatacctggactcacaatctctactctcagttgttcacacatttttgggtctatctgtcttaaggtagccatcttagctttaagattaagtgtaaataatttaaattttccaaaatatttggaatattaccagtgactattgaaagtatatggacccaactcataatggaattgttgagctcagatagaaaagaggtaaaactgaattatcagtatcttgatataagcaatttgataagcgtatccatgtgctgtggccacagaatacatggtaaatcctaacattatttataaaggttttaacttatctgcaacttgactggcttctagatttttgttgcttttgttgtcattatttttctcctgactttctccaccaatttctgctccaaggctttgttgagagtcactaactattaagtattggaaaatgacctattatgagaaagtcttttggacagtaatttcttcacttataccaaaatctttgtcaggaatggtctgtacttgggtgttagggcttaaatccttacgtatacccatatcttcatctcagaaaacccagggacagtcttttgaaaaataggaattagaaaaatttgacataaaaactagtttattccaacatttcttgttggtctcactcaaaaagaaatattgctgtttttccttctctgtaatttaccaaagggagacattgtagttaattatagaaatactatccaatgccatgtgacctttaaagaaagaagctcttccaaactgctcttctattttttccttcagcttgggtcccatctcttatgttctcttgctcagtataaatggtgtctagttatttaccattgtctattccagggagttcccttgaatacctagaattgctgtgctgtagtcactagggttgtggaaaaactctttgcccaacatttgtctttgttgagttttgaaccaaacaggaactaaatttgctcatgggttctggagctaaggagttcaccctctattgcagctgatgtgtgctttttcctttaggtgattgctgaagaattatctggcaatgacgactatgttgagcttgcattcaatgcacggaaattggatgacaaggtaaagcgtttggcattaaccttattgaaggaagtaacaaagctagcacacagtttaatcagatttccccctgcaactatttttccctttccacccacattatcaaacagatccaaaaattcagagaggtctacaaagtaaactttcccccacattaaagatcaattaatgagaaagggaagggactgtaattaaaacaggacaattctatgacaccaagactgtttccaaatgccaccggtgagatgtgcacaggtaaatatgatttaaccccatttctagggacattctaagggagaggagaagatatgaaagggaagaaaaatgacatttattgagcacctatgtttgccaagtacaggtttaagagctttttatgtggtatcacatttattcatttgtacaactcctatttatcgcgtattaatagtcagcccacttatgcattcactggttcactcttttatttgttaatttgttcattcattcatcattcattttccaaacctttgttgggtgcttgttatgcatgaggtgctggaaaaaaggcatatcaaaaatggacattccactctcacatctgcaacctggaattcatcattgaagtaaaacatacatctaaaaaacaaatgatatagtaataatatatccacaatagaatgtgataagtgatatataatagtgtgtcctggtaaggccaacttattctacctggggacatcaggaaatactttatccttataaactaattatatttggattttaaaagtgtcttgaatagattatatgaaaccatcacagactgctccattcttaacatgagcatgaactaggtgctgggaactgcagtgtgcatagatgtcagttgggagcaagcttttaacttcaccttttcacaactgttatgctccttctccttcatcatctccccaaatttcagaaaaactcacaaaacttctttatagtatcttccctggtgctattataagccactgggtcagtgtatagcagttttaagctacttgcttaatggcttataatggtttctctacacttagtatgctcttaagtacctctagtttgtcatctaactgatttatgttatagtaaaagggggcgggcttggaggtttgttggaccagttggctttgaagtgtttgagcagtttccctttagtcaaatgaacacttgctcatagaattgaaagagccccctgcagcacttacagtggttctaaatggctattcccaccattggctgtactgattgtccaggaccctggtcattgctgagcctgaatgccccagtgctggaaaccccagttccttcataatgtgactatgtcttgtccagatccttagtaattcagagaacaaatcagaggcctttgctccagtttggactggaagttaaatggtctcagatggaaagagggcaaagttgtagaatggaggagcaaaatgataacataaagatcatttcacacaacatcttcaggaaatgagggctcagcaaggtatgatgatttacccaaagacacaacactactgctctggttttctattgctgcatggtaaaccatctattctgtgtggtaaaccatcaaatctagcaacctaaatgaagaactattccgttatagctaatgattgtgagggtcagaaattcaatcagggttcagttgggcagttctgctgtctatgatgttgatgcaaatcactcagtggtactcagcttgtggatgagcttgtctggaggttctacactagctctacgcacatgcctcgcacatgagatggctgaatggctgggcttagctggaacagtctaccagagtgcctacttggtggtcctggggtagtcacacttcctttagagtatctggcttctcccagagaaagcatttcaagagaacaagggagatgctcggtggccttttctcaccccttcctggctttggaagtcatgcatcatcactgctgctgcattcttttagttgcaagtaagtcataaggccagcccagattctaggactccacatcgtgttagggcagtggcaaaatcatactggagaaaaagcatgtggactatgaacttgtggtggtcatgtttacaaaatgcaaactgccacaatatttttgtgatagaaatagaataaaataatataattatttcatgtcacagctggaaaaatagttcccagatgctctcaaggaggacccttttctagcttttagcattaaacaattttataactatctacatgtttgcagttaaaacttactgtatctagttattgtatgactaaaagtcactataaaataaacaatgctcctaattttttattatgttaatgaatatcatgaaagtcactagtttctacatacacttaaaaattgaagtatgaatatgtaggaaaaatatgctatatccaattcagacggtggttgtaggatgcctgcctggatctccagtcccttggcagtaactctggtagcccccaggagtctacatactttaggtagaaagccactgtctaatccaactgccttattttatagatgaaaattttaaagtttagagatgtggcatgacttactgaaagccacacaggcacacactcacaaaaaaatcagtgcaagagagggactcaaacagattgcctgacaaaatctaagtcttttggagcagagagttaatgaatagaaggtggtttggtctcagaatatggaagacttggaaatgttttcatgtatttcagggaagtaggaagccaggaagaggggaggtaagaggggaggtaagaggggaggtcaggcagcagtcctccaagtgtgatgcatggtcccaatacctttgcaggggaacccatgaagtcaatactattttcataataatgccaagacataattttctttattcactctcattatctcacacatgtaaagtggagttttccagaggctgcatgatgcctaatatcacaacagattgaatacagcacaaatataaggattctgctgcattctattaagctaatcattaaattggtttgcaaaaatgtaaactaataccattctcaccattttttaagtttggaaaatataattataataatttttccattaaaatactatttttgttatgatgtagtaggtttattttattatttttaaacaatgtaaccaatattttaacaatttaacagttttataatatggtaaatattaatacatacaacaaaacaaaagctctttggtatccccaataacttttaagaatgtaaaggggtcttaagaccaaaagtttgagaacccctgttatagggtatatgggaaagcactaagtacttttgcaaaccacagtgacagagaaatgcaccattctttttgacagaaacagtcatttttaatttgtctttcaacagactagcaatcatctccacactcttcaatgagagtgagtacataaaatagcttaggtttgtgataaataacttatttatctaatgttaatgcaattcacttagtagagaaagggactttctaacttgtaaagcacatttgttacattagcaactagtcggcaattaatctaacaagtaagtagagacagaaatgtaataatcactttggaacattcaagctgacaaaggattctttcttttcccattcttgagaaagtattcatattggtgcattggaactaattccgacactggtggtctccacatatgtaatagtaatcattatagactgcattttcagtgttcccatgatgctagtttgatggggtgcaatataagtaaacaaatctgtctctaaagtagaggttggcaaactttttaataaagggctagttgataaatattttaggttttgcaggacacctgatctctgtccccactgctcagctctgcctttgaagcatgaaaacagccatagacaatacaaaaatgaatgagtgtggcagtgttccaataaaactttattcacaaaaacaaacagtaagccagatttggctcatgtgccatagtttgctgacccctactctaaaacaatgtaaaatctctacctgctgtgatgtgattttactatgtttaagtatgcctgcttgaaactgtaatctggtctgcattaatgatagaaaattataattattgagcatctattatgtgccaagtatcaggtgtctaacctacattatccccaaagctcataagcatattcccagaagttagtatctttatttccattttatagataaagcatactcagatcagacatttcccagagtcacaaaattaataagctgtacagactggatatgcctacatctttcagataatttcttctaggtccaatattccattttcaagatcaccgtcatgggtatgaactgcttcctaattgcttatcaccctcttacttagctaaatttcttttatattgaactaaaaaagcagaataatatggtctctgtgttattaaagaattttaccacagcaacacttcagtaaaatgccctattcattcatcttttttgaactgaactgtcccaatggccatcttagtgctaataatcaagttttaaaaagctgaaaattccaaattaaagtgaccacacaattagacccagagttgttgttttgaagctatgaatttctgagcgtacacttgagattttgaggtgcttatgaattatttcatttccatgaatcagatgccttcttaatagtaatcacccctgatatttgtacagttttttacaaaatgccttcatgaattttttcttctattgataatcatcatagtagcccactttttttttaatatttcaacttttattttagatgcagagattacatgtgcaggtttgttacatgagtatattgcatgacactgaggtttggagtacaattgatctcattacccatgtagtaagcataggacccaataggtagtttttcagcccttgctcccctccctctctcactgctctggtagtcaccatcgtccactgttcccatctttatgtccatgtgtacccaatgtttagctctcagaagtgagaacatgtggtatttgattttccattgccgtgctaagtcccttaggatcatggccttcagctgcaaccagggtgttacagaaaacattatttttttatggctgtgtagtattctatggtatataagtgccaaattttctttatcctattcaatgttgattggcacctagactgattatatgcccttgctattgtgaatactgctttgatgaacatacaagtgcatgtgtctttttggcaaaatgatttattttcctttgggtatataccagtaataggatggctgggttgaacggtagttctgttttaagctctttaagaaatctccaaactgctttccacagtggctgaactaatttacattcccacaaacagtatataagtgtttccttttccccacagcctcaccaacatctgttattttttgacgttttagtaataggtattctgactggtgcgagatggtatctcattgtggttttgatttgcatttctctcacaatcagtgacattgggcattttttcatatgtatgttgaccacttgcgggtcgtcttttgagaagtgtctgctcatgtcctttgcccaatttttaacgggtttatttatttatttttgcttattgaattgtttaagttccttataaattctgaatattagatctttgccagacaaatagtttgataatattttctcccactctatcagccacttgtttagtctgttaatagtttttttttttaactgtgcagaagctctttagtttaattaggtctcacttgtcaatgttctttgttacaatttgtttttgttgcttttgaggacttcgacataaattctttgccaaggccaacatccagaatgatatttcatatgttctcttctaggatttctataatttgaggtcttacatttaaagttttattcaatcttgaattaatttttgtatatggtgaaatgtaagggtcaagtttcagtcttctgcatattgctagccagttatcccagcattgtttattgaatagggagacatttcttcatttcttatttttgtcaactttgtcaaagaagagatggctgtaggtatgtggctttatttctggattctctatcctgttccattggtcttatgtgtctgtttttgtcccagtaccatgcttctttggttattgtagccttatagtatagtttgaagttgggtaatgtgatgcctctggctttgttctttttgcttaggattactttggcaattcaggctcttttttgttccatatgaattttacaatagctttttctaattctgtgaaaactatgtttatagtttgatgtaagtagcattgaatctgtagattgcttttggcagtatggccattttagcaatattgattcttccgatccatgagcatggaatgcttttccatttgtttgtgtcatctatgatttctttcaccagtgttttgtagttttccttgtagagatcttttacctctttggttagatgtattcctaggcatttcattttttctagctgttgtaaatggggtcgttcttgatggagctctcactttgtatagaaatgctactgatttttgcacattgactttgtattcggaaactttgctgaagatcagttctaggagtctttcaccatagtctttagggttttctaggtatagaattatatcaacggcaaagagagacaatttgacttcttttcctatttggatgccttttatttctttctcttgcttgagtgctctggcgaggacttttagtactatattgaacaggaatggtgagagttgacatgcttgtcttattcctgctcttaagcagaatgcttccagcttttgcccattcagtatgatgttggctgtgggtttgtcatagatggctcttattattttcacgtatgttccttcactgcctagtttgttgagggtttttatcatgaagggatgttggatcttatcaaaaccttttttcctacgtctattgagatgatcatatggtttttgatatgtgtacgttgaaccaaccttgcttcccaggaataaagtgtacttgattgtaatagattaaattttgttgtgccactggatttgggttgctagtattttgttgaggatttttgcagctaacattttttcagtcttcaccatgtaccaggcaatggactcaacacttcccatgcaccaggtcctctaattcttctttgtcactatgaggcaaaggttgatactccttccattatgaatggcaaactaagccttggagaaattaaatattttgtccacagttattcagattatatgtggtagagttgagatttgaaagcagtgctaaagccagtatgctgcgtatagattttcagctacctgaagacagaggccattcttgacctttctttcattgacattttagtatgccctcctgacaataacttcttgcctaattcattcatggtatttaaaaagaatgtgaaataaaatagaaaaagcattgtaatatacaacatgtaaatatgtatacaacaagcaaaagaaatagggtactaaattgtacatagatcatgattacaaaatttttaaaaagaagagaaaagtatatgtagagtctagaaaaagatttatcaaaattctattgatggttatggaattttgaattcagttatgggttcttttttccttctttttatttttgtcatctgttttctatatttttcatttttaaataaaagtgatggtaacaaaagttttaaattaacagtaaagagggaaaaaatgagaaagttcttacattgtggttagcagtttttaagtatgaatcataaaaacatcccctgagggaccaacaatctatttaaagaggcaaagcgtgaagttacaggaggagcccaagggcacgtaggaacaagctactgtagcccacatccatagggaaagggagaagagaaggaggttttaattttttaagatgcatgtagaaacagaaactggcctaaggggcaaatgagtaaatgcatagaggtgggaatcagctagaagtgcatctgagagagaaatgggccattttgggggagagacgatgtttgaagggcaagattatgatgaaagccaccattttggggtcttgacaagatgaaggctgtggtaatcttctgaaggcaccttcagaaatagagtagtagcggatgttccagactctgggtgttgtggagcatcttgtttggttcctggttgcatgggaaggaaagcaaagcggaagatagttattcccacctctcatctcctctttctaacatatactacaaagtttctagactggcattcttcactgcagagccaactatattacttttctgctcaaaatccttcaatgattccccctgcctctccaggccagtgcaaagacttcagatgagcatttaaggcccttcacatcatggggccaactttgccagcattgtctccaattcctcccctatgcttccctaggctatagtcttattaaattacttggggtatccccctctatgtctgtgaaaaattcatcagctcccctctcttccctcaatactccttataccttcattcattcattcactcattcactcatttatacctagccctaggttatatttatttgtatacttttcttaccagcaacctagatggtactttggaagactgagatcaggttctatctgtccttatatcttaacatcaagcacaaaaactctgtgatcagtatatgtcctacaaatattttgctgagctgaagactaggatggctggtaaagacattgatagtaaggcaaaatttagaagtagagaccaaacaaaggaaaataacgagtttgactctggcttgcttaacatttaggaataataaatgacttttaaggcaaatatgggcttaattctactttgctaaagtctagatttctggaaaaaaattacttggtgaaattcgtaataaaaatgtgatggtgatgaataaggtttttgctcagatagcctcctatcctataccaggtatccattcacttatttatgtatttattcattcattcaataaacactatgtactattaaaatctagacactatggaaaatgctgaggaaatagcagaaatataaaggaaaataaagtttctcctctttgagaatttataatctactgggggtaaaaatcaagtttttaaaagggatggagataggttccattcccaacaatgaagcacttatttattttacatcactctctcactaaaaacaaatataaacactagaaaagacacaagagacatgtatttgagagtcctgaggcagtgtagatttgaggggccaagaaactggacagaagagaaacccatggaggtgcttaagacattctgtgcagattttccactcaagggaattcctcaaggctgattcctaaaatagtgtggatagaaaggctgggaagcctagtttaaaaaaatagctactaagaaacagaaactgagcagagcttttggtggtctcatggggctggggagaaaaactgaagttcagggctattgagagagcaaaggataaagactcataggtgcatcagagaagacaagtagtccaacagtatgagtggcttatcatctcaaggcgtttgctaattagcaaaagcagcatagagagaaactgaacaaaaacctagagctaagaaattatgaaaataaacacagcatttgaggttctcacaaataaaaattggcattgaagacttgtcaaggaagaacacccctcgtgaacactcaggttttcagttagggtccttttaggactatacccaaggagtaaaggaaatcagaaatggataggggctttaaagacatttgaagaaattcatcctctaaatagcttaatcctaattggattcaggagacttctccccttataaccacttgctagaagctaaagactcatgtaaaaaccttcataatcttcattacacattgtctactatttaataaaaaattaacaagcataccaagaggtggaactaagaaagagataataaaaatagacctataggtgatccagacattgtagtcattacataggcattaaaataactataatgaacctgtttaagacaacagatacagtgattttcaaagaactggaatttgaactgatctttgaagaatactttgaatttcaactaaccaagtactgactttacaaagaacttagctttcagatgcagtccattctagccaagggtggatctcagggatgaggatcaaaggaagaaagggtggggcccatgatcacaggtaaagagaagagagtttgagtagaactgggcaggaagagaggacaagcatggcctcccttccacatataaaaaataggaaatcaagagggttttcctgttgattaaatattcctgattgatcaggactagatcaaatgcaggaggaaaaacaattcattgacgtttatctattttaggatttcttcagtaaatctgacccatttctggaaatttttcgtatgaatgatgatgcaactcagcagctggtgcaccgaactgaggtaagagtcatcttcagctatgccctcttatctcctaagatgatgataaattgacctattttgagaaactcctttttgtgtgtgtgtgtgtgtgttgaggtggagtctcgctgtgtcacccaggctggagtgcagtggcgcagtctcggctcactgcaaccgccacctcccagcttcaaacaattctctgcctcagcctcctgagtagctgggactacaggcacccaccaccacgccgagctaatttttgtatttttagtagagatggggtttcaccatcttggccaggctggtcttgaactcctgacctcatgatccacccgcctcggcctcccaaagtgctgggattacaggcgtgagccaccgcgcccagcctccttttacttcttaatgtctgtagatatcaactaaggcctgaaatcttcagtgtcctcaagaaggttctgccatttttagcttttttttttttcacttttaatcctcaatttagttgtcagaagagcctttctaaccccaatttctattgttaactttcaaaacagacaattagcaacttattcataataaaagtataaatactagctatcatttaatgaggatgtttaggcatctaggtgccaagcattagactgttatttacatgcataattttatttctcacaaaaattcctcacacatgatgatgatgatgatgacccccattttacagttgaagaaactgaactttaaggaggttaagtaactttcccaggtctcacagctaacaaaggatggaactcaggtttcaattgaggttgtttgactctgagcttcatggtaatttgggaagtcaatctgcttccccagggaaagtacatacattgcactgatgtcagtcctatcatatgaacacctgacctttcttagcagccacttagtctagttgtatctccttctcactcttcctcttctttctccaagtggccccaactttatctcttattaccttaccccctactacccactaccacacacacattcaacaactaaccacgatctccatttttcattttattttacttgtaagccagtccaagagggattttgtaggagtgaggtacattgataagaaggaagtgatatacttgtgctgaattacttggagctgagagaagacccagttatgcttgcataccatttgcagagtgaaaataaaaaagaaacccccatgactttcataaggtggtggtgtggttgctatatccccaaaacatcacattggaaattcaatttcctgaagtgacagagttgcaggtgttgttaggggaatgtttcatgtcattgttatgatagacaaaaattaaatagccttggatgggctagctgtggatatcatctgatacaaagttgatatctaaaaaaagtgtttaataaaagaataaataaataaatgctgttaaatataaatagtatgtctattgcatgctatagaacaatgtaattctttggaacttaatccatgaagaataaattgaggtgcagctagcacagttgccctgagtggcatctcattaccaccaccaaaagaggtctttcacccgttaagtttccttatgtgaaacaaacttcttttgagggaaatagagcaagatggccaaatagaagcctccactaatcatcctctaattatcctacccataagaacaccaaattaaacaactctccacacacacacaaaaagcactttcataagaaccaaacatcaggtgaatgaccacagtacttggttttaacatcgttatcactgagagagacactgaagagggtaggaaagacagtcttgaattgttgatactactcctccctcatccgcttggtagtggctgtgtggtgcagatacagaatctgtgtgcttggggaagagacagtgattatgggaccttgcactggaactcagtgctgccccatcacagcagaaagcaatactgggcataactcatcctgcacccatggaggaagaatttaaaccagtcctagccagagggaatcactcacatcagtagtagaaacctgagttctggcaatctttgccactgcaggctgaagggctctggggtcctaaataaatttgaaaggcactctaagccacaaatactgcaattcctgggcaagtactggtgctctgctggactcatagccagtgggctatgagggtatacaacctagtgagacaccagccaaagtcaccaagggaatgcctgcaccacccctcaggtgcatgcaccaccaaggaatgcgtgccccataccctaagcagtgcagcacatggctccaggagacactcctccctcccacttgaggagaggagaggaaagcataaatataactttgtcttgcaacttggataccatctcagccacaatagaatagggcaccaggcagagtcctgaggtccccattccaggccgtagctccgagacgacatttctagacaaaccctgggccaaaaggaagcctactgccttgaagggaagcaggatccattaccttctgaataaaaatctcttggtccccaaataatcagcagttgtagccaggctgtactcaccatgggccttgggtgaaacacagagacatggtggctttagatgtgatgcagtgcattcccagctatggtggctattgggagatattctgcttgagcaaaggacagggacaagtagaggggacttgattttgcaacttaggtaccagctcagccacagtgagatagagcagcaattgggctcttggggtccccgattaaagactttggctcttgcacagcatttctggactggctttgggtaagagaggagtccacttccctgaagagagagtcctatgcctgggagcattcaccacaagctgactagtgaatatttgggccttgagtgaacgttggtggtaggcaggcagtacttgctgtggtcctagggtggtggtggccaagggagaggctcctctgcttgtggaaaggggagggaagagtgggaaaaactttgtcttatggcttgggtactagctcaaacacagtagaatagagcatgaggtagagtcctaaggtttccgactccaagctctggctcccagatggcatttctggacctgcctgggactgggaggaactcactaacctgaagggaaggacatagcctggctgactttgccatctcctgattgtagagtactagagccttgtgtgaacataggtagtagccaagcacggttatcctaggccttgggtgagactcagtgctatgctggcttcacatctgacccagtgcagtccagtggtggcagccacagtggtgctcgtgtcaccccacctttaactccaggcagctcattacagacagactccattggtttgggagaaagtaaaggaagaggagaagggtttccacctggtaatccagggaattcttccagatcttatccaagaccaccactgtacctctacaagtctgaaagagcccagcatcactgagcttgggatgccccctaatgcagatacagtcacagtgaccaaaaacagaccacgacacccaaatccctttgaatacctggaaagccttcccaagaaggatggtacaaacaagcccaggctgcaaagactacagtaaatatataaatcttcaatatccagatatactggtgaatatctacaagcatcaggaccattcatgaaaacatgccctcaacaaacaaactaaataaagcaccagagaccaatcctggaacaaaagagttatgtgacctttcagatagaggattcaaaatagctattttgaggaaacttgaggaaattcaagataacacagagaaggaattcagaagcctatcaaataaatttaacaaagagattgaaataattgtaagaaatcaagcagaaattctggagttgaaaaatgcaaatgacacactatataaggtatcaaattatcctaacagcagaattgatcaagcagaagaaagaattagcttgaagataggctatttgaaaacagaccatcagaagagataagagaaaaaagaatgtttaaaaatgaagcatgcctacaagatcaggaaaatagcctcaaaaggacaaatctaagagttattggccataaagtataaggagaaaaagagataagggtggaaagtttattcaaagggataataagagagaacttcccaaacttagaaaaagatatcaacattcaagtacaagaaggttatagaacaccaaacagatataacccaaataagatgacttcaagacagttaataatcaaacccccaaaggtctaaagaaaatatcctaaaaggaataagagaaaagaaaaacaaattacgtacaatacagctctaatacatctgacgcagaattctcagtagaaaccttaaagaccgggggagagtggtgtaacatatttaaagtgctgaaggaaaaaacttgtatcctagaatggcatatccagcaaaaatattcttaattatgaaagagaaataaagactttcctagacaaacaaaagctgagggatttcattaacaccagaactgtaaaggaagttcttcaatctgaaacaacacaacattaatgagcaataagaaatcatctgaaggttcaaaactcactggtaatagcaaatacacagaaaaacacagaatattataatgctctaattgtggtgtgtaaactaccaatattttgagtagaaagggtaaaagataaactggtcgcatgtttatagcagcacaatttgcaattgcaaaaatatggaaacagcccaaatgtctatcagtcaatgagtggataaagaaattgtggtatttatataccatggaatactacttagccataaaaaggaatgaattaatggcattcacagcaacctggatggaactggagattattattctaagtgaagtaactcaggaatggaaaaccaaatattatatgttctcacttacaggtggtagctaagctaagatacaaaggcataagaatgatgctatggactgtggggacgcaggggaaagggtgggagggggttgagcgataaaagactacaaactgagtgcagtgtatactgctcaggtgatgggtgcaccaaatctcacaaatcaccactaaagaacttactcatgtaaccaaataccacctgcccccaaaaacctatagaaataaaaaaattaaataaataaaatacatttctgtggggaaaagaagacataacactcccttagaaagaaagtataatgaaatacttttatttttctatttattttctttctatgaaaggaaattaaaaaatattaactacaacaacttttcaagacagagtcattaaaataatatataaacagaaacaaaaagttaaaaagctgggggacaaagttaaagtgtagtgtttttattaattttttctttgcttgtttgttagtttgtctgtttctttatgtaatcagtgttgagttgttgtcagttgaaaataatgggttttggtacgtagtcttcaaaagacacatctcacatgcaaggtctcttgacacatataggctcaaaataaagggatggaggaaaatttaccaagcaaaaggaaaaaaaaaaaaaagcaggggttgcaatcctagtttccaacaaaacagactttaaaccaacaaagatcaaaaaaggcaaagaaagccattacataatggtaaaagttttaattcagcaagaagagctaactatcctaaatatgtatgcacccaacataggagcaccctgattcatatagcaagtttttagagaccttcaaagagatttagacccccacacaataatagtgggagactttaacaccccacagacaatattaacaaattatcaagacagaaaattaacaaagatattcaggacctgaactcagcactggatcaaatggacctgatagatatctacagaactctccatgcaaaacaatagaatatacattcttctcaccaccacatggcacttactctaaaattaatcacataatctcaagcaaaatactcgtcagcaaatgagaaagcactgaaatcataaaaacagcttcttggaccacagcacaatcaaatcagaactcaagactaagaaatccactcaaaaccatacaattacataaaaattgaataacctgttcctgaatgattttggggtaaataatgaaattaaggcagaaatcagggagttctttgaaactaatgagcacaaagacacaacgtaccacaatctctgggacacagttaaagcagtattaagagggaaatttatagcactaaaatgcccaatcaaaaagctagaaagatctcaagttaacaacctaacatcacaactgaaagaacttgagaaccaagaccaaacaaatcccaaagctagcagaagacaagaaataaccaaaatcaaagctgaactgaaggagatagagagacaaaaaaccattcaaaagattgatgaatccaggagcaggtttttttttaataatattatagtagaccactagctatactaataaagaagaaaagggagaagattcaaataaacacaatcagagataataagagggatattaccactgaccccacagaactacaaacaaccatcagagaatgttataaacaccgctatgcacataaactaggaaatctagaagaaatgaataaattcctggacagatagatacactctctcaagacagaactaggaagaaatagaatctctgaacagaccaataacgagttttgaaatagaggcagtaataaatagcctaccaaccaaccaaagcccaggaccagacagattcaaagcttaattctaccagatacacaaaaaatagttggtaccattactactgaaactatttcaaaaaattggagggactcctccctaactcattctatggggccagcatcatcctgataacaaaagctggcacagacacaacaacaaaaaaagaaaacttcagcgtaatatccttgatgaacactgatgcaaaaatcttcagcaaaatactggcaaaccaaatccagcaacacatcaaaaagcttatccaccatgaggcttcatccccaggatgcaaggttggttcaatgtaggcaaatcaataaatgtgattcatcacataaacagaacaaaagacaaaaaccacaagattacctcaatagatgcagaaaaggctttcaacaacatttaacattccttaatgttaaaaactcccaataaactgtgtattgaaggaacatacctcaaaataataagagccatatatgacaaacccacagacaacatcatactgaatgggaaaaagctggaagtattccccttgaaaactgccacaaaacaaagatgccctctctcaccactcctattcaacataatattggaagttcttgacagagcaatcaggcgagagaaagaaataaagggcattcaaataggaagagaggaagtctaactatccctgtttgcagatgacatgatcctatatctagaaaaccccatcgtctcagcccgaaagcttcttaagctaataaacaacttcagtaaagtctcagaatacaaaatcaatgtgcaaaaattgctggcattcttatacaccaacaacaatcaagccaagagccaaatcatgaatgaactcccattcacaattgctactaaaaaaaaagagtgacatgcctagaaatacagctaacaaggaaactgaaagatctaccaagagaactacaaaccactactcaaagagatcagagatgacacaaagaaatggcaaattattccatgctcatgcataggaataatcagtatcattaaaatgggcatattcccaaagcaatttatacattcaatgctattcctattaatctaccactgacattcttcacagaactagaaaaatctattttaaaatttgtatgaaacccaaaaagagcccaaataaccaaggcaatccaaagcaaaaagaacaaagctggaggcatcacgctacctgatttcaaactatattacatggctacagtcaccaaaacagcatggtactggtataagaacagacacatagaccaatggaacagaatagagaactcagaaatatgaccacccaccttcaactatctgatcttcaacaaacctgacaaaaacaagcaatggggaaaggactccctattcaataaattgtgctgggataactggctagtcatatgcagaagattgaaactggaccccatctttacaccataaagaaaaattaactcaagatggattaaagactcaaatgtaaaacccaaaactataaaaaccctggaagacaacctaggcaataccatttaggacataagcatgggcaaagatttcataataaagatgccaaaagcaattgcaacaaaagcaaaaattgacaaatgggatctaattaaactaaagagctcctatgcagcaaaagaaactatcaacagagtaaacagacaacctagagaatgggagaaaatttttgcaaactatgcatctgaatgaggtctaatatccagcgtctataaggaacttaaacaaatttacaagaaaaaaactcattaaaaagtgggcaaaggtaccctgaaacttaaagtataataataataaataaataaataaaaaagtgggcaaagaacatgaacagacacctcttaaaagaagacatacatgtggccaacaatcatatgaaaaaaagctcaacatcattgatcattagagaaatgcaaattaaaaccacaatgagataccatctcacaccagtcagaatggctactataaaaagtaaaaaaaaaaacagatgccggagaggtagtggagaaaaaggaatgcttttacactgttggtgggagtgtaaattagttcaaccatcgtggaagacagtgtggtgattcctcaaaaacctcgagacagaactatcattcaacccaataatctcattactggatatatacccaaaggaatataagtcattgttataaacatacatgcacacgtatgttcactgcagcactattcacaataacaaaaacatggaatcaacccaaatgcccatcaattatagactggataaagaaaatgtggtacatatacaccacggaatactatgcagccataaaaaagaatgagatcatgtttttgcaaggacatggatggagctaggggccattattcttagtaaactaatgcatgaacagaagaccaaatacagcatgttctcacttataagtgggagctaaattatgagaacacacggacatatagagggaaacaacacacactggggcctatcagagggcagaaggtggtaggagggagagaagtaggaaaaataactattggatactaggcttaatacctgggtgatgaaataatctatacaaccaacccccattcaacgcatttacttatgtaacaaacctgcacatcctgcatatgtacccctgaaactagaagttaaaaataaataaataaaataatgggccagcctcagtggctcacacatgtaatcccaggactttggggggccaaagcaggcagatcacttgagaccaggagttggacaccagcctggccaacatggtaaaaccccatctctagtaaaaatacaaaaaatagccaggcattgtggtgtgtgcctgtaatcccagctactaggaaggaggctgaaggagcagaattgcttgaacctacgaggtggaggttgcagtgagctaaggttgtaccactgcattccagcctggacaacagaatgagactccatctcaaataataataataataataataataataataataataataataataataataataggttataacataatatttgcaagcctcatggtaacctcaaattgaaaaacaacagatacaccaaaaaaaacccaataaatttaaaaaaacataaaccagagaaaaattaccttcactataaggaacacaggaaggaaggaaagaagaagaaggaagagaagaccacaaaacaaccagaaaacaaaaaccctaatggcaggagtaaccccttacctatcgataataacattgaatgtaatgggactaaacactccaataaaaagacagggtttccgaatggataaaaacaagatccagtgatatttagactacaaaaaatacactttacctataaagagacagactaaaaataaaaggatggaaaaatatatcccatgcaaatagaaaccaaaaaagagaaggagtaactatacttacatcagacaaaatagatttcaagacaaaaacaatgaaaagagaaaaaaattatataatgatcaaggggttaattcagcgagagaatatagcagttgtaaatacatgtgcacccaatactgaagcactcagatatataaagaaaatattattagagctaaggagagagatagacctcaatacaataatagctggagacttcaacaccccattttcagcattggatagatcatccagtcagaaaatcaacaaagaaaccttggacttcatctacaccataggccaaatggacctaatagatatttacagaacatttcaactaatgactgcagaatatgcattcttctcttcagcacatggaccattctcaaggatagaccatgtatttgatcacaaaactactcttaaaatattcagaaaaactgaaataatatcaagtatcatatctgatgacaatggcataaaactagaaatcaataacaagagggattttggaaactgtacaaatacatggaaatcaagcaatatgctcctgaatgaccagtggatcaatgaagaaattaagaaggaaatgtaaacatttcttaaaacaaatgaatatgaaaataaaacataccaaaacctatggaatatatgaaaacagtacttaaaagaaagttgatagctacaaatgcctatatcagacaagtagataagtttcaaataaacaacctaaaatgtatctcaaagaaccagaaaaggaagagccaaaaaactccaaaattagtagaagaaactaaataataatgattatatcagaaataaatgaaatttaaatgaagaaaataataaaaaaatcaataaaacaaaaagttagttttttgaaaagataaagaaaattgataaaactttagccagattaagaaaaaaagacagaatacccaaataaataaaattaaatctgaagacattataacaaatactgcagaaaattagtggatcattgaggttactatgagcaactatatgccaataaattggaaaacctggaagaaatggataaactcttacacccatacaatctaccaagattgaaccataaagaaagccaaaacttgaacagatcaatatcaaataacaagatcaaagtcatgataaaatgtctcctggcaaagaaaagcctggaaactgatggcttcactgctgaattctaccaaacatattggtagaattttaaaaagaactaataccaatcctacctgaactattttaaaaaaggaggaaggaatacttccaaactcattctatgaggctagtattgccctgataccaaaaccatacaaagatacatcaaaaaaagaaaactacaggccaatatccctgatgaacattgatacaaaaatcctcattgaaatcctagcaaacttaattcaacaacacatgaaaaagatcatgcaccatgaccaagagggatttatcccagggatgcaagaatggtttaacatatgcaaatcaatcaatgtgatacatcataccaacagaatgaaggacaaaaatcatatgctcatttcaattaatactgaagaagcatttgatacaattcaacatcccttcatgataaaaaaaaatgcaaaaaactgagtatagaagaaacatacgtcaacacaacaaaagccatatacaacagcccacagctagtatcatgctgaattgggaaaaactgaaagcctttcctctaagatctggaaaaagacaaggatgcccactttcatcactgttattcaacatggaaatggaagtcctagctggagcaatcatagaagagaaagaaataaagggcattcaaattgaaaaggaagaagtcaatttatacttgtttgcagatgatataatcttatatttggaaaaacctaaagactctacaagaaaactgttagaactaataaactcagcaaagttgcagatacaaaatcaacataaaaaatcagtggcatttctatattccagcagcaatctgaaaaagaaatcatgaaaataatcccatttataatagctacaaataaaaggaattcacttaccaaaaaagtgaaagatctctacaatgaaaacagtaaaatattgatgaaagaaactgaagaggacacaatacaatggaaaaatagtccatgttcagggattagaaaaattaatattattaaaatgtgcatactacccaaagcaatctacagattcaatgcaatctttatcaaaataccaatgacattcttcacagaactagaaaacacaatcctaaaatttatatgaaactatgaaagacccagaatagccgaagctatcctaagcaaaaagaacaaaactggaggaatcacattacctgacttcaatttatactacaaagtgacagtaaacagcacggtactggcataaaaacagacacataaacccatggaacagaatagagaacccagaaacaaattcatacacatgcattgagttcatttttgacaaaggtgccaagaacagacattatggaaaggatagtctcttgaataaatggtgctgggaaaactggatatcaatatgtggaagaatgaaactagacccccatctcttaccatatacaaaaatcaaatcaaaatggattaaagacataaatttaagacttcgaactgtgaaaatactaaaagaaaacattagggaaactctctaagtcattggactgggtaaagatttcttgaataataccccacaagcacaagcaaccaaccaaaaatggacaaaggggatcacatcaagttaaaaaaaaattctgcactgcagaggaagcaataaaaaaagtgaagagaaaacccacagaatgagagaaaatatttgccaactatccatctgacagggggttaataaccaaaagatataaggagctcaaacaactctatgagaaaaaaaatctaataattcaatttggaaatgggcaaaagatatgaataaacatttctcaaaagaagacatacagatggcaaatagatatgtgaaaaggtgctcaacatcattgatcatcagagatatgcaaaaaaaaactgcaatgagatagcactcacctcagttaatattaacttttttggataaattcaaaaggccataataaatactggcaaggatgcggagaaaagggaactgtcatatactgttggtggaaatgtaaattagtataatcattgtggagaatagtttggaggttcctcaaaaaattaaaaatagaacaaccatatgacccagcaatcacactgctaggtatatacccaaaagaaaggaaatcagtatatacaggagatatctgccctcccatatttattgcagcactattcataatagctaagatttggaagcaacctacaagtctatcaatagatgaatgaataaagaaaatgtggcacatatacacagtggagtactattccgtactctaaaaagtacaaataaaattctgtcatttgtgacaacatggataaaactggaggtctttatattaagtaaaataagctaagtacagaaggacaaacttcacatgttctcacttatttgtgggagctaaatattaaatataaaaacaactgaactcatggagatagaaaatacaatgatggacagcagaggctgcgaagggtagtaggggaggagggaagtaataatggttaatgagtacaaaatatctagttagaatgaataagatctagtatttgacagaacaatatggtgactacagtcaacaataatttattacatattttataataaccaaaacagtataagtggaatgtttctaacataaaggataaattcttgaggtaacagcccaaaaaataaaaaattgaaaggatgactattgctgtacttttcttccagaacctcctctcctctgctcctgagagcattcttctcattgatattggtaaattctcctgttcccaagaatttctataatatccccttttactctaatggggaggtgctcctagagtttcacaaggaacatgatggcaaggttttccgatgagtgaagcaacatgacattgatttctcttgctttctcagtagatacaaaataaataccaggcaaaactgctcacttgtgggtagcctgcacgtacacacacacacacacacacacacacatgtgtacactcatacatacatacacataaagattttaacttcagaggaaatttctagttgctattgagtttttcaaaactgttgcatgagacttcttcactttttagcattttcatataaagttgggaaatttattttaacccaaacaattttttacctaattctccttcttgctatcattttaatcatcctaagtgtactagaacacatgacaaagtcacacagaaacattatttctccacttcaatgcattagaagaaatttaacaatgagtctaggatctagttatattaaggaatccggtggaagagggaatcacttataaaagaattatgttatttggatagataattaattaaaaaacaaattctaggtcgggtgctgtggctcacgcttgtaatcccagcactctgggaggccgaggtgggcggatcacccgaggtcagtagttcaagaccagcctgaccaacatggagaaaccctgtctctactaaaaatacaaaattagctgggtgtggtggcacatgcctgtaatcccagccacttgggaggctgatgcaggagaggttgtagtgagccaagattgcaccattgcactacagcctgggcaacaaaagcaaaaatccatctcaaaaaaaaaaaacaaaaaattccaagacttccactaactaaagacttcctaagtagaaaaatcaatatgacagaattccatttaactttatttgtatatcccctagagcagtggttctgaaactttgtgcctcagaatcacccaggagacccacctccagagtgtctgtcggtagttctgggtggggactagaaatttgtgtttttaagaagtttccaggtgatgcagctcctgctggtccaggaaccacactttgggaatccctgccctcaagtacacagtacaatgctaggcacagagcagctactcatacattctgaaccaaattgaattatttgaaccatagttatggcaagataagatttgactcatatagattcttaggccaggattagccaagtttgtgattagtaaagtggttttaaaagggttttcctatgttatagacatagtttataatcttaagatctgccttgtcacgcctttccaggatattgtaattgagttggtgataagctagtataagtatggtcctgggatttttcttctagaaacttctcttctgacttgcaatctgatgtgactcaaggtcacagattaccagaccatccaattatttagcagcagagttgtcttgctatacccttcaccccactaagagtctttacctttgctgaccccaagagaagagaatttatactgtaagactgacagtcctacagaactgagaattctctatcaatgggcaaaggcagccctatccttaatttcaactccttttgatatagaagggatcattctcagcatccacatgctggaaaatattattggcattattcatgaaacaacagccaggacagtgaccacaggagttctgtgcataatgacctgcttagtgggtacccttaaaagatttactacatcaagtttttattaaggcacctcttccaggctattgttcttttcataagcatcacaatggtttctcaagcagttttaatgtggaaatgtgaaaatgtcaagcatttctcccccactcaccactcctctctttcttttcccaggttgtgatgaataacttaagcccagcctggaaatcattcaaagtatctgtaaattctctatgcagcggagacccagaccgccggctaaaggtcagaaatctgtgtccaagaaatgtgattttttaaaaaaagtatttaatcttcctatttcttttcaaaataatattgacaaaccccaaattttctttacactgtacccaaccctctcatcttttagcatctcgatggaagaaacaagggctatttcttcttctagagccattgaagcttatatgaaagcccaaaatcaattccaattatgttatatcaagaggcaaaacccatgtcttctgaaagacaaaaccatggcaataaattcaggttataaatgagagttattaaaatgaaaatagtgtcatatcaattatctactgttatataacagaataatgcaaaatttagtagcttagaactagaagcatttatttagcttatgattctgagtactgacaagttgggatgaactaatctaggtgattcttctgttgatcttgcctggactttctcaggcatttgtggtcagctacccaagaggagggtggttctgcttctggaggttggctggctgtggtctggaatgagaggaggggtggggccatatggctctcatcatccccaggccagcttggactaacacacacagtgaacttagggttcgaagaatgcaagaacagagccccataagacctctttagggcctaggctcagaactcacacaggtcacttcctccacagtctaggtcaaagcaagtcacatggtcattacagatttaaaaggtaaggagatagactacatctcttggtggaagaagctccaaagtatcgtggccactttttcgatctatcacgaaggctttctgagcaccttgggaatgtaaaagttggaagaaaatatgcattcaaagtcaccaaaggaagacagtaggctgaacgccaggagcagatttcaggagatgtttttataggccatgctctggcctttcctctaccttgaaagtctagacgttccttgttgtcaatggcccggaggtgattcaaccaattaaggataactaagcaaatctactggagactggtgcctataaactaaaaggccaattgattaatgttcagtgaaaaacacaaccatcaagcagtaatatcagcttcaccagggcattttcttgtgggcaaaccacagagaagacaatcatcagaaggttgctgttattgcctgaaatcagaattgggtaactgagacagttaatggcttcagactctgaaaaccaggagtgcccacctccactgtccatcaggcagactaaacattcatgttgacttctcaggacaactaatcccctggaaagtgttagctgggtagctggacattgatgatgtttgccttagtagttttacattttcctcactacttttgccccacaaaccttctgacagatacaattttttgattcatcgatatgatctgtcaggttagaatcccatctgattggttaatcccaagctctttaaggttgctttatatgtctttgcttaaatccattctgtatgagctttgcagttgaactcttagcagacatgttcacttccatgttcttgaggagcaactcagagttgcacctggtatctctgtaagaactgagatatttcaagcctcaaccccactggaaaccttcaagccaaaatcaggattcctggctatttggcccttcatgtggaagctcctatgcagaatggccaagagctgtgacttcaggcataggatggcaattatcacttacacgttgagtagcaccctcctattcccagggaggtaaatgaccctctttggccagaaataaaataatacctcctttagccatatatctactttttatgaggagtcattaaactttttatgaggaggataaaaggagagggtcatctgtaattgaataaataaaaatgcagaaaaggaacactttgtggctttctgagtgctctgctgcctgtagagaaataagtaggaggtaaggaaatagatgattgattgatagatgatagaggagagaaagaaagaatgtgagaaggaagaatagaggaaaagaaggaaaaaaagaagaaaggaaagaaaaaggaaggaagggaggggggagagaaggatcagggtttctccacacgtgcactattgacgtttggattttcctgtggggagctgtcctgtgcctgtaggatccttaacagcaaccctagctactagatgccagtagcatttcacccccgtcacatacacactcacacaccctgctgcctgtgtcagtctgaaaatcaaaagtgtattcagacattgccaaatgttctctagagtgtaaaatcacttccagttaagaaccactggtatagtacatcaaacttattatacattagagtcacctgggagccttgttaaactcctcaagaacctatgaaaatgttttaatttctttcaaaatcagaagaagagaatgaacatgtaagattaactaaaatattctaatttttttttcttgcatcagaaagcaacgaactttttagggtccatgaaaatctgttgtgttaaaaggggcccatgaaggcaaaagtgccaatgaaagtcacactgtgttcctatcccaaacatcttgtcatctcatcagaaaatacttcagtatgtattgctaacattgctaacagataataaatctttccattaataaaactataaaacattattcttaagaatgctaactatacttccttaatgccaccaaatattctgccattgtttatgtttgccagagtctctcatttattaaacaattgtttctatttgtttaagtgaagatttaaacaaggtctaagcactgtatttgactgagatgtctctgaagcctcctttaatcagttcgttctcgctccccttttttttccccctgtaatttacttagtgaagaaaccaggctggtttgtcccatagcatttctcacattctgtgtttcctataaatgcatatttagaacttgatcagatttcagggtctgttttctggcaagaatgccccagtattattaacaatttatggattttttaaatatatttcagtgtttccatctatttcagttattataattcctttgaaatcttaagttgtcccatatttggccaataaaagcttcttcaagttggctcttgaattcttttgatataaacttagtaacgtccttgcttgataacgtccttgctttctggaatgaattcttgacctaaatcaattttgaaattttacaattctttttcttcattacatatgtatttctatggatgcagagccatattttaatgtctctcaaaatcattcctctccatagtatttaaggtctctgtggacctatagcccatggaacagtcaggttcatttgtttcattttgttttcaatttttagatattttttcaaatttaattttgccttataattatattaaatgtttacatggttccaaagtcaaaactgcaaaacagggaatattcagaaaagattaacttccattcctgtctcttctaccttttaccttcattttgtagcatattttgtatgctacgttttgtagcatattttaatacctggtacagctagccatacccacttccgtattccttgccttcttaagggttttcctggatattttacctgtttttttcattgagctttataaacaacttatctaataccagaaaaaaacccaaaacttgataatattttattgagattgcatttaacttgtgaattaggcagaattttctctttataatattgaatcttcctatcctagaatatggcatgtcttttcattcattcaagtctccttttgtgttttgcaggagtgcttaatattttttctcttattttctatgtacctcttagaacctctattgtttgcataaatgaaggtcattgaattttttcttaaactaatatttgttctcttattgtttatagtgattttcccattaactttttttctttttctcttttctttctgttttttgtttgtttgtttgtttgtttgtttgtttgtttttgagatggactcttgctctgttgcccaggctggattgcagtggcgcaatctaggctcactacaacctctgcctcccaggttcaagtgatttccctgccttggcctcctgagtagctatgattacaggcgtgtgccaccatacccagctaatttttatatttttagtagagacagggtttcaccatgttggccaggctggtctcaaacacctgacctcaagtgatctgcccaccatggtctcccaaagtgctgggattataggtgcccagcatgtttttttccaaatatgtaatcatactacttgaaaatggagatagtttttatccttacccctttttttcttctaataccctcaatgtgatagatggcagtggaggtagagggcctccttgtcttattcatgaacatagtagaaaattctatagtgtttccccattaattctggcagagattaatttttctgtagagacagagtcttgctatgttgcccaggctggtctcgaactcctgggctcaagcagtcctctccctcagccttctaaagtgctgggattacatgcgtgagccaatgcacctggctgggattcattttttaatgtaactctaaaggtatcagacactcagtgctttctcagccatgtctactgagccttaattacctatgatattcaatacaattaaataccttaaatattcagatcatatttttactagttatggtaacccaagagataacaccacaacatgctaaaatgtcttctgaactgcataaaggcattacactactactttctatggcatcctagacatgccatattctaggatagactcaatatatattatttctaaagcatattagagtttataaggcccttataaatatcataatttcatttacttctaaccacattgtgaggtaggttccattatcttcattttacagatgaggaaactgagactcaaaaacccatgttgttaaacatcaaattcaatgttgttttaatcagattgcactgcctctattttattgtattatacttattagaaaagaaatcatcctgataagcctatttcttgaccttttcaaccagaatgatttatttaccattatgctaatatttaacagaagatttgtctatatgtaacatttcataaggtctgagacactaaaggaaagtctctcaataaaactataacacaatgcttacttatcaatgtatgatttataagaaaataaattactctcccagaaatatgtacctcttagattctaggaaatatggcattaatcattttatttgatttgatcaacatattgttaatacccagaacatattctttaggaggcaatgttgatgttcagaatagattcttccagagagtgttcttagagaagaaaatggtgagagggtactatcagcaagtatttattcataacccaattatgcctagcactgtggaaaactgtcatgccagaacaatcttgacaaacaccatataagcaccctgagaccatttaatcacatgtattatggggccattttctatctctttctctaatttccaaaccacacaagtaacatggatactttcccctacacaaagttcatcaagcatcatcagagtatggttgataggagctatttgccttgaaggggaaaactaaggtgatagcaccagttgttctggatcaattcgcccccatgccttatgtaggagagaggcccaggttattaactgagcccatggtgcagtaaaggaaatggcagaagagaagaagaagcaggtccccaaagtcaaagtagaagggagtaagacccaggaacccactaaggggtgaaaggaggcccaaatacaagtctaaagcaacccctgaatgacatttcacccatgattcatctcgcttgttctttgcgccgtctatcttaggctgccatgcctggttgatttaaaacagccatgttcttgagttgccttctgacacccccaaagctggattcctggacaatcagaaaagtgctctgttaaatcagaatcccacactcagtggtcctggagtcttcattttaacaattttcataaacaatgctggtacaggccatttgccaaacacacattgagaaatactgtctttttttttcctttaagttttttactttattattttttttaatttacgtttttttactttaagttctaggatacatgtgcaaaatatgtaggtttgttatgtaggtatacacgggctatggtggtttgctgcatttatcaacccatcatctgggttttcagtcccacatgcattaggtatttgtcctgatgctctccctccccttgcctcccaccccctgacaggccccgatgtatgatgttcccctccctgtgtccatgtcttctcatttttccactccgacttatgagtgagaacatgtggtgtttggttttctattcatgtgttagtttgctgaggatgatggcttccagcttcatccatgtgcctgcaaaggacatgaactcattcttctttatggctgcatagtattccatggtgtatatgtgccacattttctttatccagtctatcattaatgggcatttgggttggttccaagtctttgctattataaatagtactgtgataaacatacgtgtgcatgtgtctttatagtagaatgatttataatcctttgggtatatacctgtaacaggattgctgggtcaaatggtatttctggttctagatccttgaggaatcaccacactgtcttccacaatggttgaactaatttacactcccaccaacagtgtaaaagtgttcctatttctccaagcctcaccagcatctgttgtttcccgactttttaataatcaacattctaactggtgtgagatggtatctcattgtggttttgatttgtatttctctaatgaccagtgatgatgagcttttcttcatatgttttttggctgcataaatgtcttctttggagaagtgcctgttcatatccttcacccagttttgatggggttgtttttttcttgtaaatttgtttaagttccttatagattccagatattagacctttgtcaaatggatagattgcaaaaagagaaatactgtctttctactgattctccaaacctagctgactcactacaggtaccacccttatgtagttcagcacggtttctgatgccttactgtgaggctgagtgtatatgtatatgtgtatgtgtatggatacattctgttcttcctcctataagaaatccttaacacctgttttttgattacatccaactattcatatctttcttatttcatgtgtgaccaggccatcttcaattgaaattgtattttctccacaaattcactgtctttgctttggcctctctgagccagactgacacactactgccaaatggatttgagtccactcatagagtttgcctcggaacttccccctttattcccagcctcatgtgactcttaacccctgggtccctacttgcctcttattttgcctctaatcttttagaattaattgcatgtttgttttctttctgtttcaagctgatttttttctagcaaaccttctagctcttactgcttggaaaggaaaagacaagttccaacccccagatctgaatccttggcattgatcccaattcagccccataattcccccaaacccatagaaagggctttaatcattagatatgaattacatcaacatttcacgattattggtgcaaaacacaggcagttggaattgaggagtccactgctatgttcagcattgttggaaacacctgcaacaaagaacctggcatttctaggcaactgaaagcaatttcaccgtcctctctatgtgccttatatttgtaacaggaaaaaaaaaatccttggatagctcatggtcctcttgagttttctggagatctggtcagattcaagtgctttctttatggccttctggactcaagagctgctgattttgtgcctgtcaatagttcagtctgcctaaatgtcctggaacttatctgattgcagactcatggaggtgtctctatattggatcagctatagcacaggaattcttgagtccacttaactaaatggcacccctgagtacagcaggctgcctctactgaaatcggaaatcaatactgcagcgtgaaaaagcagtagccagctcaaatagtgttaaatcatgcaggcttctgaattgagagaaaaactacatattctctcaactttaataattctttcttttcattaacattatcatcttatattacaggtgaggaaattaagaacctgtgttttcgcaaattgcttataattacagagcttagtttacacagctttagtttaaacctgggtctctcctgctctataatttctgctcttcagtatttaaaaaacagctaatatttactgagcacttaccaggtaccagacattgtgatgggcactttgattaaattttctcattgaactctgtaattgttctaggttaagcaatgctgcagtaacaaagagcccctgtgtaatagaagttaatttcttgctcacataacaatcaaaggtaaaacttttatatcaatgtttgcctctccttcatgaagtaatccagtaactcaggttgcttctatcttgtggctcatccatatcttagggacttatttttgtttggatccatcaggcaaaaggggaaaaaatatgaagaggcctctctctaaaagttttagctgaaaacaacatctagcattgctgcctatattccaatgggtagaactcagtcacatagccacagtaaatggcaagagaaaccaggaaatgtggcctagtaggatgcctagaaatagaaggaaacagatttttggtgaattggctggctcttccacagggagacactcttattatcctcattttgcaaatgggaaaactgagactaacaaagattaaataactagcctaaattcacagagctagtcagtggcattggaaggatcaagtctttatgactctggaacctaaactccataccagaacctaaagtccaataaaactttccgtgatgatggaaatattctgtatctgtactcttcaaaagagtagccactacccacatgtggccaaagcaattctttcccaacctctcctctctttctcttcaagcctccttcttattttcagtcctcccattctggtatcccatccccttttcttcaaaacacatcatccttcccatccaccaaggagaaaattctgccccttcatgtgtcaagcctatgatgctaatgggacccctcctctgcctagtctttagtgactccaaattggaagaaatgggctgttgtacaaatggggtcaacactaggtgcttcaatgtcaaaataactttttcattagtgaaaattagatctgatttccttactatctaaaaagagagcctaccttgccaaagcaagtgctagtttgcttgtttgtttccaagaaaccatataaactgatcttacattaaaaagaatcttgggagttagtgtttcagtggggaaaacagaaaagttctggacaaagatggtggtaatcgttgaaatacaatatgaatatacttaatgccacagagctgtaaatttaaaaataaatggcaaattttatgttatgtatcttttaccacaacaaaaattaaatttagaaaaagccttcttcctgttaacatgactttgaacctgctccttgtgaaacaactgcctgacattattgtactacagagtatttaatgcctgcctaaagctggcataccttacctataatggctcttgttctctcagcaatctgggatgagggtatggcagctcctaagcgattctttctgactcccaaattcctcccttttggaaacccttgcatgcaaagggtacagtccttccttgcccaaccattatgagggaagaggccaaaagagatggtacaacctggccaaactgttttattgaaaaaattgtccatggtcatgctctgtctttgatttttttaaaaaatgtttttgaaaaagtcatctttggaaaacactttgcaagtctaaaactaaaagtatcagatgaatgctattcagtgccctgatgaggtctctagttgaaagtaaagaggtagccctcttattatctggctggacatttccctactagagagaatgtccatctaaataagttgcaattgctgcaactggaagcagtttcctcacattatttaatccatctgcatccccttctgcactgaaaatggatagctaaccagctactgggaagatacttggggaaaactgggacgtggataaagttgcttaatgatgaagggaaggattattctgagtagaaattctgagaatcccccagtgcaattttgtgtcattattcaaattgacaggactcactactctgtttaaataatgctgtgttctggtaacactggttatgctggttgctcttacttgattgtttatttagtttaaaatatttttaatatgagttactctatagtttattccactactttgttcacacagaaactgaaaaagttgcctcaagatctcaattttcatttttgcacatttggaaatgttgtttttaacctagccttgtcaacaggaaggttttcacaaactggattgacatcccaagatgccttttcattgagtcagtttctgcagggcatccagcttctctcccacattttaaacattaaaccagaatgttgtttgaaaaagatgaaaacatcacaatccgcagccatcctgggctttttttctggaaagcattgtcagtagaatcatcaaataaaacatgaagagacctgtctcttaggaagaagatcagctttcataaagaaagagtccttgaagcaaagggaaatgaccctttcttagatgcttggcagaacaatcccataggccctccttctcaggagctggaggaggtatcagcatctcctcaaagatatggtgcctgtaagaccccacctgtctgcagtgtttatacttcccaaaaagattaaggaaggccaggaggactttgtgtggagcacacaaaacaaatatcaagaaagagcaaattgactgacctgataagaaacgaattattttctctctgagagtgtgtgaattgttctttcttgggaacctgagctcattgaaaatgagcataaatacttttggacaattccagtaaagagaagaaagttagaatgatcatcaatcccacatccacccccatgcaatttagagagaaaccaggtagagatggagagatgcctcctcatgttgcctacagaggccactcgtgctgcatggctccagtcagggtcccccgtctcactgggtctagtcttcagcttctttgctggtacaggaactcagctttgtccaatcactcagacttagtgggacctggaagaactgactcacggcaaaaggcagatgcataagccaggaggccaacatagtaatttacaaaaaacaaaaataaataaaatataaataaataaatttggcaagaactataattatcaagctccatacagggaacctctttcctgatacctgaatacttttgaagcagaattagcaaccaaaatatgttatttggtgagcatagaaaaatcaaggcaagggcacatgaggagtctggagagtgtttactctggtcagcagttgtgactgaaagactcaagagtctggaacatctgattaagttaataaggtgcttgatcttaaaaatatagataattcggccgggcacggtatctcacgcctgtaatcccagcactttggaaggccgaggcgggcagatcacgaggtcaggagattaagacaatcctagccaacatggcgaaaccccgtttctactaaacacacacacacacacacacacacacacacacacacacaaaattagctggacgtggtggcacgtgcctgtaatcccagctcctcgggaggctgaggcaggagaatctcttgaaccagtgagttggaggttgcagtgagtcgagatcacaccactgctctccagcctggcgacagagtgagactccctctcaaaaaaaaaaaaaaaaaaaaatacagataattctaggctttcatgtactcattaaagctgatctctgactcccaattcctgaggtgagccacagtatatcttgtcaatgtataattttcaaaaagttaaaagtatgactctcattgaactatcaaatgaatatgtatcaaaaattttattcaactcattaattgatgaggtaaccaataagaagataaaagttctccaagagcattttggataatttagtttacatagtctttttctttaaaaaggactaaaatttctagatacaaaattaattaatgtctttaggggcaataaaccataaacttcagggtcatctttacaccagaaggaaatcattgcatcatatacaagtttaacatgtataactttacagatcctgagccctcaattattaataataaatagtaaatagcagaaacaaataatggtaaattcttataggaaaatatatcatccttggatgggcctgttaaataatgattaagtatggcattgaaagggcttacggtcacactctcggacttgttttcaggttgtggataatttttcttaacaggctcaagtagctcctgagttcacatttctagaagatcctgatatatgcctgaaattcccacctgtccctctccattgcctccccatctctgaatagctggcatgttcttaacattcaggtgtcaactcaaaactgaagcactcagacttcgttgttcatacatacattcctccagttactcttcatctaatcaccatctccttcatggcacttaccaccatctgtgattacgttgtttatttgtttacatgtttatagtttgagtcctctactgaaatataagtgccaaggtccgtgggaaaggaactggcctatgtaattcacctctatatcctcagcccctaaaacagtgcttggcatatagtagattcttaataaatgtatgcttaaagaatgaatagatggatagatggattgatagatagatggatggatatatacacaagcccatagttacattagctcgataccattgatgacattgtaccagattttttgctatttggtctcaccttttaaagacccctagaaaaatacccctcttatctactcattcttatctccacatatatcgatgctagtgattaggttaattaggttaatgtttccatcacatcagttatgacctgggacacttcctttaatttaagacaagtctacattcatcatggaagctttctttcctcattgtcatgtctcagagaacttcccattgctactcatttgtcaccatattttctcctaacattttttttccttaaatttaaacatatctttccctccaccagccatagggagttagaagaaggaaaggaagggaagggaagagtctggaggataaagcagccaacagagaaaagcactccttcaggaatgaggggctggaatgcaagtcacaaaaaaaaaaaaaaaaaagaaacagtattgtggccacatctggttctcacagcatagcttttggaggggaaagaggcctaaaatcttagaaaaggaaggtaaagaaagtagccttgtggattttctaaatgtcaggtcctttttatttcactggcgtattttatggtttagtactttgcttctttgaacagttcctagaatagcaaggattaagtctagtactaaccatgataaatcctggtttacctttaagcaatgagatttttaatagaataaagtagaagagggatgtggggtgagtgagacaaacaaacaggattcaattaagtcttaaaatgggtgagaaaagaaagagcatcctttggattctgatcctcagaactttttctacaacctacttgtctccacccccctgccccccgacgtcggtttcatttcctgtggcaattaactttacttcaacattatgttgaccacacggcatgctttattgcaccggtatttaaaacctttcatgacagctatcccatgaaagagtaaaatcactaaatggacttgtcaggaagcattacctctagctcatctgccctgcagaccagctggccttcttcataagctctcttaccatgcaatcacccctgctactcccaataatcaaactgactcttgaaggcatatgatgtaacgaaccacaacagaccttaagacaaggtcagcatatgatctagaataatatcatcaaactttagcaacatcagaatctccaggaaggcttgttgaaacatacatcattgggtcctaaccccagagtctctgattcagtaggtctagggtggggcccaagacttgcatttctgacaagttcccagatgatgctgatgctgctggttcagagttcatgcgtaaagcatgattcatatagaagaaatagtcaagagacagtttcaacaatacatttccctcaattcacccatctcaaccttaaaatttctctatatctgcatccactgtttcttttttatgaaaacaagtttatctgcccactgcactccaattcaattactcaaagactctttcccagagtgttttaaggcaagaagaaagctttggagtcatctctcaatagttgcttcttaaattaacactattgacatttggagttggataattctatgcagtgggggactggactgggtattgtagtatggttagtgagcctctatccactagttgcaagtggcactgcccccttcagtggtaataaaaaaatatgtctctagaaactgccaaatcacccttgttgagaaccactactctagtcaattgtatctttactctctccttctttgttgggatttaagggtgaaaattcatcgcatgccttcctgagttggggccagttgagaaacaaaaacagaacttgaaaacatggccatcagaatataatttcactgttgctaaagctggccccagtgcacaagtaggaatgcttctcctgggagatgtttgggttgtgattaacaataggtgaatgaattctggctttaaactaacacagaaacagaaaaccaaatactgcatgttctcacttgtaagtggaagctaaatgatgagaacacgtggacacaaagaggggaacaacagacgctggggcctacctgagggtagagggtacaggagcagaaaaaaattaaaaaaaaatttggtactaggcttagtacctgggtgacaaaacaatctgtacaaaaatccccatgacacaagtttgcctatataacaacacacccatacccctcaacctaaaataaaagattaaaaaaaacaatagatgaggaagcccatagctaatcttaggtagggaaaaaaataaatgtataaataccaggtgggaccacagtggcaaaactaaggcagtggatctcaaccttggattcatattagaatcacctgaggagctttaaaaaccactggtacctagaccccacctcagaccagttaaatagaatttctgagtataaaggccaaaacatcagaaattttaaaaagcagccaaggtgattataatgtgcagtcaaagtaaagaaccaccgcttaacttaatagactgagaacattaaatcccttgttagatttttctttaaggtattaaggagacagcccctagtctgaaacaagatctctcagtgtttcttaagactttttcagtcacaaaattctgctgacgtgtaagttgcataaacataatagaaaggccatgaaatatttacaggcttcagagtaggcttcctacttcaagtgtctaagccaagaacttgaacgcatgtgcaaagacctggaagtttgtgattaataggctgaatgctgcagcattttaacgtgttggggaggagacctagggcaggaaaaaatatgacaaggttagtgaggtaaacagaacatttggatcatgttaaggagtcttaatttctatcctgagagcaatgggaggcactgagggcctctatgcagaggagtgatgtggtcatatttggatttctgggattaggactctgcctattttgtagaatttgaattgcatgagggcaaggctggaggcaggaggtctggttaaaagtcgtatcagtggccaggcgcggtggctcacgcctgtaatcccagcactttgggaggccgaggcgggcagatcacgaggtcagcagatcgagaccatcctggctatcatggtgaaaccccatctgtactaaaaaaaatacaaaaaaattagccaggcgtggtggcaagaacctctagtcccagctactcaggaggctgaggcaggagaacagagtgaaccgggaggcggagcttgcagtgagccgagatcgcaccactgcactccagcctggacagagcgagactccgtctcaaaaaaaaaaaaaaaaaaaaaaagaagtcctatcagtaatccatgtgagttaatttttaaacagggatgaccagaacttggtaccagatcacctttggatataaagagaggaagaggaaagacttaaccctgattcttctattggtcacgtggatgaaaaatggtaccataccttaaaatcagaccactgaaggagcaaaaggtttgggatgagaaagatgaattcagttttgtatttgctgagttgaaggcatctacagactatacagtgggcagttggcccaggattgtatcaaatttagcactggaagtcccacatctcaggaaaccacttagtcctgggtgaaccaggacagttggacaacatggcagttgcctacataagtttgattctcagagaagagaactcagcagggacataaatatgagttgtcagtaaatatatggcaagtgtgcgtgtgtacatgcatgtaagtgctcatgtgtgtgtatgactagaaggaaaaacaccaatctaataacagtatattcttctcagtggttaaatcataaagctatttattttttttaaattggcttttaattttctaacttaataatatatagtttaaaattcacacacacatttttaataagcatgccaatttgttatatttgctgagaactttctagttcctgtttaaaaattcaaaatggaaataattatttttaaaagtcctagagaggtttcccggtatgggcaagtgtattctacttttgtatagtgatattagacaacattaagaaatagactacagatcaatttggttagtacctggtgacaatctcctaaattccagtgtctacttaggcttaaagtaacctggcaataggaaagtcacttggtgatatgaactaaactgatagagaaggctgctgtccttctacgtttttattagctttctaaaatgagtttatcatatactaccttgctctgttgttcattctgcaaagacaacctacactacacagtaatcaagtatgtatttgagacttagcagccgcacctaatttctttggaaagcatatcggcaatgatttcatcagccatttattaaaacaagtaagctaaaaatgataacagcaatcctcaatctgagtaacgaagagagcatgggagaagcctatgtaagttctggatcctgtagaactgggtacaccggtgttgggatttgaagcccaggactccttagaatcatgtgatagagacctcaaggtattccaacaactttatcatcccagtgaaaaaaactgagaaccagagaggaaaaattacttccccgggaccacacagctcattagaagccagactaaaacttggatctggacttacagaagggaaaagagcattaagtcagtattgtgtacctactgtgtgccaggaactgtgccaggtactaccccacattccatcccctctgtccatacaacaaaattgcaaggttaacaaagaaggaaactgaaaatcagagagctgagtaagttcctgaatatttgcagacctcttgagggaagaacctgaagcccaggtctgtttaactctaaagtcctttctcctaagacttcctaaagccttgtgtttcttctgtcaggccacactaacttcctcaaaactaccattctgatatgtaggctaaatgaggaaacaggttcaattgatcttctaaggcaggagaaaaacaaaatagtagatgtgtttatctatcatcttcagtaatgaaaggaaaaaggaagagaagaaataccaacgactttcctgagatttaatatcacccaacacatttcaggtgaagtgcccttaggtgtggacagttgggaaaaagaggtctcgagggtttttctaagcttttaataaaagctcagagagccccatagtgtttaaaatatctcaggaggaccctgcatatatgtgggagaaattatgtatgggaagaaaggggaaggccctttgaaggattctttcttgcttttctgagtctgaagtcagaagtaataaaaactctcttttgcctttctgcctacattttataaactgtatctattttctaatgctttcctcaacattttctcttcagagcctcacctaggaaatagcacaggaattaatattctaattttacagatgaagaaagtgagacatagattaagtaactgacacaggatatcatggataactagcaaaggtgggaagagaaagtgggaaaaagagatgtggtttgaaatggtttaccattttttactatgcatttctatcaataaaagcacccttcaatgtaggcacattttactaattgcaagcatttactattatactaatatagtatgtatgttttaaattttatgcaataatagaatttttttttttttttttttttttttttgagacggagtcttgctctgtcccccaggctggagtgcagtggcgcgatctcggctcactgcaagctccgcctcccgggttcacgccattctcctgcctcagcctcccgagtagccgggactacaggcgcccaccaccacgcccggctaattttttgtatttttagtagagacggggtttcaccgtggtctcgatctcccgaccttgtgatccacccgcctcggcctcccagagtgctgggattacaagcgtgagccaccgcgcccggccgcaataatagaatttttaaaggctatggttaaaaaataatacagatgaaagtgcttatagtttcttccttcacctaaattatgatggtcacaccctagggtggcccctataactctcaccctctagtagtcatgtttttgtgtaattccctctccttgagcgtgggcaggatctgtaactctctaagcaatagatatggcaaaggtgatgggatatctttcttgtgattattttttatgtcatatatggttgtatggaagaggtgaagatgtaattaatatccctaatcacttgaattatatctaattaaagggcagttatactagtgggccttacctaatcagatatgccctttaaaagatggcctaggctttccctgaagtcagaaactccaagcaacagagactctgtctctcagcgtctgtcttctaagaaacaagccaccgtgaatagtacagccacaaattctgccaataacctgagggagcttgaaatcagatccttccctagtcaagcattcagatgaaaatgcagcctacctgacacctagatttcagccttgtgagatactaagcacacaacgcagccacggtgtaattgaactcctgacacacagaaagtgtgagataacaaatgggccttcttttaggccattattgtgtggtaaattattacacagcaatataaaactaatagaccaatagagggtcttttgtaccccttaggttttgcataccttatgcactcttttagccctttgcccacaagatctcgtttcatcttcctccaaaccctataagaattgatatttctgtaaccactttgggagtgaagtgacagactcagcaggcttaagtgacttgccccagctctcacagttagaagtgaaaggcaagagacttgaacgtcagcctggagattagaaagaataaagccagttcttctagcttccttttgttgttattgttgtgattgttgcatccaactggccctatagtgtgccacaacataaaactatttccacatggccgccctcccctgctggtgcctctcgtaataggaactagctttttctcctgggtttctgctaatttactgtcctgaattcttctacttcagcactgatgcattgtaggacctgtagctcttcagtgacaacagtgggttctgtgttccattgttacttacacacgagaagaatctgtgtgagaaccatctatcaggactgtaaagttacctgactataaagttctaacagttgactgcttcaatattaatggagcttgtcattctgagaagcaatttgatatgactttcctttcattctactgtggaacaaagtaccaaaagctgctgcttttcacaaataaatttttcacctgggcacagctatttgagtacctgttgttcatgtgtttccaggtctcaggtcttgcaaactcattactaaccaaacccagggacatagagttaaggaggaaaatgcttggtttccatgcttgccttgctggaggccattttcctctaataagaaagacttttgctgaactggaatgacaggaagacaggcaggacttttcttccacctacttacaggaattgggcttctgtgggcatggtccagagcttagtagcaccctccctgggcctcattttctttagtaatcaaatggagataatagtacctgcccttatttcatagcgttggttcattcacttattcactcattcattctacaaatcttagattgtctactgtattccaagatagccacatgaaaaaatttataatcaagaagcagagctggaattttcagaaccatgtcaatttcaaatatttaaactatttattctttaacaattataagtaattgctgaatatcttttaagtaccatctgtcttaattacattaaatatgtagtcattctttcagtcatatataaatcttctttcaagacctactgtctatgaagcaccatgctaggttcttaggatatggagatgaatatctctatcatcaggacattcaaagtgtaatggggaaggctgatgtccatgaataagcagataggtttttattatttatttatgtatttaattttgagacagggtcttgctctgttgcccaggctgaagtgctgtggcacaaccacagctcactgcagccttggcttcctgggctcaagcagtcctcccaccttcagcctcccaagtagctgggactacagatgcatgccatcacacctggctaatttttgtgttttttgtagagttaggatttcactatgtttctcaggctggccttgaactctgtgctcaagcagtttttcctcctctgcctctgaaaatgctgtgattccaggcataaaccactatgcccagccacacagacttattttaaattttaagtgaagaaatgatagggaatgaaaaatccttagagcacctatcctgggatgggggagaaaaatgatattgtcagagctgcatttctgatagttaatctggttctatggacttgaagaagagaagaaaaacagagtgctactgtggttcagacaagagatgaagaggcctgaaatgcagtcacattgaggataaaagagcaaaggagtcatttggagacttatttaagcaataaatttggtaggaaatgttattgcccagagaccaggtgggaaagggtaaaagggaaagtagagaatcaaaattcctctccagtttctattttgagtaattttttcccatcagccatgcagggtaggtttgttatcaccattttactcagagagcctcaagatcaagtaactagaaagatcaggaccaagattcaaacctaggccaactaactccaaagtccatgctttttgctaaaaatcaaacctcctctaggatcttcatatgaatctgacaatgtgcccctattcttagatccaaaaatctgttccctggacaattagatggggcaaaggtaaagaaaggacatggcaagattagagacggtggagggcaggcaaaaggtggaatctgataaccaggcttctcttccttccacgtcctacattcctttgccaatgctcttctccactagctggtacacagttcttggggttctcctggtaacttggtcctgtctgtagaaatcaacaaaggcagtttctacagtaacccttggcagtaagatttactgggatggctcacagcgtctccaggtattgagatatatcttatgtattctaaaaggaaaggcttaaaagatgacaatcaggaagcttcagttggctgcttgcttactagcatttctcaggctccgtctttcacttcagctctgatttgcaatatagaaccttctgcctggccaaagcagtatcttgacagtggataggagctattttacccctcagagttacctctgaatctgcacagtaactataagacagctgcaggcacagtagaatgcccctcttcccctatctctgctctgctccccaagactagaggctggtgattcagatggcagaatggtaccatctgtgagtaaatgctctgcatgatccacagtgatttccaaggtaacaaagatattccctagcagcaacagagcccagagatggtacctaactgtactcactggatgcctagaacttttcagagcttgtcctcatcctgacatgcttatgtatctctttttcttcaaccagctcatttgattcctagcattgttttttatttttaattttttgtggctatatagtaggtgtaaatatttatggggttcatgagatattttgttgcaggcatgcaatgtaatataagcacatcttgaagaatggggtatccatcccctcaaacatttaccctttgagttacaaacaatccaattacactctttattttagaatgtctgctgtgactgtcctcagcaggactctctctttctgaatttagccctgcaacatgtgttggaccttagaaacatgggggaggttttttgaggaggtttccagaggacagaattcaaccttgtgtttttctgctatatatagtgagcttttcctcactgtggtgagaaaactatatagttttctgctatatgtatgtgagtattttccctatatgtaggggaaaggatttcctttgtttcacagagtaggtcatttcaatgaaagttatgaaaacaggaaattatatttgtatattgattcattttacagaagaggaagaaaaaaatatgttgctctggaaggggaaaagaatcctttggcctaactcataattcttggtacattgtatgttttaaaagaaatgtaactagaactcttcagtatcctagaccagtatgaaatgacagattttctattattttccttctgtttgtgtatagtttgtcactttttttcagcagtttgtgtccttagtgaatcacagagtaagattctaagcactttctgaacaaagtaacccctgcattagaaattggatactatgcaacagttgaaaagcaaggcctttcatgcatagtttcttgagcctcctgagcctttctccaaggtcaaggtgagggctccactcacaattctgaaactcctctttgtgactttagacaaataaccttcctgtgcttaaactacattacctacaaagatggtaatgcctgcccctagccacttctcagttaccttttttcaggaagtgagaaagtctaaaaaggactttggatccctttaagggacctgttattttagaaatgcattattgggagtcagggccacataatcagggcagtcagatatttgccacaaaggctcttgagacttcaaagaataaaaaaatcaatgaattgcttactttatcaaaactctgtatttgaaactttggatcttttaaaatttatatggttatagttaaaatactttacttctctggacctccatcattaataaaatgggcataaaatagtacctgtcccatagagttgtaagaattaaaggaggaaatgaaaacaacacacttagcatataataaatagtcaaaatgcatggccaaagtgacctgtattagatgttatgatagataattaagatgttttgttggtgagacatcagatgaaatgaaacatacttgtgttctctgaggcaccagcccctcctgcagagagtcagtgtttccaagaaaaaaaaatggccaaacataaaagatgcagagatattatctgtaactagttataatgaggtcttcaaaaatatataactaactccagctctttgttctaaaggatgagtcccatttcaaggtaggtacgatgttagtctggacatcacagatggatagtggcaataacagcaatgtaattcaagacatcttgtatcctttcagtttgcagaaccatttcagtcttccaagtttttccggtttttcacttctaggcaacaatggtttggaacctccagcatctctgttggcagtaaattcctagttccagttcatcagaagctttttgcttgtgtgacattactcttggtctcctcttccttatctgaaaattttattgacctgcaattaaattatctacagttggaataattgcttgctgtttctctgcttctgaccactactggaaagccatttggactttagattgtgcccagctttccttcaccttccttgattatgctcctcttatgtacctgctaattttatctagagtccagagcattcttagaccttttccattcctgtaagtcccagaggatgacactgacttgcttgaggtcacagaatcaatcagttgcttagggtaagaggcaagatcttctcattcctaattctgtgatcttttcacttcttgtatgtatggccccttcttgtataagaataaatgtgattcatatctaaaatctggacatggaaaatggactaagctgaaaataactgttggcaaaaacataaagtagtatttttcaaaaggtaatccccctaaccagcagtgtcagcatcacatgggaacttgttagaaatgtaaattctcagccatgcctggtggctcacacctataatcccagcactttgggaggacaaggcaggcagatcatgaggtcaggtgatcaagaccatcctggttaacatggtgaaaccctgtctccaataaaaatacaaaaaactagtcaggcatggtggcgggcacctgtagtcccagctactcgggaggttgaggcaggagaatggcttgaacccgggagacagatcttgcagtgagccgagatcatgccactgcactccagcctgggtgacagagcgagactccatctcaaaaaaaaaaagaaatgtaaattctcagtcaagctccacctaagacctactaaagcagaaattcaagccctctgggtgatgcatgctaaagcttgagaaccaatggtacagactatgccaaaagtgtgtaccttaattacaaaaggctattaaatgggcactgtattagtccactctcgcgctgctatgaagaaataccaagactgggtgatttatatggaaagaggtttaattgagtcactgttctgcagggctggggaggcctcagaaaacttacaattgtggcggaaggagaggcaaataagtccttcttcacatggcggcagcaaggagaagtgccaagcaaagggagaaaagccccttataaaaccatcagatctcatgagaactcactcattatcatgagaacagcagcatggaggtaacagtccccatgattcaattatctcccaccaggtccctcccatgacacatggggattatggaaactacaattcaaaatgagatttgagtggcaacacagccaaactatatcattccaccactggccccttccaaatctcatgtcctcacatttcaaaacacaattatgcctttccaccagtcccccaacatcttagctcattgcagcatcaacccaaaaatccaagtccaaagtctcatctgatcccttttgcctatgagcctatgaaatcaaaagcaagttagttacttcctagatgcaatgagggtacaggcattgggtaaatacacccaatccaaatgggataaattggctaaaacaaaggggctaccagccccatgcaagtccaaaatccaaaagggcagtcattaaaccttaaagttccaaaatgatcccctttgactccatgactcacatccagataccttccaccagataccctaaattatctctctcaagtttgaagttccacagatctctatggcaagggcaaaatgccaccaaactcttcgctaaagcatagcagaaatcacctttattccagttcccaacaagttcctcatctccgtcagagaccacctcagcctggaattaattgtccatatccctatcaccattttggtcaaagccattcaacaagtctctaggaagtttcaaactttctcacatcttcctgtcttcttctgagccctccaaactgttccaatctctgcccgttttacccagttccaaagctgcttccacattttggggtatctttatagcagaaccccactctctgtagtaccaatttactatattagtccattctatgatgctatgaagaaataacctagacagggttatttataaaggaaagatgtttaattgactcacagttctgcagggctggggaggcctcaggaaacttacaattatgacagaaagggaagcaagcatgtccttcctcacatggcggcaaagggaagtgccaagcaaagggggaaaagccccttataaaaccatcggatatcataagaattttctcactattatgagaacagcagcatgggggtaactgcccccacgattcaattacctcccactgggtccttcccatgacatgtggggattatgggaactacaattcaagataacatttgagtggggaaactgccaaaccatatcagccattaatgcataaaattgtgttaggatttcacaagtagactttaattttaagtctattattttacctggaagacaaggtaagataataacttttcaaggtccaaggttttacttaaattagcagaagtgttcttagggctctgcagggcctggctgaaaaaaagagcacaaagtttaggggagatgctgccagaggcaggcaggtattcctcttgatggaacatttactctttactgtccaattcagctgacatcaaatttctctatagtcttacaccatgctgttttgcacatgtatattaccttcctggtctctggagatatttgaatattctgaacactatttagtctttttaaatttttttattttttatttcaataaattttgggggaacagctggcatttggttacatgaataaattctttagtggtgatttctgagattttggtgcatcaaccatcactcgagcagcatacactgtatccaatgtgtagtcttttattcctcgccacccctcaccctttcccccaagtccccaaagtccaatgtattattcttatgccttagcgccctcatagtttagctcccacatatgaatgagaacataggatgtttggttttccattcctgaattacttcacttcgaatgatagcctccaattccatccaggttgctgcgaatgccaatgttttgttccttgttatggctaagtagtattccatggtatatataaataccacaatttatccactggttgattgatgggtattggggctggttccatatttttgcaattgcgaattgtgctgctacaaacatgcatgtacaggtatcttttttgtataatgacttcttttcctctaggtaaatacctagtagtagaattgctagatcaaaaggatacttttagttctttaaggaatctccacaccgttttccagagtgattgtactagtttacattcccactatcagtgtaaaagtgttcccttttcattgcatccacaccaaaatcaatcaatttttatttttttatcatggccatttttgcagatgtgaggcggtattgcattgcattgttttgatttgcatttccctgatacttagtgatgttgagcatttttccatatgcttgggacccatttgtatatcttcttttgagaattgtctattcctgtccttagcctactttttgatgggattttttttttcttgctgatttgtttgagtactttgtagattttggatattagtcctttgtcagatgtatagattgtgaagatttttctcccactgtgggttgcttgtaactctgctggttatttcttttactgtgcagaagctttttggtttaattaagtcccatccatttatctttatttttgctgcatttgctcttgggttcttggtcatgaagtctttgcataagccaatgtctagaagggttttcccaatgttatcttctacagtcctcatggattcaggtcttagttttaagtctctgatccatcttgagttgatttttgtataaggtgagagacgaggatccaatttcattcttctgcatgtggcttgccaattatcccagcaccatttgttgaataaagtgtcctttccctgctttatgtttttgtttgctttgtcaaaggtcagttggctgtaaatatttggctttatttctgggttctctattctattccatgtgtctatgtgcctatttttatactagtaccatgcttttttggtgactatggccttatagtatactttgaacttgggtaatatgatgcctccagatttgttctttttgcttagccttgttttggctatgcaggctcctttttggttctatatgaattttaggattgttttttctagttctatgaagaatggtggttgtattttgatgggaattgcattgaatttgtggatcgcttttggcagtatggtcattttcacaatattgattctacccttccatgagcattggatgtgtttccatttgtttgtgtcatctatggtttatttcagcagtgttttgtagtttcccttgcagaagtctttcacatccttggttaggtatattcctaagtaatttattttattttattttttcagttattgtgaaaggggttgagttctttatttgattctcagcttggtcactgctggtgtatagcagagctactgatttgtatccattaattttgtgtcctgaaactttgccaaattcatttaccagttctgggagctttttggatgcatctatagggtttcctaggtatacaatcatatcatctgcaaacagtgacagtttgacttcctctttactgatttggatgccctttatttctttctcttgtctggttgctctggctaagacttccagtactttgttgaataaaagtggtgaaagtggacatccttgtcttgttccagttcccagggggaatgctttcaacttttccccattcagtataatgttggctgtggatttgtcatagatggcttttattaccttaagatgtgtcccttctatgctgcttttgccaagggttttaatcataaagggatactggattttgtcaaatgctttttatgcatctattgagataatcatgtaatttttgtttttaattctattcatgtggtgtatcacatttattgacttatgtatgttaaaccatctcatatccctggtatgaaacccacttgataatggtgaattatctttttttgatatgctattggatttggttcactagtattttgttgaagatttttgcatctatgttcatcagggatattggtctgtagtttcccttttttgttgtatccctccctggttttggtattagggcgatgctggcgtcatagaatgatttaggaaggattccttctttctctgtcttttgtaataacgtcaatagaattggtaccagttcttctttggatgtctgatagaattcaggtccaaatccatctggtcctggacttctttgttgacaattttttattaccatttcaatctcactgcttgctatggatctgttcagagattctatgtcatccgggtttaatctaggagggttgtatatttccaggaatttatccatctcctctagttttactaatttatgcatgtaaagatgttcatagtagccttgaatagttttgtatttctgtggtatcagttgtaacatctaccaatttttttctaattgagcttatttggatcttttttcttcttttcttggttaatctcgctaatggtccatcagttttatttatcttttcaaagaaccaactttttgtttcatttatcttttgtattttttgtttgttttagttttatttagttgtgctctgatcttccttatttattatcttctgctgggtttggatttcgattgttcttgtttctccagttccatgtgatgtgaccttagcttgtctatttgtgctctttcagactttttgatgtggcatttaatgctatgaactttcctcttagcactgcttttgctctatcccagaggttttgataggttgtgtcactattattgttcagttcaaggaattttttaatttccatattgatttcattgttgatcatttggaaacaggctatttaatttccacatatttgcatcgttttgagggttccttttggagttgagttccaattttattccattgtggtctgagagagtacttgatataattttgattttcttaaatttactgagacttgttttggggcctatcatatggtctatcttggagaatgttccatgtgctgataaatagaatgtatattctgcagttgttgggtagagtgttctgtaaatatctgttaagtacacttgttttagggtatagttaagtccattgtttctttgttgactttctgtcttgatgacctatctagcactgtcagtgcagtattaaagtcccccactatatgttgccatctgtctcatttcttaggtctagtatgagtaattgttttgtaactttgggagctccagtgttaggtgcatatatatttgggattgtgatatttgcctgttggactagtccttttatcattatactatcacctctttgtcttttttaactgctgctgctttcaagtttagctattcctgctcacttttggtgtccatttgcaaggaatatctttttccacccctttaccttaagtttatgtgagtccttctgtgttaggtgagtctcctgaagacagcagaaacttggttggtgaattcttatccattccggcattctgtatcttttaagtggaacatttaggccatttatattcaatattagtattgagatgtgaggtactattctattcatcatgctatttgtggcctgaataccttgtggtttttttttcattgtgttattgctatataggtcctgtgagaaatatgctttaaggagcttctattttggtgtatttcaaagatttgtttcaagatttagaactccctttgtagtttttgtagtgctgacttggtagtggcaaattagctcagcatttgtttgtctggaaaaggctgtatctttccttcatttattaagcttaatttcattggatacaaaattttggctgataatttttttctttaaggaggctaagaataggaccccaatcccttctagcttgtagggcttctgctgggaaatctgctcttaatctgataggctttcctttataggttacctgatgcttttgcctcacagttcttaatattctttccttcatcttgactttagataactggatgactgtgcctaggtgatgatctttttgtgatgaatttcccaggtgttgagtttcttgtatttggatgtatagatctctagcaaagctgggaaaatttttctcaattattccctcagatatgttttccaaacttttagatttctcttcttccttgggaacaccaattattcttaggtttggacatttaacatagtcccaaacttattggaggctttgttcattaacaaaattttttttctttgtctttgttggattgggttaatttgaaagtcttgtgtttgagctctgaaattcttccttctgctcatttgattctattgctgagacttaccagtgcattttgcattactctaagtatttcattgatttccagaagttgtggttgttttctatttatgctatctatttcactgaagaattttcctttcatatcctgtatcatgttttttatttctttaagttcgactttacctttctctggtgcctccttgattagcttgataatcaaccttctgaattctttatctggcaattcagagattttgccttggtttggatctgttgctgctaaactagtatgatcttttgggggtgttaaataaccttgttttgtcatattaccagaattgtttttctggttccttctcatttgggtagactatgtcagaggaaagatctgggattcaagggctgctgttcagattcttttgtcccactgggtgctcccttgatgtgctgttctcccttttcccctaggaatggagcttcctgagagctgaactgtagtgattgtttatgcttttctgggtctagccacccagcagagctactgggctctttactggtactgggaactgtctgcaaagagccctgtgatgtgattcatcttcaggtcttgcagccatggatactagcacctgctctggtggaggtagcaggggagagaagtggactctatcagggtccttagttgtgtttttgtttagtgcactggttttgtgttgattggcctccagccaggaggttgcgctttcaagagtgcatcagctgcggtcctatagggaggatgcaaacttgccctagggacacctggtcaagtattaaagtttctcaggtggtgtgcagggccacagagcttccaagagactatgacctttgtcttcagctaccacagaaggtagagaaagaccactaggtgggggcagggatagtagtgtctgagctcagcctctctttgggcagggcttgctgcagctgctgtgggtgatgggggtgtggttcccagtccattggagttatattcctagggggattatggctgcctctgctgagtcaaacaggtcaccagagaaatagaggaaagacagcagtcacaggcttcaccctgcttccatggagcctgcaatcctaaaggccggtctcacacttaccaagcaaccccgctcaacagcaccaagtctattttcaggcagtcagtgaccagggctaagaacttgccccagaccacaagcctccctgccaataagcaagcagagtcacagttttttggcatctcagggagcctgcagcagtgatccagttccttcaaagggtctgtggattctcttggctttactggtatgttcctgcagtagttctttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgcctgcagtagttcttggagcaaaagttcacggtataagtctccatacactgcactgtctatgcaagcaggagctgcaagctagtcttgcctcctgtctgccatcttcatccctctcccctgtttggtctgtatgcaggatattagattgatgtgtctcagataatactgtgtagcagaattttcgtgatgtcctattctgcattcaacagaatgtttaatattggcacagtccaatagggctatcacaagacatgtgttgctattgagtacttgaaatatggctagtggaagcagaggaattgagtttttaattttatttaattttaatgaatttacatttaaagagctgcatgtggctagtggctaccctattagacagcataggaatagatatattgatctaatatcttacacaatgttgattaagtagaaaggtaattgtatacttttgaatagtatttagaaaacttagaaattgataaacctagaatagtctttttaaacattagtagggcacttttaggaccactccaaaagtgattatgtctaaatcatttattagaatagtgtgacaaagttaggagccttctgtttatgatgggtgttaagtcattctatgacccgcaggttttccgagactttttacaactgcagctcttagaaatctattttaagtgggaagaggttactgaacccaaatttgagaaaaatcgtggaaaatacaaatgctcttctacagaaatcatggaaaagcattccaaaaatcaaaatttatttttcatccttatgattgagccataagtcaccgatcaaagacctgtcataatcaagtttttcaaagggataagctataaatgaaataatttgaactttaaaagatcatatgtgactgcatctgagtaccatttgatgtgttattaatttattttttcagatgtttttaagtgtttggtaatttcctcgaccaaaaggaaagacactgaatccccccattttccacttaggatgatttcagcttatgaagtagtgacataagacctaggatagtctcttttaaaacataactaaaaattttttaagctttacagtttctcacatgaattctgaaagaacattgcttcaatttttaccttcttatcctctcatctcctttccagttatgagatattgtcagactcaagaatgagaatattgaaggtctggttaggttcaaggtggaagtaattatatttacccaatctaaagtattcatttcaagaatggaggtaagcaaataagaacagactatgaagttactggatattactggcctctaaactggagacctaggtttaattgtctctagaattattttgctggctgatgttctgcagaattggattgtgttgataaatgagtttgattacttactttcttcattgattctgacagctacacctgaagaaattattcaaagtgaagtattatttctaatctagatttcctatggataaagctttggcaaaatatttgccaatcttggcatttatgtattataaacttattaagtcagtgaatggatgctcagcatatgcagtttatatgactattaaatgtgtttccaatacctgaaggataagtatgcatgttgggagtgaagatacatttttatatcacacaaacagtaagataaagaataagagtatatttttattaaatgtaccaagggttgcagtataatctccaaaattaattgagatcaatatggctaaccatcccaatccccaaatatatcaaatgccttaagcatgtgcatttttttagctccacaattctattcttaaaaatttgttctatggaaataattatatatgttcatatttataaatgaaatggccaacataggtgagtagtaacaacaatagtagaacaatttaaataatgtaatcctcttcagcctttacaaataatattataaaacaatgattctaaataaagaagggaaaggggagtgaaccaaaatcatctgccaatttttttctttctttctcctttctttgggtttattctgttcttttttttaaaaataaaaaagttacattgaacatttggcttatcaatttttagcctttcttcataacgagtacaaatgtttcaggctttaaattttcattgatggctcacttttagccatatcacacaaattctaatacttatctttattgtcacttagttccaagtaatttttgtttccattattattaattatgtcttcacttatgagttacttagacagcagactttcaaaaaatttttagttagagattcagttgtttttaaaaaatcaatgtttttatttagtagtaatagtcacagaacatggtctgcctcatatgcttctttgacttttgagaccggctctttagtctagtcctaaccagaggtcaacttttataaagatttctgtgtgtttgagaagaataggtacttctaccttacaatgggtacctataatgtggtagggatgggggtggggtaaggaggtgaatgaaattttagagaggtaatgatggaagcaaagagaccagatagaaagctaattgcaataattcaggcaagaaatgatggtagaatggactagggaggtagtggtgaaaatgttgagatggaattagattctggatatattttgaaagtaaaaccaacaagatttcctgaaagatttgatgtggagtgcaggagagagaaatcttagcctgagcaactggaaggtagagatactattagctgagatggggaggactgcaggtggatcaagtttggggtagaagacccaaatgttaggcaccagaaatggagagttagagtagacagcagttcaggggaaaggtctggactggagagatacgggatcatctaggtcagtggttctccactggggtgcttggggcaagtgctatgggcatctagtgggtagacatcagtgatgcttctaaacaccttgtaatgttcaggatagtcccttaccacaaagaattataggaccgaaatgttaacagtaccaagactgagaaaacctgacctaaggcctgagcataagagaagaaaaggtgctcaaggactcagctttggggcatggcttagtaggagttcaaagagatgagaagtatctatcagataattctaaggtgtgtgtctagtaatactgggggaaaaaacaggatagtcttatgtcctgaaaggcaagtatttatagtatattaaggaggaggaattcatcagccttgtcaatgctgttgatagatcaacaaagatgaggactgaaaattgctctttgaatttaccattgtggggtaattgaaaagaccccatattaacaagagtaatttcaacagagtggtgttggcaaaagtctgacgctgttacttactgactgagtgacttagggcaaggtacttagcctctctgagttttagtttcctccctcataagctgaaggtaataatctacttcatagggttgcatgagataatgggaataatgaggcggagcacagtggctcatgcctgtaatcccagcactttaggaggccaaggtgggtgaatcacctgaggtcacgagttcgagaccagcctggccaacatggtgaaaccccgactctactgaaaatacaaaaattagccaggcatggtggtgcacgcctgtaatcccagctactcgggaggctgaggcaggagaatcacttgcgcccaggaggcggaggctgcagtgagccaagatcgtgcgcagtggtnnnnnnnnnnnnnnnnnnnntgcctcttgggctcaagcgattctcgtgcctcagcctccctccttgtgcctcagcctcccgagaagctgggactacagggtgccatggcactccacgcctgggcgacagacgtgagactctgtctcaaaaaaaaagaaaaaagaaaaaagtgttggggaggggggataattacgtgtaaagcacctatcacagaactggcacatagtaggccctcaaaaaatctaaaatctccttccacaactctcccattcatctccagtttctctcctcctgcaacccctcctacatttcccccacacaaaaactactacttcaatgttttatcaatactaaatactatttagtattataagaggcaattctctcattaaaatacactttgtgatggggaccatatttcaatgatcccttattattaactgaagaaaaagaaaaatgttaataatttccggttttccgtataaggtaatacattgaactgggagaaaaacaggtagcaatttaaaaatacagagtcacaaagtaatttctcattaaattaaatatttcattgttgaattgaattgtttattaagtcttttttcggtttgaaactgtgcaaacccaaaccagtagctccattttctaggcctactgaagttccctgtacctttcccacataaaactactatatacaaaactttcaatcaaaaccaaaaatccccggagagacatgtcaaaggatggggattggattggggaaagctaaagacatagaaaatttctctttaaaatgttttactctggaatttcaactggttttgtcttctcttgggattcagaaaatgattatattaactctaatgattttatggtgactttataaaaaatggatttaattttaaaaggtcaagggtagccatattctgagaaaaaagatatctgaaaatatgtcattctgcatgcaattgtaatttccacagaagtaaaggcctgggaggtcatccaagtaatgagatttcatgctaattccccagttagtcacacacagtgagctcacagtccaagtggcttcagacttctctcgaagctgaggtggctggagaggaattctccatgatttagaacttcagggtaccctgatgttgtcctaatcagcagcctgattctcctatctgctgagcccccaaagagaggtttttatctccctatctctacatctactatatttcattgagtctaagacacacattttattcatattcttcttatgtcttggaaatcaggtttcatcttataatctattgctattggtcagtctgtccagaagaacactttgtgtgatggaaatattctatatctgttccattcaatatggtcacccctagccacatatgtctcctgaggacttgaaatatggctggtgcaactaaagaggtcaatttttaattttattttattttcattgtttaaaatttaaatagccacatatgtctagtggtgggcctaatggacatcataggtgcaagtcaaattcttaaaggaaggatttaactttgtttcttccactcacttgagaaatgactaacttgagactcctttaaattaaattttctgtttgaggttttttcactgcaccagtagtgagttcagactgaggccctgagtacagtagttcccctttatctgtggtttctctttccagagtaccagttgccattggtcagccacagtctgaaaatgttacattactactcatgccctttggggctatgattaagtaaaataagttacttgtacaaaaacagtgtgatactgtgacagtagatctgatcatcaagatggccactaagggactagccggcaggtagaatagatggacaaagggaatgattcgtatcctgtgttgcaggacagcgtgagatttcatcatgctactcagaacacatgcaatttaaaacttacaaactgcttttttctggcatttttcattaaatcacaatgcctacatcattcacctcacttcttctcatcatatagcaattttatcatctcatatcatcacaagaagaaggatgagtacagtacaataagatattttgagagtaagggagagggagaaagagaaggaaagagggggagagagagagagagaacgagagagagaccacattcacaaatgcctattacaggcatacttcagagatgttgtgggtttggttccaaactactgcaataaagtgaatatcacaataaggagagtcacacagatttggggattttccagtgcaaataaaagttatatttacactattgaccaggcacagtggctcccacctgtaatcctagcactttgagatgccaaagcagtcagatgacttgaggccaggagttcgagaccagcctggccaacatggtaaaaccccatctctactaaaaatacaaaaattagccaagcgtggtggtgcatgcctgtaatcccagctacttgagagactgaagtatgagaattgcttgaacctgggaagcggagggtgcagtgagccaagatcacacccaccgcactccaacctaggcaacagagtgagactctgtgtcaaaaaaaagttatgtttacagtatcctgttctttattaagtgtgcaatagcattatgtctgaaaaaaaaagatgaacataccttaatttaaaaatattcttgctaaaaaatgccaataatcatctgagccttcagtgagtcataatctttttgctggtggagggtgatatggtttggctgcgtcccctcccaaatctaaacttgaattgtatctcccagaattcctacgtgttgtgggagggacccaaggggaaatgattgaatcatgggggccagtctttcccgtgctattctcgtgatagtgaataagtctcaatgaaggcagaaataaagatgttctttgaaaccaatgagagcaaagacacaacataccagaatctctgggacacatttaaagcagtgtgtagagggaaatttatagcactacatgcccacaagagaaagcaggaaagatctaaaattgacaccctaacatcgcaattaaaagaactagagaagcaagagcaaacacatccaaaagctagcagaaggcaagaaataactaagatcagagcagaactgaaggagatagagacacaaaaaacccttcaaaaaatcaatgaatccaggagctggttttttttgaaaagatcaacaaaattgatagaccactagcaagactaataaagaagaaaagagagaagaatcaaatagatgcaataaaaaatgataaaggggatatcaccactgatcccacagaaatacaaactaccatcagagaatactataaacacctctatgcaaataaactagaaaatctagaagaaatggataaattcctggacacatacaccctcccaagactaaaccaggaagaagttgaatccctgaatagaccaataacaggctctgaaattgaggcaataattaatagcctaccaaccaaaaaaagtccaggaccagacagattcagagccaaattctaccagaggtacaaggaggagctggtaccattccttctgaaactattccaatcaatagaaaaaaagtgaataagtctcatgaggtctgatgggcttatcagcggtttctgcttttgcttccctctcattttcttctgttgccaccatgtaagaagtgcctttcacctcccaccatgattctgaggcctccccagccatgtggaactgtaagtccaactgaacctctttttcttcccagtcttgggtatgccttcatcagcagtgtgaatatggactaatacagagggtgttgggatgttgcctcaatgttgatggctgctgactgatcagggtggtgatcacttaagattggggtggctgtggcaatttcttaaaataagataacgattacgtttgccccgttgactctttatttcatgaaagattcatttgtaccatgtgatgctgtttgacagcattttacccatggttgaatttctttcaaaattggagttaatcctctcaaaccctgtcactgctttatcaactaattttatataataatctaaattccttgttgtcatttcaacaatgtttatggaatcttcactaggagtagatttcatctcaagaaactattttctttgatattcataagaaacaactcctcatccattagttttattatgaaattgcagcaattcaatcacatcttcaggttctacttctaattctagttctcttgctatttctaccacatctgcagcttcttcctccactgaagtcttgaattcctcaaagtcatccctgagcattaaaatcaacttccaaactcctattcatgcttgtagtttgacctcctcccatgaatcatgaatgttcttaaggcatctagagtcatgaatcctttccaaactattttcaatttactttgcccagatccatcagagcactatctatagcaggtatgccttacaaaatgtattccttaaataagaagactggaaagtcaaaattacaccttgatccatgggctgcagaatggatgttgtgttagcagacacaaaaacaacaatgaatctccttgtacatcttcatcagagcttttgggtgactaggtgtgttttcaatgagcagtaatattatgaaaggactctacttctgagcaatgggtctcacagtggactctaaactttcagaaagccacgctataaacagatatgattgtgatgccattcaggctttattcttccatttatagcacacaggtagagtagatttagcataattctttttcttttctttttttctttttttttttttttttgagatggagtctcactctgtctacccaggctggagtgcagtggcacaatctcagctcactgcaacctctgcctcccgggttcaagcagttctcctgcctcagtctcctgagtagctgggattacaggcgcccaccaccgcacctggctaatttttgtgtttttagtagagacagggtttcaccatgttggtcaggctggtctcgaactcctgacctcgtgatccacccacctcagtctcccaaagtgctggcattacaggcgtgagccaccgtgcccagcaatttagcataatttttaaggaacctaagattttcagcgtggccagtgagcatggacttcaacttagagtcaccaggtgagtcagcctgtctttcaaagatctgaagccgggcattgacttctcctctctagctaagaaagtcctagatggcatttacttttaatataagactgttttgtctatattgaaaatttgttgtttagcctagccatcttcatcaatgatcatagctggatcttctgggttacatgctttagcttctccatcagcacttgctgcttcactttatacttttctggtatggagacagcttctttccttaaacctcatgaaccaaattctgctagcttcaaacttttcttatgcagcttcctcacctctctcagccttcagagaaatgaagagaattaaggacttactctggattgggctttagcttaatggaatgttgtgactggtttgattttttatccgaaccactaaaactttctccctatcagcaaaaagtctcatttgctttcttaccattgatatgttcactagagtagtacttttaattttcttcaagaatttgtttattgtattaacaacttgactaagcgtttgttgcaataggcctagctattggcctctttaggcttttgacttgccttccccaccaagcttaatagcttttgatttaaagtgagagacatgtgactcttcctttcttgaacatttagaggccactttagggttattaacaatattggcctaatttcaatattgttgtatctaaggaaacaggaaggcccaaggagagggagagagatgggagaatagccagttggtggagaagtcagaacccacacattaattgtttaagttcactgtcttatagggacacagtttgtggcacctcaaaacaattacaatagtaacatttggatcactgatcacagatcaccataataggtacaataataaagagaaagtttgaaatattgcaataatcaccaaaacgtgatgcagagacatgaagcagcacatcctgttggaaaaatgacactgatagacttactcaaaacagggttgctgcaaactttcaacttgtaagaaatgtaatatctgagaagcaaaataaaacaaagtgtgcctgcattgattgtttttggcaatctcttactgtgcctaatttataaattaacctttatagatatatataaagaaaatcatagaatatataggatttagttctatccacgacttcaggcattcactggaagtcttagaacatatcctccatggataaatgggcactactgtaccagctttggttcaaatttttggaagagattttttttcctgtctctagccaataccaaagttgatatatgtacattttcttactgtcccgttctgcatagtgagctttttttctcatttactcttaccctcaaagggtaaatctataatgtctcagaattaggtagaagtctcctgttaaattcctaattttggatgcttttaactttatagtaggacctgaaataatggtgcttccttcaatcaataatgacttcaagccaataaaatatggtaatataatttatgatacataatagaggcctaataaatgtttgtttagagagaatggagaagggatgaaaggactaattgggcaatagagtttggatgtttctttaaataatagttccttgaccccatagatgtttgaggggaggagtgtggttaattgtactgttaacttttgtttagataagaaaaggaggagttggataagttatatatgagaccctggcaaggtgcaaagagagagaaaggcttaataatggaggtatcagtcagagttctggcaggaaagagatggcaaacctagatggatggaatagcacctgccatggcctgtttatgaactggactagagctctgtttgcatagggtaaggaccagaagctaaaaacaccattttgaaaatatctctatgagcttctgtgcatgagaagtgcagttctggggtcaaggcaacaatgatacatcccatgagacctcacagtttttgtagcacccaatcagataatagtcacctggtaaagtgctatgtgagtgtagggaaagagcacgttttaaatagaaccagtcttaggagaaacgttattccgctgaagaaactagaaagcacaggcaatgtttgcctcctgaaaaattactccatgttaagatttataggttctaggtctctcaaattagttgaatctacttggacttggggttgaaactcaatgtatagtaagttccattagtgataaaagagaatgaaaagaatatggaaagttaataggctttctagaaaatatagccatttgttattatggttcattattctgctatgtaaaaaaaaaatggttaaattgaggaagggacaaaaaaaggctctggggaaaagggtatacttttcatggtaagaaaataaagtcctgtgttttctggtgcaaggacaagttacttctccccaaggtatgaccctggcaatttctggtgaaagccacaattcctagaaacccagacccagatatcagcagttaggaaaatatgtatcttatggttaaaatgagaaagctatgttctaaggccatatgtagcaatgggacacagtcacaaggaagagagccagggtctgagcagcctcagcaaacttggtgcgtgagataagcaatggtcagaaagatggccaagtcagactcagaaaacccaggtggagtcatggcagaacaaaaggaaacaaaatccaaattcgcagacaaaactcagaaagacaccaatagcagtgagtaaagcaaggccaggcacccaaaactaaggaggatggtgagaagggtcagcccttccagagccaaagagcaggtcaaggtggtaaacaactgccgtgacaaataaggagaaaaggagctatactctctttatgttttacccacatcgggtaatgcctcatacagcatagatacccattaccgattgaatgaataaataggcccaacaagcagatttagaacattggaaacaggtcttcctagttcagccaactgaactggtttagctatcacctaaatcagtgcttcttaaactttaatatgcataaaaccacctggggattttgtttaaatgcagattttggttcaataagtctgggatgcaacttgggaatatgcattttaacacagttgtgaccgctatgctgctgatccacagatcacactgctccacaccaggatttgaataacaacagccttgacacagaagcttgaactagctttttgttaaggcataaatcaatttcaggagggaggactgcaagtagaaataaagaagcacctgccaggagtaaggaggtgaagtctagtcaagaatgacagttcttgagaggagtgatttgagaaactctcttgtgactgctgacagctcctagcccagcaagaggagacctgggtagctcagaattgcacatcaagatttttttatttttgaggagggaggggagatagaacatttaaaattgtttactcacaggagccatcacaagttttcataacctgaacaaaaatcatcacccaatgaaggatttcatttcagcacactccatctgtcttgttgcataaaaataaaagttcagggtttcttttttttcagtttaagtatgtcactacagtagagtttagtgacataaaaagatgatataaaaatagaattgatggtgtagcaaaaggtagaaatggggactttatagacatcgcagacagaattatcatattaactctttgtagtctccaattaaatacctggcccctcctctgtccttgtacttaccgtcctctatgaactatagcatttggtctccatttaaggaaaatttgcatcatgcttctgtctcttctagacacctattgatgcggctaccaagcaacagaacaacaacagcaacaacaaaaagtgatgaaacccaacttaagctatgataaacttctgtgttctagggcagtactttcagaatcacggacagcggcaaactcctgtggaggcagatctctttgatttcagtatgggccttgcagctatctccctcttgccactgtgcagaggacaaccatttttgacctgctgtaagtgtccaccctctcctgtcaattatttcccccttccctatattataggactgttccccactgtgcatatacatagaagccaacacagactttttcccataagcaggtgttgcatatatattcctagaattaggcacccatatattaaacaagttttccaggatgtatctgtagctcctagactgtttcacattgaatgcctgctctgcttcagtatgtctctctcagctactgactgtcaacctacatctgttcatgtttattaagtctaggagatggccttcaagacttttaaatgagcgacactttaggataggattcacaatatgtttcatagtataacaatcttaagatcatgtgtgagtaatcaacattctaatttattgataactgagcaaacttaagttgccattcttcctagtgtagtatagcaaatgaaaccatgtttacagcaggggattaactccatttcctaaaatcaaaattgggagtaaataagtgaggtaaaaggaggttcccaagagtgatgaaaccagacaagagaccacagccagtggtctatccttatatgaggccaatgcttacaaataataaaccgtctctgagttacagagactcaggagacatgggcttaagaagctgattgattacaattagggaaagacacattggaatgtgacagctaagaacatttcttttctttttttcttttctttttttttttttttttttttgagacagggtctggctttgttgcccaggctggagtgcagtggcacaatctcggctccctgcaactgcagtctccacctctggggctcaagccattctttcacctcaacctcctgagtagctggaactacaggcattcaccaccatgcccagctcatttttttttttgtattttttgtacagatggggttttgccacattgctcaggctggtctcaaactcctgagctcaagcaatctgcccaccttggcctcctaaagtgctgagattacaggtgtgagccaccgtgcctggcctacattccatttaatggcataatttttaggaaacattattgtaatttcctcagaataggatttatggactacaagtttcatggggaagattctccaaagctggccctaaaacctgcagtatctgagggataatggcctagaggatatctgacatggtagcattaagagaagtaagagagggctgggcatggtggctcatgcttgtaatcccagtgctctgggaggcttaggcaggaggattgcttgaggccaggagttcaagaccagcctaggcaatatagcaaggtcctgtctctacaaaaaaaagttttaattagccaggtgtggtggtgcacatctgtggtcctagctactccagaggctgaggcaggaggatcacttgagcccaggagtttgaggctgcagtgaaccatgactgtggcactgcactccagcctggatgacagtaagagaacctgtctaaaaaagaataaaaaaagagtaaatgaccataggaaaggcacagtgaagtggaacattgtcactggcagttataaggaacagaaactccatgggtctcagagtcaaaggaagacattagggcttattcacccagaaatgcgtgctaagtcaaggtcaaaacaatcaactttgaacttgggtcttagttttgcctccatgctggtttttgctaaggatccctcttggatacaagagccttcctactcatcatggaaataacagacaaaaaccacttgatgatggtgttatgagtttcctattgctactgtaacaaaattaccacaaaattggtggcttaaagcaatgaaaatgtattatcttatagttctggatattagaaacccaaaattagtctctctaggctaaaacagatgtcagcagagctgcattcctctggagactctaggaaagaatcatttgctgttacttttccagctgctagaggctacctgcgtttcttagcctgtgacccccttctagcaatcacagcaccctgacctctgcttccattattgcatctctttctttgattcttactcacctgccctctattataaggactcttgtaattatattgggcccacctggataatctgggcttctattcttgtctcaaaatacttaattacatttgttaagttctttttgctatttaaagtaacatatccacaggtcccagggataagggtatggacatacttgaggaaccattattctgcctaccatcagccgtgtcttcactgaaggacaaaaagcatttatctatgctgaacatggtgagtaactcaggacccaaagagctcaaggaaaatggctcactattccaaaagtaaaaggatttaccgtagcctagtttgtcaatttaaaacctttaaacacttaacatcacttcttgctccaagaaactctctccttaaatcattttcttgcaatacatcatcattattttttaaattaaccaaacaattacagcaatttttgtgttctgaaaacaggaacatgatagttggcttctctcccagaaaccttttacatttctttttacctatgagtgttatgaaaatcatctccaacatatgcaaccagagcagcacactagcatgctgctgtgtcctggctaaaactctcctgggatgctcacacccgagagagcctggcagaatggccactcactacttttgcccaattagaggaggattttgttgctaggcaggggtttacgcttacaaaacttcagacagaaatgctaatcagagactgaaggcttcacttctcctgcaatcagtcaagtcctgtcaattctacctccttaatctctttccatccctcccctttcctctctaaccttatgccttttctcaaggcagtgtgacacattgcagggattccccaaaatgacttgatcgtattaaccatttagggtgtatattaaacatgcagattcctaggcacctcacttaaaattcttattctaagtcttggcaagggctttggaatctaagtgtgtaataaatacgccaaagtgactcttattattaggctaggatgggcaaaactgacatgatgaaataggacgggcttagaaatcaggcacacctttgtttgaacaaacatttttcaagccaatgaacttggaaaagttacttagctactctgatcctgtaaaatgaagagttcattggttggagagttgaatggaatcgtgtgtgcatttcaccgcacacaaagcccagagttcaataattgtgaattatcttctcttaccgcccttcatgtctctccctatattataatacctgtcatattatagtttttacagctgagggatgctgactgactctgcaaatgtcacagaaagacaaccagaaacacttgtctaagtcctgtgccaggaccttccctatttgtccagttgtcagcttcatcgtgtaattacacaggctttcagagctctccctgctacacagcttcctctcattcacaagaaaatggtgggcttaatcatgtgagaccttgtacaccatcatggggatttaggctttttccagtcctttgtgattttcctttcctaaggtcttcaaactagatatccttatctgcctccctattttacctacaatcatatccccttccccaacaattgctcccttgcaagctctctgcttgaccaggtcattttcctcctactctatgggcaacaactttacaagtttgtccacaatgctttttacctgttcacctgccacactgttcttcaaagctcacatcatattgctttccataaaaccttccacaatatccctagactaacaccccaggaatacaggttgtccttaaaccttgggttacacacaagcctttaaatatgaaccactctatggtgttcagtcagccggtagtcatgggccaatgctgtctctctccttgggaatggggacctctgcttctcccacctcaacagtgtatgctgtatgaacacacatggctttgattgatatgccaggcattgtgaaatgccttctctaacaaatacttcaggcttgaacacctaatcttgagtggtaatggaacaggtttctgggagatcagaacaaatgcagagaaaacacattctaccttaaactgtactttctttccataaatatcctagaaatgctgcaagaaagccccgatactgtggaacatacaggtagaaaactgaaggactaatacaatttccagtagcccaaaggatagtaagcaagaaaatgagttgtgtccacagttaataataataatgtgttgtatacttcaaaattgctaaaagaatagatttgtaatattctccccacaaaaaagtcataagttggtgaggtgatgaatatgttgcttagcttgattgagtctttctacaatgtatacatagatcaaactatcacaatatacctcctaaatgtacacaattattatttgtcaattaaaaatacatttaaaatgagttaagcatccctttctatgcttttacagctgcctctgccttcccaaactaccccagtattcactcccccacaccttgggtagtcagccaaagtctcccactaggaatttcttgagacattccctgtatctccagtagttatcttatacccagttccaaagtgatgtctcccataccctgagctcacctccccatacacactaaattgtaagtttctggaaaacaggtaccacatcttgttatctgtgtgtcttcagcatttagcacagtatctgtcacacatctgctctggaaatggagtatgtatgaatgaagaaattaatgaatgaatgaatgacttgactgatggtgagttaatattggtgtcaaacagaaccctctgaagaaaatggtcacagtgaccaagcaaagactcagaattaaagtctttcactccatggagaaaatggtttgttggaaataaagaaagttcccaccttccaaatggaacccgtatataacccagtggaaattatgacttaatttgaggagaattcctataatagcaacatgttgtgcagaaaactgaagatacaaaaaagactttgtccttaaggatgggcctctgctatagcacagggagtgtggcatgggaagaaagtgagggttatgataaagatcagcatttctattgaaaattttagtctacacattgttttcaaataaattatttattgaaaaggcgtctgtattagaaatcagagtatctgagtttccaaaaaagaggcctcacctccgatctttagcttcttcacctgtaaaatgaaaagatctctacccatctgcctgggttgttggggggatcaaataagaaagggatgtgacagcattagagctattagaaacagccccacaaaataagtgactgaataagtcagtaagatgaattttttactgcatctgagctaagagcaggtagagcaaggctttaaaagcaatactaccatgaataaattgtgtggtgttggttaagtaatctccccttccacaaccttagttttctgatccttaaaattagagggtaagagtggaatgatctccaaattaccacttaacctaagatatgattcctaagaccaaatagagaaaaggcaaggtaagttcccgtttaatgaatcaaagaataccagcttccttggggcattcatcagaacagagctcaggtcctataaatctacatcatacaagtgacaatcagaagcacattgtcctctagcctatgttacagctgtgcttgttagcagcatgtccctagccctcattatccccgatggacctgaaccatttggccaaagccttacagggattgccagagctcatagttatttataggtgcagttcatcaaaggctttgagctttcctttgtggtgagagctgatctctttgactctcactctatacctttttcttttatgttctgtctgttctttaattccttgcatttttatgtgccttcagttctgattaattcgaagctgtacagattttaccatactgattcattggttgggagggatcaacaagaggaggagagaaatactataccaattcagcacacagaaaaccttagctcagagacctgaaatgaaggtttgagggtaatgggaccaagaagcatcacctgtgtgccaaatctgtcactaggaacttttcataggagtttatgttgcttaggctatttttatccagaggaatttgggttacctctagtttgggaagattttgcaagaattcacctgaaaaaattggaaagacaggaaatctggccacactcccaggatttctggaagagctgaacagccagggctcacagtccttattaaatagctcaagactcagaaaaatctttcagaactcagagcagccctaacaactgggtcatctggttaacctcctaggcagcagaggttcgcatttattctcatgctataccattatggcaactcagctatcacattgttttcactattctcttgctcctactcccacagctaactgctttattctttttctctgtctcaagttctgattgtttcagttagtctccattgtttatgatgagtaaaacttctacatcaagtcacctcataggctctggtcaatgtacagcttggttgtccttaaacaaggtacccatttctcgtctttcatctgtggccaggggagcatgggcatgagataccattatagcaagttatatggagagaaaccctcagaagggggctgtggcgggggtggagtagcaaatgttcttttgtgtgtgtgtgtgtgtgtgtgcgtgtgtgtgtgtgtgtgtgtgtgtgtgtgtgtgtgtgagagagagagatggggttttgctcttgttgcccaggctggagtgcagtggcgccatctcagctcaccgcaacctccacctccaaggttcaagcaattctgctgcctctcagcctcctgagtagctgggattatgggcatgcagatgttctaaagcctagactgcccagtaaagtgttcaaagtcagtgtcataatagagcctgagatgcctatataaaccaaacttctcttcctataaaaaacttatgatctataaaaataaattccaactcaaaaagcacataaacaaaggttttaagaacacttttatgtaccatgttattattttacaattcattctataccactctattattcattgactaagggttcttcaattagtgaggttcctaatgtgttaaaatacaatttactttatcaaagtgtagtggtggcataacttctaagcatcatctgttagaatgaagtacacacgttcaaggttgcattttatttaactaatggtattgctatggtattattttctgtgataatctattgcagaactgagtgctttagatacattccatgagaccagggcttttctatgagctggagacctaaactgtatttacaacagtgttaaaggctctgctcatcacagcaatcttacggtatttgattctctccatgtcttggtaaacagtgcaaatatgagggaaaggaaactgtatatttatctaagacagtggttctcaaaccatggtcctaggaatagcatatcgtcatctgagattgttcaaaatgcagatcctcaggccttaccccaaacttactgaatcacaaactttgtgggtgggtccagaaatctgtgttttaacaagccccccaggtgatttatgtgcatactaaagtttaagaatagtgatctaggatacttgtgtgagcttcctaagaccccagggagactctattttccctgagaacaatgcagtatacccataacttggctaagaacaagagtattaaaaacaagatattaagacatcttgaacaaggtattaagacattaagaacaagtattaagaacaaggtaactattgtatctctagttagttctgagtgagggtcaaatctgggaggaagccctacctaaggatgaatgccatatacattggttctttttcaccattctctgtccttcccttctgcttcagcaggctgcccctgaccccacctcatgtctaatctccttcagtttcctacatagaattttctcctacttcttctgtcaaccccaagtccaaatttcctttcagacctacttcaaaaacgactccctacaggaaatggtctatattgtctctcaattacatccattaagcatttattaaacacctactttttttcctggcacaagttaaagagacacatgagtatcagacactgttctcatgtccaataaggatgcacaacaaatcacccctctcctttgctttcactcaaacctttctctgcagttcctagtaagttatcacataatttcactttggttttcaccttcttccagcatatatttatcttctctgctgtttgacaggtttcttgagggcagtgaccatgattttaaactcatttgtacatagtatgtttcctaacagcctactgagcacatgctggggacatgttgggtttaatgaatgagatcacaaaacaatagtatagacatgtgcagaatggattctataccttcacagtaagtctcactgtcttttatttctctgccttttgatccaccccttacccactgacttgggctacaaaccaataaaatcctcaagacaactcatttgcctaaaggtggattcatgtttctctatgcggggctggtgaggaatccaaacaagtgccaggccagccactgggccaaatgacaatccaccaaactcttaattaagtttaaaaatacatcttaaatactgttctttggtacccctttttttggttggaatgatgtttgggcttaaaaaaatatcttgtagaatcctgactcagggccaaaggatgaattggatgccatcaattaatggagttagacagaacctgccaaataaatgacctgtacatgaccagaaagacacaaaggggagtgatggtctgtttagcagtgatgaggtgtccaaatttttcagctgaactaggttacaggccaagctgtattctccaagaccagctgcctaaaggttgcttacaaattcccttttgactcacatgccaaagcaatacttaggtttacagagcacatacctgcctgccaaggtagttatttgcaaatatgaacaacgttttgcaaggctcatatttgccaattttcccctctttatagatcaaagctgcagagagcatcataaaaactaaacttctaggtaaagacagaaagaaaagaaggcaagattcctgtggctctcttggaaactcatgctgagaaaatcatcaccattttatccataggatgttggggtcttgagtcatcagaagactttggtacctgctacctgatcttggggctttagtgaagccacaagaaactagaaggacttgccatgaaaaatgtatggttttgtgaaaaacagagatgagatggtaatctcacttaggctcactaaggttgtcagtaggaggaagaacctctggtaagaaaaagaagctcaactatagaacctggaattgctaaaactattcactaattagcagcctcagatgtactctgttttcaaggtaactcaacttcccacttaactctgacccaaccatggactcctctgggtactctgtggccaagctgtgacaagaccagatcattcaaaccaaatgtctctgaaagacagaagataacacagagaaaataaatctaggagttgtatgaaactagaatgatcttgtttacaagatacgacttcctcttcagggcttgcagttctgcagcattgactaaggtaatgacattcaggtagttcttttcctcctagcacacatgctaccatcagtgtgttctagacatacatgcctcctgactcagcagactggagaccaacaataggaaataggttttaattttatttttcagctgtgatcaatagacaacaactaactgctatgctggattgaggaggagtctaacgtaggttttatctcagctcagtgaggaaattatatgatggattagtgatgtcttgcatggatgaagataagaggataaagagggagtaatcgggggatgaatgataatgcctgtgcccggtatttgccatcctagtctagatctaagagagagatgccaagagagaggtacaggattctctctttcaccactctatggatctgactcctcttccatgacaaatatgtgaattaaggcctcctcacttcagggaaaaccttacctaaccacagaggcccaattgccatgtgcaaccatgttagattattgcatagtagcttcaatattcacacaaaagaaacactagtattttttttttgacacacagtcccactctgttgccaaggctgaagtgcagtggctcaatctcagctcactgcaacctccacctcctggattcaagtgattctcctgcctcagcctcctgagtagctgggattacaggtgcccgccaccacgcctggctaattttcatatttctagtagacatggggtttcaccatgttggccaggctggtcttgaactcctgacctcaagtgatctgcctgccttggcctcccaaagtgctgagattataggcatgagccactgcacccagcccatttttattcctggaatgaattatgacagttatcttagtcttccttttggtcacacaaaacctggagtttctaaagttacaaatagctatcacaggcaaagaagctgacccttctgggttactgtaagctttgcaaaacagtccatacttggagagaaaacctgacttgggctcatttaccgtgacttgggcttatttgtcgtgacttgggctcacttatccttgctcatggtgaagtttataggcatttctcatttctggcaagctgagagaggaggaagagttacaaaatgacttcagtaaggggaaactattgcaggagagtgcaaattgctagttttaaatacaaatgtcagaagaaagtctaagtgaaagcaggggctggtatgcaaaggaaaacaattatgaatggggaagacctaaaaaaaaaaaagacattctagatcaagaggaaaggagaggtcctccatatgcccacacaaaggacatcggttaaggatcatgctagacagcaagattggactgaatctcaaggtgtagcaaccagcttatttaaataagtaagtccaacacttatagggactttagatctaaacagccaagagcaacaatcaagacagggaagtgctgaaacatcacaagtcaacctccatattccacatgtggcccaatgacaagcatttatacaatatgattgattaccctgtagtttactttgtcaatcagtcatgaagttaattacatattactcttgggcactattataaataagggtatagcaaatagtgataaatttaatggtccttagcattcagctattaaattgatgacacagtcatatcagcattgatgaacatggactttcttcatcaaggataatttatatcaataagtataatgggctatctcattctcctttggccaacacattattcacactgttataggcagtgaatctattagtaaatgaggaaaaaatacgttttgttttctgttttttaaaaaaagactcctgataaatgctgattataagaaaacaggaattttatatcacggacataaaggttaaagaaaatgtgagctcaccataaaacttgctgaaatggaaaattaaggtggattctaaagagataacctgcatccaactgtggcttctccaggaggagcctttgaattgtcctgttcacctacctagaatgctcttgtcttccatccactccccgtacacttggatgattccattcctccatcagtcattgttttagatggcatgtcttccaagaagtcttccctgaccttctggactgagtaagatgccaatcttaggtcaggtcctccagaagcaaccctgaaataaggattcatgtgaaagtgtttccagaaataacggataggagagtggaaaattaggaccagagaggagaaggagacaagcaaaagtaggatataaagcaaaatctcaggagaattttggcccaatcctgccagggatatctaaaaacagtgtagtcacatctcagttgtctcaatgaacaacatttaaaccttgctgtgtgtcagtcactggtaaggatttctccaagcacttccagtactgcacactcaaggagaacaatctagcagtctcaggacagccctccaacaaagaggctgaggtgctgagtgttgagagagaaaagacatcaggaactctggtgtgcctcaaaatgataaaggaattcaatgtgacagagtagaacatattgatagtatctgcttcactggccctgcaaagggttcctgtagcaccctgaagactctctaagatagcatttacaatgctgcattgtagttgcttagttacttatctgtgtttcttgctagattataggctttgtgatggaaaaagcaatggctgccttgttcatcattttatctacagtgactagcacagtacctggcccatggttagtattcaaaaaatatttgtgaaaggagggaaaaaggaaaggagagggggaagtttgtttggtggaagtattatactagtgtaatacattacacactcaaacaaaaacgaatcttggtaaaacattattcttaaaggaattatgcaaacctactttactcattctgagcatgaaaatcttggctgtaaaagttggatatcgtccatgcagcccaagagttcatttgtaacagtccagtaggggctcttatatcaactagatgaggggagaataataaaactcctggtctggaatgaaagctatagccattttactatatggtcaacctgaacaaacacaaatatggcaacaataatgtttatattaattcctagcttgtttttatgaaatattcttgaaaattcttagctaatgtgggctagagaaccagctccattccaatcacatctagattgtattttaatctttcattattcccttacatgtatcatttaacatgtattttttaaaaactaaattctcagtggcttagtaaaatgaagatgtgtttcttagtcaaaaaaatctaatcaagtttttcttgggcagtcttcatacaatgattcaggcatcctggttttaaacacctgtgtctttatcatcccaccttcttctaaagcctaaagtctcacacctccagctggtggataggaaaagagaatggagagagcacacctcattcctaactactttagtccagaggtgaaacacatcacattcccttgacggtgtctagtcaaatggctaggaaatgtacccacccatcaataaccctacactggaaagcacaaatatttggtggatagctaaccaaccatgtcgttcattcaacaattacttgtaaagcacctaaaatatacaaagttccttgttagctgttgggaataaaattgtaagttaaatagaagtggttgcagccccatggagctagcttacggttttgggggtaaatatacattaatcaagtaatcatgaaaacatatgatcccaactgtgcaatgaaggaaaagtacaaggatagaataaagtttataacaagctagatctagcctgaatacctgaggaaggaacatatgggctgatatctgaaattggaggaggagtatctagaaaaagttggagagaaaagcattccaggcagaaggaagagcatgtgccaaggccctgacataagtaggaaagaatgcctgtgtggttgaagcctgacagtgagaaggaaaatgggggtgtcagggaggtgggggagtgttgtggaatgaggctagagaagtaggcagagaccatcaggggtctacaagctatggtagggattttagacttcttcctagttctgttgattcttattatgtgtttactatacccttctagtcacacattggtttatgaaggttgtttatatacatatattcatacagaccttcactgttcttgcccttcctctcagttctccactattatcaacctcctagagtatcctttccttaaggccagttgatttcaatgaaagttgtcttcctccccttggctccatttcagcaggcataaccaacactgtgcagtgccccaggcacactgtgggttctcatatctcagtgcatttagcacacacttgctgctccttgtacctagaagacccacatcctgtcatacttcaggcttcattgcattcatccttcacaactcagcttccccactcaattctactgtaagtccttcactggctttcctcaaactcctggctcagtcagattgctatccactccaaacccaccgtactccacattaaatgcaccactagcatagcacttattaaattgtgtagttggtttatttgaactgacttcccctactgtgttccaagtttttaaggaaagggatagttttcattttcatttccatattaccggtgtcttgccattattttatacatagtaggcactcaaaatatagcattaattgaatgaaaaaaatatttctcaaacttctttcacaagacactaatgtcactatgagttttacctaaattcagatacataaacaagttattttcttggccaaataagttggggaagattgtatattatgccctaatcttaacaattattgacaatgtagtagatgtatagaatacaaaatttaaggaagcagctgctgtcagcttaatgcaagcggcaaccctgcacttgtaataccctaagaatgactgcttccttaaattttgtgcccttggtggctggtttacctcctcctagtaataggcattgcacattgtcatttcaaaggctctcagagtttctgcaatagcaaaaacggtttaacttctatcatctcagggtaatccaaatgtatttgaggatctggccctttttaatttttcattaatacctattaacctcccatagtactgatgctctttgaaatgaacttttaaaatgctttgccactatatggattaatacatttcgatgtgtgctttttcaaaaatgataacctttatgtgggagatggatttagatagaaacttgggtccatttatcaaaaactacctttgaaaatacgttgaatgttatgatagccagaagaaatttctaattaggttctaataatgttgctggcctctcaaagtagttatagatgagaccactttaaaaggagggccatttccatcagtgaatggatgggtttacacttccaggtaaagaagatctgttttatctctccaaagacaaataaatctattggtctgtccaatgatgggatgaaatgagaagaaaagttcaattacttgggaaataagcctggtgggataggtcagtggccctgcttaacactgccaaaatctcagctctctgcttgtccatcttgcaaatgtgtgtctgactccatctcggtggaaggaataggatgtcttcctggctgactcaaagaaccaagtcattttatctcccaggaaagtgatccacccaaaagtctgtctgtcataattattgtttagaggaggagaattgcttctctttgacaaacagagtttcagtggtagcaatgttaggctaacagcttagtacaaatttttggttttcttgtttcatcgaggaacttccaagctgtttttctcacactagataactaagcatcataactcagtgagggaaagattggccagaaatggctgaatctatgcagaaaggctaagtgatgtagaaaataagcttctgggaactgaaataaatcacgtcacaaataactaaacaaaatttcaggaaaaaagagaaatattgtattatcttaaacttggtttccagacatttagagggtggctggagtaagtctacataaggtcccagccagcagccaattctgcagtgaggagaacccaggatccagacccaggtcagatatgatggttgcccagtggagccaagactgagagaatcccaaggattggcaaggccctaaaatgtcctgatgattttgtgcccaaggataaactagacattcagcccaagtaatccaaagaaatgtcgtggacactagaccagagcagggaccatgacgaatagtagtgataaaacggagggtccagaaccacgtgtgtgaatctggctagatgtctgagtgtcttttcattatctgagggtggtcagtccaatctactataaacacccagaattggcttggacatagcagtagcaaaactattttgtgtggatcattcatgtatgattggttaggagtagctaatttctccatgcttttgggatctgtattgttctcttattctaaaacaaaatttcaagtcctgaacacctatggtggttgcattaggcaataattaagagaagcaagtaaatgagttagaaatacatagtaatcaagtttcctggctgtgccaagacttcctcctgtctgtcagtaaatcccacattgcccatttgtggtttgcagactgattaagctatacaaatggaatcatctgttcttttctggtcttcaagcgccttttcctcctcagggatccaacggaaggttgcctccaggcatcaaatcacagcaatcaataaaccaccatgagtagcatggctcatttagaaacagagacacaggcattttgctagaagaaacaatgattacctgtcatgggttcagagacttatggtacttattagaagtcaaagaatgtgagacttttcatggccaaatattaaactattccttggccctcaaacctgttcttactgtgattcacatgtaggtgaatggtatgttcaatgacgttaaccaaaagtttggggagtaatctttaatttcttcttcctccttttcttctccctcaactccaacatctacatagatattgagacttatagttttttcttccttaatatctttataatctttccagtgtcacagatttacttcaaactctcattggacttctatttcccttcccacttcattcattcgctacttaacagcctgagtggtatttctaaattgctactctgatcatgtcatttctctgtttaaaatatttcacactgaattgcctgcagaacaaatatgagtccataatgaatgactctgaccaaataattctatggaatgctctagggcttagtaaatgctggggtggattgactttataaaaatagtgaaatacatagattataagatgggaacaatacacactggagactactagagagagagaaggaagagggtaagggctgaaaaactactcattaggtacaatgctcactacctggaccacagaatcattcataccccatgtaacaaagctgcacctaaaataaaagttaaaattattaaataaataaataaataaaatagcattctgtctcagctttcatataatcagtgcacagaaagttacataaaacatagcagacactcaaaaactattcattcaaagaagaataaatgagccatgcaagagaataagatttaaattctaacttcatccctttctagcttaataatctcaataaagttacctagcattcctgggcttcagtgtccttcaaaatgtggttaccaacactggtaggattaaatgagatgtacttagaggacttagccaatgacttagtggcacacagaaataatttaaacgcagtctgtattagcagcaaataggttaacatgacaaaaggtatgtacttcttaggcgtcacctatacagggtactttacaagaaaattggggagttgtgacctctgactgccaagacttggaacccacattgcacatatcacccctgtattagtcaggattctctagagggacagaactaatagactagatatatatatataaaggggagtttattaagtattaactcacccaatcacaaggtcccacaacagccatctgcaggctgaggagcaaggagagccagtccgagttccaaaactgaagaacatggagtccgatgttcgagggcaggaaggattcaacatgggagaaagatgtaggctggaatgctaggccagtctctcttttcatgttttcctgtctgctttatatttgctggcagctgattagatggtgcccacccagactaagggtgggtctgcctttcccagcccactgactcaaatgttaatctcctttagcaacactctcacagatacacccaggattaatactttgtatccttcagcccaatcaagttgacactcagtattaaccatcacaacccctaatcagtcaatcaaaaggcatttactcaggtctcatcatgcaactggaattcatgtttttcaataaggttaggaaatcttccctccatatcaaatgaggattttgcaattttaaaagtttagtttgatgttccagtggaaagatcaacatctgttggagttagagctatattaagtagaaattaatgattttagagtttgccttctaaaatccctctctgttagaattgtctttagtgagccattatcatctagaatggatccagtgacatagaacagaaatctggaagtgtggggctctattaataagaagtatgatgcaattactcttccaaagttgatcaagtgtgatcccactgatagatggaatgacaccagtaaagaaaaggtaaatccttagatttctaaatcattttaagaataggacaagaatttaaggaatattaagtccagttctttctccaggtaagacagcctttagcccctggaaaatgaagaatcctatcttaaaaaggtaatggccattctctgaccaatgcttcttcaactgaggactatgcagaacaattgtttttgtaaatcttgattggatttgaaaggaaaatcttttcagaatgctgagactctttcttcaaaatgcctgtctcctcatggtgtctctccaatgtgagatgtggacagatttctgttttgtttcacagcacatatggcagatactgtgtctcagcctcttgagctctggaactagcacagcctttctgtcttataaccctggggttgtaaggttatgaagttacaaattatgtacctaacctaaattctaaataaaatatggatttctatatcacttcctactgatactctaaaacatttgaagagatttattacttacttagcatttgtgaaaagtgctccaagattcttgcataaaaaatccatcacattttgcttttgttcactcactcattcatccaagcaacacttattgagtccctattaggtgcccactttaatttttcattttttccaagtataattaatgtctatttttaccactagactgtaagatttatatagagattagtccatctatcttcccatctttattgctgtttaaattgcacttatgtatcttttttgctgttcttctatatactgcacatatatcatttcccaacacagtgtgggtactcaataaagacttgataatgagtgaaaataaaccatcaaataagattgcttcctgctatgaaacagatccaactcatccaaagtaggtctagaaaatacagacaggtggagatataagtcatagagacagagagtcctaaacccaaaaaaattgtaaaggagagatacttataatttcagaactttttatagcagtgcttcatcagatgttaaaagtagtatgcatcatacctcaacagccaactggtctattctgccttattgagtatctatgcattaactaggaattgtgttcatatttgcaattcacataataaagtttcctgaatccaaccacccatcagtccccaaataaaataactggttctcacatagatattacacctgtaaatttggtagaagagagtggtacaggttgaaccagtgcagaatgactttgataatgaagacagagttctcattgaaagcctggggcataaatcactgtcaaagcctgtctctttactctgtccacacaaccatgggagtttcagtcctcctaaggagtagtgaggtgtgaagttaaaaggtttggacaagcatttgggagcctctgaggcttatctgagctaaccaagcctcccaaagccataaatctccaatgaaagcttccaagagtgacatatttcttgtggaatgtcccctagcttggctgcaatccagaagagcagggatgtgtgaactgacaagataaagccaacatacccattgcccttccatctcctcctgggcatttcttagtctggcttttgtgagtgtagtaacattttaggactgtatttgcctacttacagcaatactgcattgaattatcttaaggaaacaggatggcccttgattgttgttttctctctatggatgggttttctgttgttgttgttgctgttgaattgaagaacacagtgggagccaggacataattgctaccatagtcacaaaccacagactcctgggtattctgtgtagtgtttctgaatatgtccagagaccacatgcatccaaattagcaagttgcttgcttcaaaggcagattcttgtaacccactccagacaagttaatcagaatctctggaggtaagtcctggaaatctgaaatttaacaactcttcttaggtgtactaaattcttagacataaaaactttttattgtggttcctccaatgcaaattagtgttttaacagatgaggactgagacccagaggaatagaatgatctgcccaacgtctcacagctggtacactgggacccaaatctgtgccttcccaggtctgtccttgattctctacaacatcccccgcatctcctagggcattcaccaaagcatagcacgagtcctatagagaagtgctttgagatacttgcaccatctctggggcatgtaatctgagggaagaagagagccttaactggacagattacattccaattctgtgcaggctatcatgtaaacaagagagtagagaaagtatctctacaccatccggttgtcccttcaggctcccagcaaattttcctgctctacctgtccttaccttatgcttagaagagggtctggtattagtaatttgttcttctgtataaataagataaagaaatgttatacttgcatatgttgtttaccaggtactaccaggtttttatttgctcttggaagccttccctgactatctgcagtgaacactcccagacaacccttggtgcaacctccatttttgccacctccactgcatcactattatttatttgcacgtccatcacctgcactatatcatcagcatcttgagggatgaaactgtcttgcatttttatattctctttgccagctcaattcctagtctattgtagttgataaaaaaatgtgtgtgtgtatatgtgtgcttgtgcatataataaatccttgcaatgacctggcaaatagaacaaaaagtaattcccaccatagagatgaatgaactgggtagccaaaggcaaagtgatatgaggatgattacctagttgtccagtgaaacagaggagatttgaattgaattctgaatgaccccgagaatgctgctgtttccaccataccagagcactaccaagttccctttcaccatcaaagtgttctctctcctgaaggtagtgacttctttaaccaattctctgattttggaaaaggaagttttgccccattaatgaaaatgtagtgcattaattaaaatgcagaatgtaaactgagaactgatttagaagaaaaagaaaaagtagcaaagtccacagccagagagtctagaatcagatagagagcaagatataaggagcacatagaggtaaatggtgcgacaaagtctgtaaaagaagtttatgctttgagatgccccttctactaaataatatggtctgagtttcaggattagaggaagccttattagtctggacacatgctgctaataaggaaggtggtataaccccaagacagcacagagcactccacacagatgttatgccctagatgctccacgtttcctctcgaggcggggtcagagtgggagaataggctaggcagggaaaatgagtggcggatgactgtgcacaaactcatttatgaggcctgtagctggtggtatgcccaatatttataatagatcttaaaacaaagactggtggaaagacctgcattttacttggtcttgctccatcaagcaaagcagacttctgattcccctccccttttaaagttaacccttcaatcatttccttgcaagtttcaaacaggtctttggacacattcatctacaggtcacttggctacttcatggcatggatcatgccatacccttctcctatgtatcatctcctgtttgtactacccttgaggctaataatagctaagggcccttcttcactgtcattgtattagaagctcacatgaagcattaacccataaaccagggagagtcatgttacatggatcccaaaaattccagcaccatttcctctctttgctgttgccttggtgcatggataccttagtgtgtgaatatcaatgccatctatggctgctggacatcccagatgctggtacttctaccatcctttcaccctcagcccccaagaaacaacccaactgcatagagatatagatcaaccctcaggatgcccaaaactggattcctggggctcttgtttcatcaaaatcacttcctctgttctcttgacccatgtcattatattccttgctgtttggggaaaagacactctttaaagctggctttgtatttatagccacctccctagaactgagacatgagtctgtggagacagagcctggggacaaacctgagtaattgtcaccagactttacttagctgtgcctcacccctccagcatccagttcttttttcctggacccatcttgccagcatactttcacctcaccttaggttgagtccatcagaagatactcaggcccttgtacagacagatttccactagtcctgcccaccagtctagacaagggatgaacatgactgaggccccagcccagatcaccacttctggaattacatctatgtaattttgatttaagaaattctctccttcatttaggtcctatttatggccatcttatagggtctaccctctggtaggaagagttctatttcattctatttggcattctgcactgccaaattcagaagtccaaatcagagtgttcatgttgtaaatgaaaggttttcttttaactcccatcctagcagctaggttgatgtcagagggttgttgtcaagtctacagtgagaaaaagacaataaaattaagggacaataatcaagggaacttgacccctcttcccatgtacacaactggccaaaatctacccatattcaagtcacaacctccaaacaagctgagatatatatttggtattattttcatagatgtttacagtcctgtacaaagcattaaactaattttgtgtcaaatgttgtcactgaatttttaaagaaatacatcattccaaatactaaattatggatcaaattctcataaatccctaataattggtggacctaattatgattatatgtatttgcctaagagctccataaaatgataaagtattgcttgacttcctaaaagctacagttagaagactggtctagactgagtggtatgagaacacagtttgctttttacctttctgacccaattggcctttaattttgatggtctgcatttaaaattcattttgtgagtaaacccagcgaggctcctcctccatggaccactttgggtaatttttttttggcgggggggtggggggacaattttaaagagtgtctattatcaaagagaaattttaaaacatgtatatttataccatgtggttggacatcgtagaattagctggtaaaaaacaaaagaaggaaaaaggaaaaagtgccattggaaaggtacatagcagaagtaaactatgaagctatgtggtatagtgaaaagggcccaggatgtgaagaaataaagccagattcacggcctaattcaattcttgctagctctgtgttttggaataaatcaccttcagttgctttattgtatttcgggatcatcatctataaaaaatggaacctcccatctcatggacctctggtgaggatcaccacgagacaataaacaagtgacttttaattgtcaaagggatataatgatacctaacaaaagaaaacaaagggagtattgttcatcaggtattgatagttaacaattttattgctttaatataattatcccaggctttggaacaaagattgaaaaagagataaagatgcaataccacataactggagaattttagacaggatctcagagagcattcattccaattctcatttccagacacatattttatagagtaggaaactgaagtatggaggagttgagaagcttgcccaaggtctcacagcattatcctgagagcttgaaatagaactcaggtctcctgctgtccagctcccagcaacctctacaatccctaaagctgtttctagaatcccatctcttcgatcctgtgcctacaacccatgtcaacaaccattaaagcatattattcagttcaattgcctcctttaataattaaccagtttattacaataccttcccttccccttgcagtgcagagacagggccaaacactcagagaattgtcatagactcaactcagggagaaaggcctcttttgtttgctcatcaaacatttatctgagttcttacttgtgccccaaaactgtgctaccttgataaaaatctcagtgatcagaagtccttcaagtggtggatatactcacaagccagtgattaccatgtaattagcaatatgttaaagcaaatataaatggattacatagaagcttagaacatggtatgactaaggagccaggagaaatttgacagagatttctactttacctggaaaaatgataagttgtgacataaaaaaataaaaattttaaagccaagagaaaaagaacatatttcctttaactgtgagaattgtgcactgatcagcagcagttacgttatgtgatgatcacagtttggacagctggtttctgcccaccaggaactgaatcagattcagatcatttgaactctgatgtcaaagtcagtcatattttcaacaccctggatattctttttttaattattattatactttaagttccgggttacatgtgcagaacgtgcagttttgttacataggtatacacatgctatggtggtttgctgcacccatcaacccatcatctacattaggtatttctcctaatgttatccctctcctagcatccccccaccccacaacaggccctgatgtgtgatgttcccctccctgtgtccatgtgtcttcattgttcaactcctacttatgagtgagaacctgcagtgtttggttttctgatcttggatattctataacagcagtagttggttaacccctctgttcttagtttcttcatctgttcagtagggatgataataataatgtctcactgagaggattactgtgaagattaaatgagtcagagcatgacaaatgcttacaacaacacctgggacaaagtgagtgttcaataaatgttggcattttagtatgagaggaccaattgagtgtcactgaaaactcgtttcagaatgttactacatgaaaaccagggaagaggtgaagaaagttatatcagtcagagttcctcccaagaaacagaacaatgaggatgtgcatatattaagacatttattgcaaggaattggctattgttgggggctggctaggcaagtccaaaatctgtatatcaggccatcaggaagggcagactggaaattttagggcaggagctaaagatcctgtccacaggcagaatttatccttcagaaaagcctcagtgctgcttttaaggcttttcaattaattgtatcaggcccatccagattattgaaaaaaatttgctttacttaaatttttttttttttttttttttttttttttttttgagacggagtctcgctctgtcgcccaggctggagttcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgctttacttaatttttaacagcttttttgaaatataattggtgtgtaaagaattgcacatacttgatgtgcacaatttgatgacttttgacatacgcagacacctgtgataccatcacaagctgattgacatatccaacacctccaaaagtttccttgcatcaatttacttatttatttgtttgtttgtttgtttgttagaacacttaaaatgagatctactcacttaacaaattgtgaagtgcacaatactatactgttcactgtaagcactatgttgtatattacctctctagaacttattcatctaacatgactaaaactttatacttattaaacaactccccagttcgccaccttccagcccttggcaacctctattgtattctctgcttctatcagtttgactattgtacatgcttcatttaagtggaatcatgcagtatttgtccttctatgactggtttagttcacttaacataatgttctccacgctcacccctgatatggtttggatattcatcccttccaaatctcatgttgaaacgtgattcccaatgttggagatggggcttggtgggaggtgtttgggtcataggggtggagtcttcctgaatagcttggtgcccttcttgctgtaatgagtgagttattgctttgagttcacacaagagctggttgttaaagagtctggctcctcctccctcactctctcatgctcctactctcaccgtgttacatgctggctccccttcaccttgcaccatgattgcaagcttcctgaggccctcaccagaagcagatggcagcaccatgctttctgtatagcttgcagaaccatgagacaacctaaacctcttttctttgtaaattacccaggctcaagtataatgatgtaagaacacactaacacagtccctgttgtcacaaatggcagtatttccttcttttttaaggctgaataatatttcattgtatgtatatgcaccacattttctttatccattcattcatcaatgaatatttaagttattaccatacctcagctattgtgaacaatgctgcaatgaacctgagagtgcagacatcctgttcaagatgctgatttcacttcttttgtatttccaccccagtgtgggattgctgaatcatatggtaattctattttaaattttttgaagaacctccatattgttttccatagctgctccaccattttatattcccaacaacaatgtacgaaggttccaatttctccacatcctcaccaatacttgttatcttttgtgtgtgtacattttaaaaaataatagccaccttagcaggtgtaaggtggtatctcactggagtttgatttgcatttttctgataattaatgatgccaagcaccttcgtatacacctgttggccatttgtatgccttctataagaaatgcctatccaagtcttatgtcaatttttttaattgagttttttgtttgttttgctattaagttaagttgtaggagtttcttgtttatttagacaattaaacctttatgagatacatggtttagaaatattttatgccattccataggttgcccgttaattctgttgattatttcctttctgtgccgaagctttttagtttgatgtagtcctacctatctatttttgcttttattacctgtgcttttaccattatatccaataaataattgccaagaccaatgtcaagactttatccttatgcattctttcttctaggagctttatagtttcaagttttatgtttcagtctttaatccattttgagctgatttttgtgtgtgatataaggtataggtctaatttcattttttatgtgaatatccagttttcccaacacaatttgttgaagagctattatttccccattgtgtattattgacacccttctcaaagttcagttgaatatatatgaatagttttggttttggcctctctattctgttctattggtctatttgcctatctttatgccaataaacaatattttaattattgtagctttgtaatgtattttaaaatcaggaaatgtgatgccaccagatttattcttctttctcaagatcattttggctattctgggttgacaaaatttaatacaatttcatgataaaatcactcaacaaactaggtatagaagaaatgtaccttaatataataaagaccatctatgacaagctcacagctaacatcatactcaatagtaaaaaaattaaaagcttcttctctaagatcaggaagaagacaagtatgcccactctcatcatttccatttaacatagtcctggaaggccgggcaggcgtggtggctcacgcctgtaatcccagcactttaggagtccgaggcaggcagattacgaggtcaagagattgagaccatcctggccaacatggtgaaaccccatctctactaaaaaaaaataataataataattagctgggcatggtggtgtgcgcctgtagtcccagctacttgggaggctgaggcaggagaatcgcttgaacccaggaggcagaggttgcagtgagccgagatcatgccactgcactccagcctggcaaaagagcaggactccatcaaaaacaaaacaaacaaacaaacaaacaaaccatagtcctggaaattctagccagagcaattagggaagataaaataaaaggcaaacaaatcagaaagaagaagtaaagttatctctgtttacaaatgatataatcctatatgtacaaaaccctaacggcttcacgaaaataaactattagatctaataaagtaattcaggataaaataaagttgcaggatacaaaatcaatatataagaattagtaacctttctatatatttacaatgaaccatctgaaaaggaaattaagaaaatacttccttttacaatagcatcaagaacagtaaaatacttagggatagacttaaccaaagagttgaaaggcttctacactgaaaactacaaaatactgatgaaagaaatcaaagaatacacaaataaatggaaagacctttcatgttcatgaattgaaagacttagtgttcaaatgtctgtactacagaagtaatctatagatttgaagttatctccattaaaatctcaaaggcattttttacagaaatggaaaaagcaatcctaaaattcatatggaaccacaaaaccttctttactttaaagtaaactgattataaaatgtttaaccacatatataaaatagatgattgttgtttgattgaataactgggaactgctagccagatagccttgttgacacatgaagctgaccatcacaaaaagctagtgtacaataagttggcatagcacatttcttttaatgggttcaaggcaatcataaaacaagagtaggagggagtaacccgatccctcagacccacttatccatgcattctacagacagagctgaagaccccagggacaatgcacagactacttggctttgcatccttttgtgtggaaacagtgagcaggttcttcctctgtactgtttggtgtgctcactaaaccttagaggattctagtagtttacagtttcaatcaaagaatggggattttacacagagcagactcatgagaccttgattctaagttcctgcttctattaagaggtagcatggcataacaacaacagtaacaaatatatatacatatatatgtgtgtgtatatacacacacatatatatgtatatcagctatgacattagacacctgggttcagatccacttttgtcacttaccaggtgtctagtcaagtcacattccctctccaagcctgtaaattgcacctgtaaatggcagttaacctgtaaatagtaataatattgtcgtgtcatggttattgtaaagaattaaagaccataaacacaaatggcctgggtttataaaagatgctcagttaagacaagctatgatgcttaacttcctttatttcaaggattacctagtgttagttgtgtagtttcaggaaagttccttcatctttctgtgcctcagtttcctcatctgtaaaataagcatacaataagttgttctgtggactaagggagttaatatgtatgaagtgctctgaacaatgtctggcacatagtacgcactatatactttttaactattataatttgtgtttgtgtggtagtgatgaaatcaaggaggtacgaaaaccagattttagtccactctgtactgggtgaactggcagaagtcacttatctgtcatcaattttcttttctgtaaaaggagggggttaattagactatctgtcaagcttatgcatttttaaagatattatacctaaactgctctgtgagatgtaagaacctgagaaggttttctggcttgtgatagttttgaggtgctatgctctcacagatgtgtcaaggccttcttattgattcacaccaaggactctgcctctgtctcagtttttctgcagggtggttgatctgtttacttttcaccaagatgcgttcctctgtcagctgcatcagagctgtcataagccagcttcatgccagggagagaaggaaagacagtgtttttattggtctgtttcactgtgtctttcttcctttgggatcccttctcagaaaggtcaaaataaaattctgcaactgccctgatgaggaatgctagctgattgaagaaagagacccctgtaagcagcactgcctgctgctgagaggcccctgatggagttctgccaagcctgactcatcctccagctcagggaggcctgctggtcactccctttctgccccagccagagagcacattgcaaacatcttaaagacttgaggttggcagcttaagggggaacagtaattcaccaaagcatgatggaaaatctaatggagggcaatgaaggggtgaatgggatgtgtgccctgtcccctaaagaagggaactcctgctctttcccatttcagggtagtgttaaaaaaaagttgctcccacttcttttcttctatttgcttctgcctcctttgcctttttatttgctccttccaaaggtaaaagactaagtatctgatgtcagatgcaggcattcagtgagctgtacttactatcaggcaaagttatgagcctcaaatacaagggcccagaaaccactcttcttcctctttctatgtctaagcccagcaagatttcttctgctcctttctccaggtaaggagtgtgtgaatgccagggtcaataaggaggggctggcacaaagagagaaaaatatctgattgtaacagcagatcaattcagtgttctacaatgtgatgatcacagtgcacatcctgagtgattttccaaattactgaatcatttacttgttccactgttcattgaaaaatgaggtagaacttcatcctaccttgaattaaagggcttcccatcactcctgtcaaagctacattgcattgcatagcatttcaagcagaatgagctaagcctttcattgacttcattttgtatcctttgtgactagaactaatcttagcatttctgaattagaagaaagtttaaaaacatcccaccaaattttccataactgtctgcttgactttactacattttttgcatgtggtcctgcagtttctgcttgaacatttccagcaataaaacactttttaacaaacagattcctttgtttggtacaggtttattggaaaatacttcctttgttatttctttgtaacctcttaaaattctgtttttcctacttttggaatcagaaaaaaataaattgtaatgcctattcctacgatagtactttaagtacttggatggttcttagactaagttatgctgcagtaatctcagtggctgaaaataacaaaggtttatttcctacccacacataggtcatctgagagttctgtactaccctcacttagggactcaggttggcagaacagccatggtatttccgtggagctccactgctccacagtatttctgtagagttccacccctagatttacctgtcaagctgtctctccacagtcctgctccccattcagttcttggtcattgcagtgggccatctcatgctgctctctggtctgctttgtccccacaacatggacacagcccctctcctttattctccaagtcaccatcagcataatgatgttatgggtagcagatttgctggagtcttggggttaatggaagaagggcaaattgggagaggggaatggaagggtgacgtatataaataatctcaccttgaaaattagacatcatagtttccaaaattccttgcctgtctctcccctcctcccaccccaaacttgggtccatcttcagccctctgaggaaacccaccctaatttcttctcaattctcatgtcttggtcccacctctgtgtctctagttgttatcaaagagaaaattcaacttgaccattacctttttcagcagagaaatgtagctccttttgtcttaatctcttccattcttatttattctaatgaattctccttcctaaccaaagggcttcttaatatttcttaggcaaaataattatctgccaaatcctccatatttaaagagatagcagaagctgagaaattagtttttcttgatgtcttaaaaaggtcattgcaaatgtttttcattcctaccgaccccattttagagaaactttcaaagactgtaagtgtgagggttaatattaggggtcaacctgattggattgaaggatgcctaggcagctggaaaagtcttgtttctgggtatgtctctgagggtattgccagaggagactgccatttgagtcagtggactgagagaggaagactcaccctcaacatgggtgggcactatccaatcggctgctagcacggctagaacaaagcaggtggaagaaggtgttataaccttgcttgcctgccgagtcttctgatttccttctttttcctaagccagatgcttccttccactctttctgcccttggacatcagaatccagattctttggcctttggactctaggacttgcatcagtggcttcctgggggctctcagaccttcagccacagactgaagcctgcactgtgagtttcccgggttttgaggcttttagacttgaactgagccactactggcttcccagcttgcagatggcctaacacgatgggactttgccttgtaattgtgcgagccaattctccccaataaacatcctttcatatatacatatatcctattagttctgtccctctggagaaccgtgactaatacagtaagcatggatcataaacggtgaatttggaagtactgagggagtcagatcatgaaagaccttggaagacctgctagcctatatacattttgattttaagcagggaattaacataattagtgggttataagggggataggagtacaagtgagacaaggagacaagctgggagactgttgtagtaatgcagatgagaaggagcagtaggaatagacagaagtgctggagtcaagccatagttaggagacagaatggagaggacctgatgtgggagggtgagtggaaagaggaatatcaggaatgatgcccagttttctgtttgtagtaactgaatgagtgttgatgcaattcactgtgacagaaaataaatgagtaggaataaatttagggggaaacaatgtttcattttagacagatcatattatagatctatgaggcatcctgcaggatctgggaacagattaccaagtcagatttttcaggcaagaccggccagtgggatctgcgccctgaagaagaactaagctgcctcttagatccccaatattccaaggaaaacctctgagcaaaaggtcccctttgctgccttgatcttatttgaggtctgagcttctttcctgcaaatctttggcttaagatgtagcaatgatatctaaagtgctgaagactccaatccagtctccaccctgggagtacgtggagacctcctcttcacttagatgtgtgaccaagcacagggattgctgctgattcagtctagtcactctaaaaagtatcactcgagagctgaatatttagcccttttgttagaagtgaatggttgcatcttgtgtgtgatgggtgcataatatttaccagtgtggtaaatatctggtattgtctgtgcactattttccaaccatttttcacataggtacgtttaaagattttttgccttcctaataatttttgttgtcattgctattttgccttcagaaaaaaaaatagaaaaagaaaaatgtgattaatatggccccattcaaatcatgaagcaggagctgccattgtgaaagctatatagatggactcaggcacctaatgccaatgtaaaccagggaggctacctgctatgcctaaaagagtactggaattggaagcagggcacctgccttcaagtcccaggttttcattcactagaaggtccctttggcaagtcacttatctcccttgggtcttactggccttatctgaaaaatgggcagatcattgtagtcactgctgcatcacagggccatttgcagattacaaaaagtccaagtaaagggctatagaaaccagaattacatcccatatgctccaatcttagactcccaggctttggttccagaccaaacatctttcatctactctttctcctaaagttaacattgccttcagctgctgtggctacattcttaattttttaagaaagatcattgttttctcttacagtgcatagtatgggactgggactccaatggcaagcatgacttcattggagaattcacctcgacattcaaggagatgagaggagcaatggaagggaaacaggtacatggtcaaccacttttggttttgcctccagtcggtatgatgcatccttagaacacagctaccaatgaaacagcaagaggcaaaacatcaatgtatgattaagtgtgataagaagggagcatggtaggatgtgagtatctagattctagaactagcccaacccaaagcaattgtgtgtgcttggacaagacactgaccccaaacgttacagtttctccattagtaaaacagaaaggttagatgagagtatttctaacttcctttacctgtgtagccctgaaaagtgacttaatctctccatgcctcattttgctcatctaaaaatataagagtgataattgtacctacctcatagaattttgtgaagattaaatgagacaatcctaggtgatagcagagcgcctagcacatagctagcatttccaaaatatctgctattaacagtagtattccttctaggtctatatttccatgatttggtgacattaataatactttcatgccttggagaaattatttgaatcctccaaattttcatataggtaccaggttttcttctagttccatcattttactcttacacatttgatgccaagacctgtacacaagcactaccacataccactaagacacactgtcccacacagaaacccaaaccccttctgtgtttccctcagatacacacactttcatatcatataatatctagacagacagacagacagacagacagacagacagacagacagacagatagagatagaaagtcatctgggcccaaatcatgcaacttctccttttacctgtttattgttcacctgcccaatttccagctgaaatacctctttgcctggcagatttctctatctgctggagcctgttttatccatgcccaaaagcaagatagaagtgtggaaggagatgtaacaggaggtagccctcaacaaataactaatggaagttgggatataaataccccagctcccttgcccttcagttggcaaaactctgaggtgtatgctctatacagtttcccagagttctccagcaggccctagttatccacagtggtaactgacttgataatgcaccctttctgggatgcctcttctatctaatttctcactcctctattcatgcttcctggtatcacctcccagatggcctacttgcacttatattcttgcctcaaatttgcttcttggggaactcaacccaagacacctgccgttcttactctggagttcactgtcctcatggagcagaaaggagtgaaagcagagggctcagtgcttttgagaaagtctttttctttagagataatactctgtgcctgttctgatcagaagtgctaattagagatgcctcaactcatttttcagctctctcatatgtaaggtcaggatacagtcagactggatggaaatgaactaacatttttttagagtcagaaacttaatctgaatgataccatttgttgaacacatacctttggtctggaaactcaatggaaacaatggcagctttccacttagttcctgcaaaacctgctgtaaatgctctgttaggtactcagcattacaagaaacttgtcaaacacccagagaccatcacccacaagccaggatgcagagtttcagagccacagttaaaaccaacactaaattataagcaaagtcattcccaagataacaaggaatatagctagagaatattgctctattgaatatgcagaactagtcctatttagctgctaaatcaatgatagcattcataccacctgctagagttctaaaaagttttataaagttttgccttatccacttctatgaatagaaatagtccaagcagtaaatatgggaaatatttcatcttattaattaaatattaaaagtaagaatgtaacacatatcataaatgaaatataccaaaacctaatgctttcaaacagagagaaatcgtttaagttccactgaggaaatggaccatatgctaatgtgcttttctgaatcactgagctaccagaaaaactttagtttaactacccagccactgttttggtgtagttatacagtgggaaatattgtcttatttattgtttctacaatatttatcgagtagcacctagtaaattccaagcactgtgacaggctctaaatgcaccatgactaacaatgctgacatggtccctgcccttctgaagcttacagattggtgggagtcaggatagaatgtaaacacaaatttaaaaagttaaaatgcaactacaatttgtgacaaatgctattacaaaactaaaccagtttcattataaaagtgtgcatatagaaaagataatctgacatttaagttgaggccccttaatgattaaaaagaagccaatatgtaatgagtgagagaaacgcatttgaagtaaaaggaatagtagtgcaaagtacagaggcagggctgagcttggtgtgattgaggacctggaaaaagaccagtgtatctgaagcagagagtgaaagaaccattcataggatgtggtcagatatagaggcagaggccaggaaaagcagattcttctaaatgtgataagagcatgtgcaagctgtgctttcctatacattagccactagctacatgtggctatttaaatttaaattaattaaaataaaattaaataacaagttaagttcctcagtcatgctagccacatttcaaatactcaatagtctcatgtggctggtggctactatatttgatagtgcagattcagaatattccaattattgagaaaattctactggacagtgctgcaaagtgttctagctagagaatgacatgattggttttaattttttaaaatattacttttgctactgtgtagataattaaagagagacaagggagatctgttaggaggctaccactatagataagaggtgataatgacttgggttaaggaactagtcatagagatagataaattggagagacttaagacatattttggagatatgagctacaaggtttgttgaaggcttggatatagggagtaagggaaggaggaaatggttgactcaaggatagattattaaattgtgccatttcctgaggtaaggaagaattgtggtagcgaggtccagtttatgaggaagttttcaaaatttggtttcaaaaactggtactcagaggagaggtttacccgtaaatatattttaggagccatcaactaagagaggacatttaaaatcaagagaatggatgagtacacctagggagaggggactgaagagaaggtacaggaggctcgaaccctgaggaatctcagtatgtagcatcagagaaaaaaagaggagagaacatctttcaactttccttttcctgtgggagttatgattctataggtacagggtaaattcttaattaaccttgattaattcttgaataacatttataagtatccttagtttggggtggccaaaggggatacttgcaagaataggagagctactccaagaccttctagaagaaggcattgtggttaatagtgcaggctttggaatgagactgatgtgggtgtgaatcccaggtctaccagttactacctgtatgacctgggaaagttctttctcttctctgagcctcatcttccatctgtcaaagtgggctgtggggagagttaaatgggattgggaaagtaaagtgcatagcccatagttatatgccaacttcatcccaagacagatgcaaactatttagatctggtccatcaggaccccctacccacctcacaagtacaaggaccccaagtatctacgggtttgattcaacttccttggagccctctcctgactaagccaacccatacttgctcatcttagcctgagaaggaagtgagtagacttttcatggatgatcactataatttttaatagaattcaaaatctttaactcaatatatcctgcttgatagaagaaattgagattaatagaaatcattgagaatgacaaaaaatggcacagctaattttagtgtcttttctttccaactgtttggtaaatccctaaaccacctgttttactgaaatattagaggaagctttggggcaaaagacaatatcagttttgataggtttgggaggaacttgggctcttttgtccagaaatactaaatctactttgagatggactataattcttgtttatcaagttctacccacttggagagtaaatgagaagaaaatctgagggaggaaagaaagacaacattcattatggacagattaggagattaggcctttaaatgacaaaaacaaggctaggggtctgattttagattctgctttgaatgttttcttctttctttctttcacccaagaattccatattttgaaggagtcatagaggactcttcactggtataagatctccctcttccaaatcctatgtagttgcccagtcctgctggcaccttccagtgatgagaaactacagtatcagttatctgttgctgagtgaaaaaattagcccagaacttcctggctgaaaacaacaatcactatgtactcaacattcgctaggttggcagtattggctgaattcttctctgcttcacatagtgctccacgtggtgccaacagaactcactcgtgcatttgtgcctcagcagccaggatggccaggatatttctccaggtatacttttatcctcctggagaccattgtaggctttttaatatggccctgaaaacttcccagaagcaagagaggagccagccccaatacacaggcgcttttcaagcctctgcttatatcacatttcctaatgtcccattggccaaaatgagtcatgtgactaaatgcctcatcattgtgggagggagctacacaaatgcatggacactgagaggaatagattatgggaggccactgctatatcagcctatccatttgcacctgcctcagaaactacttcattttcagacacttctaattctcaggtagtgaaattttgtctcttgagtagaaatccagagattcagctttcataggttggtgggcaggaacattcaacaactcttggatatttgattcacaattggttttgtcccattaaatcttctgtaggctggagacctattccccttagttcccagctgactccttaattcccagccactcctgtagctctgatcttatccttcaaaaaggcccctttggagatctactgtgtcacttttgggacataagccaatccattattttagttctccatgaagttctatgttaatttattattgtccctagtaaatttctctagccagcattcactattcctaaccttttgagtcaattctcaggcagtaagccttagtacttggtcatcactcaactgtgttcctgcagatttcttcttccctgtactgctttatttgaccatattaatagtaagcattgacatgtgccaggccctgttctaaatttattacaaggattaatcagtcttcacaataatcctatgagatagagtataattataagctccattttgcagagaagacattcaagacatagagcaatcaagtaacttgccaaaagtcacataagcagggaagcggagttgctggggttcaaacctagaagtctgacagtgagtatcactctcaaccactccccctattgctcctctagatgcaagagttaccacctagagactatttgtcagccctccagttcagtttgtcctcagcagcacctaggagcttggccttattgaaagactcagctttttcctgaacagattctcatgctatgacccttctttcaggtgcagtgggagtgcatcaatcccaagtacaaagccaagaagaagaattacaagaactcaggcactgtgattctgaatctgtgcaaggtatgtacacaaccctctcttccaggagtatgaagctagggctatctgagaggaagagttcaggtggtgtggtcagaggaaaagagtatcaaaaagatgtgatcttttaaaataaaaattaaaaagtcatgtattaaagaacataaaatgagaaatgtaagcatgggtggtcatggagctgtggcagcgcagtgtcactgtcctctccccagggacagtcctgccccaaagacaggagagttccgctgataggttaggatcatctctgcccagagcagtgctagagggagatctccaaatggggaagccaacatttctagaacacctactatgtgcccttcacggtgtccagtggttgttttgtttggtttggtttggttttggttttgtttgtttgctttgttttgggacagagttttgctctgtcacccaggctggagtgcagtggtgcgatatcggctcactgcaacctctgccacccaggttcaagtgattcttctgcctcagcctcccaactagctgggactacaggtgcccgccaccacgcccagctaattttttctatttttagtagagatggggtttcaccatgttagccaggatggtcttgatctcctgacctcatgatccgcctgcctcagcctcccaaagtgctgggattacaggcatgacccaccgtgcccagcctgtccagtgttttatatgtggtaccttattcatactgaaagcgtaccataaaaacaagacaacaggcaaagattaaagggcttacgaattccttccagaggggctacaactttgcagagaatcacatgtgctaataattaaacttcttaactcaaatctgggagtgatgctgacactagttgagtacttactatgcaaaaataactataataaactctgtttaattcttaccacaaccctgagatgtctactttcaattgaggttatgtacctagctcagagtcacacaagtagtaaatttaagagctgagattttaacccacgtgtctctgactcctccatacaggactcaattgctatccagatgattgttgtgtgtgcatgttgtgtgtgtgtgtgcgtgtgtgtgtgtatacaggcatacatatatgtgtatatgtatatgtatatgtatatgtatatgtatatgtatatgtatatgtatatgtatagaggccaatgtcagggatattttgggttctattccaaaccaatgcaataaagcaagtcatacacattctttcatttcccagtgcatataaaagttatgtttacactatactgtagtctattaagtatacaatagcattatgtctaaaaatgtacgtactttaatttaaaaataccttattgctaaaaaatgcaacagtcatatgagccttgagtaagtcataatctttttgctggtggaggaccttatctggatattgatggttgctgactgatcatggtggtaattgctgaaagttggggtggctgaggtaacttttaaaaataagacaacaatgaagtttctcattaattgactcctcctttaatgaaagatttctctgtagcatgtgatgctgtctgatagcattttgcccatggcagaacttctttcaaaaatggagttaatcctctcacaccctgcctctgctttatcaactaaatttagggaatattctaaattatttcttgtcatttcaacagtgttcacagcatcttcaccaggagcagattcaagaaaccactttctttgtttatccatgagaattaactcctcatccattcaagttttatcagttgtggcaattcagccacatcttcaggctccacttataattccggttcccttgctatttctaccacatctccagtttgtcccaccagtgaagttttgaactcctcaaggtcatcctagagggttaaaatctacttcttccaaactcctattagtgttgatatttcaacctcctcccatgactcatgaatgttcttaatggcatctagaatcatgaatcttttccagaaagttttcaatttacttttctgagatctatcagaaaaactaccgtaatgatagttataaccttatgaaatgtatttcttaaataagaagacttgaaagttgaaattacccctagattcatggggtgcagaataggatattgtgttagcagtcatgaaaacaacgataaaaccccttgcacatctccatcagagcttttgggtgactaggtctattgtcaatgaactgtaacattttgaaaggaatctttttttctgagtagactcaaaatattcagtaaatcatgctgtaaacagatgtgatgccatccaggctttgctcttccatttgtagagcatgggcagagtagatatagcataattgttaagagtgctagaatttttgaaatggtaaatgaacattggcttccacttaaagtcaccagctgcaatggcccctaataagaaagtaagcctgccctttgaagatttgaagccaggcagtgacttcttctctctagccaggaaagtcctgatggcatcttcttcttccttgttctacaatgaaaatccgttgtttagtgtagtaaccttcctcaaatgattttagctggatcttctggataaattgtggcagcttttccatcagcatttgctgctttaccttacacttttatgttacagagacagtttctttccttaaacctcatgaaccaacctcctctgctagcttcaaacttttcttctgcatcttcctcacctctctcagccttcatagaattgaagtgagttagggctttgctctagattaggttttagcttaagggaatgttgtatctggtttgatcttttatctaaaccactaaaacttccttcacataagcagtaagcctatttcacttccttatcatttgtatattcactgttttaatttcaagaacttttactttgcattcacaacttggctgtttggtgcaagaggcctaacttttggcctacctcagctactgacatgccttcctcactaagtttaatcatttctagcttttaattttaagtaagagatgcatgactcttcctttcacttgaacacttagaggccattgtagggttattaactggcctcatttcaatagagtagtgtctcaggggatagggagacccaaggagagggagagacatgaaggaatggccagttggtggagcagtgagaacacacacaacacttatcaattaagttcaccatcttatgtgggcttggttcatagcaccccaaaataattacaacagtaacatcaaagataactgatcacagatcaccataatagatacaataataatgaaaaagttggaaatattacaattaccaaaatgtgacagacacaaagcgagcacatactgttgggaaaatggcaccaatagtattgctcaatgcaatgttgtcagaaaccttcaatctgtaaaaaatataaagctcaataaagtgaggtacaataaaagaagatacacctatacatatatgtgtgtgtgtgtatacacacacccagatggtccccaatttacgatgactcaacttataattttttgaacttatgaagggcttattagcatgtaaccccactgtaagtccaggagcagttgtatatacatgtatttatgtatatatacagtcatgctctgcataataacattttgtcaatgatggaccaccgatatgacagtactcccataagattataatggaggtgaaaaattcctatcacctagtgactcatagccattgtaatgcaattactttattttttaaacaaattcagtgtagcttaagtgtttataaggtctacagcagtgtatagtaatagtctaggccttcacattcactcacctctcactcactgactcactcagagcaacttctagtcctgcaggctccattcatggtaacttctctatacaggtgtgccatttattatattttataccatatttttactgtgcctttttatgtttagatatgtttagatacacaaagacttacagttgtgttacagttgcttacaatattcagtacaataacatgatgtacaggcttgtggcctaggaacaataggctataccacatagcctaggtgtatagtgggatataccacctaggtttgtgtaagtatactctatgatgttcacgcaatgataaaatcacctaacagtgtatttctcagaatgtatttccatcattaaatgacacatgattgtatatatgtatacgtgtgtgtatgtgtgtgtttatgtgtgtgtatacatacatagatatatgtttcctaacatattagaaggaacctaatatgtatatatacaggaccatatccttacataacaagatagtgaaggaaaagagtaattggtctgctttgggtcatatccctaccctttacaccaattgctgggactaggggataatgtcttatgactggccattgtattaatctttttttttcaatattttttgatgctttgacaactttgggccttatgaacctaagagggactactctcccagtgttagctaattcctatagacagcaaacaacctgccttttagcatgcctttgatatacaaaccaatcattttttagttcaaacccccaatcacctcccttaccaaactctcacacaccaagccaatgttctcccaccttatatgcccctagggtcaggtctcacataactagaaaccactcacatggttttgatagatttcaaaacctgctgaaatcgttcaaactatccaatcctaggcctgcttagctgcttaccctgccttgcccactcctgcctatgaaaaaaaaacacacagtaaatggtttgcccatgctttcccttcattgcttttgcttcctgacctatcctggtgcttccccatgtgaccttcctttgtggcataacatgcctcctatcctttgaagaactgtgagcaataaactcttcttacagatacagacatctgtctccatgtcaggcatcttatcataactgtacaaatcaaatcctgggtacattctaaacagttatgtgactatccttgtgctcaaagaagcaggagaaaagatctagattcaatggttatctttctccttaaggtgactgtgtacacacaattttttttttcttccatgagttgctcttagagttcagtgctcagaagcactgttattttgctcactttcaagttcttatttctttgatatgcagacacagtagcacagtgtcccaactatcaggcaaagcattaccatcaggacaccaaaagtaagcactatttagaggccaagtgaacatcaattctaagaaaagtatgccaatagatgtgtgccacctggaggtggtatctagagagaccaacactgattttttgggtctctctaagaagcttcctgagcattagatggaatctgagaagtgacagtcaaaaattacagttactggctgtccaggtagaaggatccagactgtaagtactgtatgtgtttttctaatcactgtagtcctagaatctagtgcatagtgagtattcaataaataattgttgaataaacgaatacatgaatatcaccaagagccaagccaagcagcaaaatcacaaagaaatgtaaattaagaccagaaatccctaaggtacttgagaacacatgatggcagttggcataacgcaacaaccatactgacttccagagtagaggtcaaaaggacagagtatgtaacccagacttgcatcatttgagtctcaactctaccatttattagcattgtgatcttgaccttaatttcctcatctataaacagggtacaataataatagttgtgccaccttcataggattgttctgagaattaaatgaggtaaaagatgttaagtacctgtcattcagtaatgcccaataaatgttagtcattgttgttcatggcaggggaagcatttaactaactggaaattgtcagtaaattaccttctcagccaatggtattttaaaactgcctatctaaattacctgcatattaagaatgtcaccaggactgggacttagacacagggaggcaagactgaagtcaagtgtgagacatcattgatttcaaaacagtagtgacacttgaaaatatagttttagtctcacttcagaggcataagctgattaaaatttgcataaaccataatagaggggagcaatggatggatattggcagcattcataggcccatctgtattaatattgctttccttctctcctttaacagaacaaacttaactgacccatcttttttcaatgatgtctgtctgccctttcctctggtttagcagcttatcagtcaccaacctttaggcctccaatatatcaggaaatagactgtgctgttattaacccagtttcctctcccctcctatgcagattcacaagatgcattctttcttggactacatcatgggtggctgccaaatccagtttacagtaagttgttttcatgttgattccttgattcttattcaggaatcaagagatgaggggtggcactgggtttgggggataaagagacaaaagcttattaaaaccttcaggcagctttgttcaagtctcattgttgaagcgtatggtatcgtgtttttgaaatgtgttcacacttctgttttctttaataagtatagttttcagcatcatatcaggaaatttatgccactcaacctcaggtggtctaggaaatcctcctaacgcttcccatttcttcagtaactatgtgaggcatgaagcagagtagcctgtcagattccatcacctggtgagaaaaattgaaaggaagtaagccaagcaagtaagttccactgagccaaggcagatgccatggttgtgttcatgtgactagaccacagcaccaatgtcatacccagtagtcgggaccaagagtaagccatacaaacagttcattaggcaatgaaaagatgaattccaaagattggagaaccaggccgaggtcaaggttgagaagtagagtgggtgtctagactcagtgaatggatcaaggatcatcccctgtatgtaatttgtgtgcccttgggatttacacacccctgatgtatatttgactgggtaggctgagtctttttaaagtgcctaggtaggtcaaggttgtaagtccatctgcactggaacaactgactttcactgacttaatattcaaaattctcctaggtttggtcagatgtgacttccagaaaaagaatccccagatggcaaaagacagatgtgctagaaccctttggaaagcaatgtggacgtaaacaagagagatgtaacttgtacagcatttatttctcatcttacagaaatgtactaacgaagctcagccctgttcagctccctgactggctcagtcatttgaaaaaaggaaataaaatgggtttaaatttttagtcaagctttgggcccaagagagtagacgggacctatatattcctggaaccaaggaagatggtgctcaaaggactaaaaggagtctcaaaggatgagataaatggtcatttactaaactagcttctccttagctagggaagtatcctctgccctaatctcagggaggtatacctatgtccttcctaaacttggggtattgtgcatttatttctgaacgcttacaggagcaaattttagagtttggtctcctctttaaagtctaagattctctaatgcacagccagcaagccttcctacattcacactgtcacatacagaaggtagcaagcatgttcgctgaggatacacatctaactctagctgtcctgtgggctcattgctgctctgagcatacccatatggaagtatggaagcaagcaatgtcataaaggagagctactggaaatagtttcccaagatcttaggcaaaaacgtgatttcaggaaactatttatagcttttcaagggaaagctctattgatttcagtctggtttagattttgtagatcccatgctcttgaacaactctgtattcaaccttcaggggcttgctctgcccttcaaattgtgctgcaaagaatcagccccaacaaaaattaggtgctgaaccccaacctaaagtgttcccagctccacatcctgactttcagatatccctgtgccctgcattgttctcccctcctttctcagtctgctgaccttcccccactgagagtaccacttcagtgtttgtcaccaacaacaccccagttgcagctccccatgccctccagtgtcaactgatagacctgtgggaggtgtgagtgaggagagcagtctggagcaaggaatgagaagaggagaatgtacagatgaatgctgaggagaagggggcagccaacaatagttcctccccacagcccttcctcctgtagggtttcaggttggggactcagaagagaattgctaggtattctattcccagtgttctactaaaggaaacataccagtcacttctatgtcattttcttccaaaatgaagtcagctttctcattctaaatgttttattgctcaagtggtgcaacttaatttaaattataagctgtaatgcaaatcgttaagaaaaagtatcgtgtcttatttaatttggtctgtaagtgtttattatctgcctggttattttactgaaaccatctggcaacatgaaaaggaagtggcagagagatgagaagtgaagagaggaaggtttcctggcatggaggtgggcagaggagagagagaaaagggatgtttcattgcagtaattatacctcagaggctttcagaggcaaaaacccccattggcacattatgtgacccttggctcctgagcaaccagggagctttagccaacacaaactttttgtctccctggagaaaggccttcaagcaccagaggtgacataaagttctggatgttctccatttcctcccctagagccactttccatccttctccactctcccttctgtgccccaggaagcaagcctccttggatgcaccacccaagctctccagctcttagcttttggttggatttgaccaacgagaggcagccatcagagatcaaagaataggaggcgagagaacttgaaatatttatttctctagctgcctgcctgctaggctgtggttgggcagcgaccttcttcctgacagaaggtcacagttcctgtcaggtgccctgtcctgaagatactcctcttactgaattctagtaactgctccctcccactctttctggtcagtttccattaaccttttccacatgtttgtgaattgtccctttattaaacttcctcaatcaccttttgagtggactttttgtttcctgtagtggctctgaccaatacaaaatataagcaggggctaggagaaagcctttgtatcttccatagatgctggtgcttctggttcaatcttaagagtgttaaagatgggggcatctttctcctcagctgctaagctgctcaaaatacttttgctgaattgtaataattgaaccctaaaccttcaaagggaggttagatttagaaaaaagaacaaattggataaataaacatgatattggggttttgctttaaaaagcatcccccataaacttaagtatttatgtaccactatattctaattataaatactaaaaccttaattaggaaaatgaataaacaggatgtatttaggggagtattggggaagcagtttggggtcagaacttgaagggctttgaattttgaggtaatttggtggataatgcatgttccaaaggatattgacgagggccttgaagcaacaggcacatgctttcgacaagtaaacctgggtgtttgatggtggtgatgggggaacgagagatgaagcaagcagagatggaagcccactgccacaggcctggtaccaggtaaaaagaagctaaacaagggtggcagcagcaggagaggtactgtggaaagagaagcactaagcctctgcctagaatacaatgagaagactgaaagcaatcaaagcttttgtgcctgactgacagagcatagtggacctggtcagggaaatacgcgaggcaacagcagctgtaggcaagatgatgaatttggctttggacacgtcagaggtactttcaggtatcccagtggagatggtacttataaatatggacctaggtttcaggggagagtcaggagctacatgtatgtggctttggatgagatgtcccaagagaaaaatatagaaggaaaaggggcctgatgacaaggaattgtagaggacctctatctggcagcagaggaaagaggggcaaagagttaagagaagaaatgccagaggagaagaaggcccaaggggaggcagtaactcagatgcccaggaggaaaaagctaaggttaagatcaagggcaacaatcttgcatgctaaagagaagtcagagggtgaagaacaacatgatgagtaggtaggtgtatatcatcttcaaaagagcaacttcagcataacgagataggtgagacccaggagttagagtgtaaacagaaggtaaagaagtgaacacagcaggtgtaagtattcattcaagaagttaacagtgaagggaaggcaagaggtacaaggaggatggcaatttaaagattaaaagagaagagattttaagctagaatcagactataagcagaggtaacagcccagtggaaggaaagagataaatgatgctaaaaagagccctagacagtcaatgattcttattcttttttggtcacctgaacacttgagaatttgatacatgatctatagcctcttactgggaagtgcacacatccagttttgcatgcaattttgggaggtcaagggcactcctgaagacagtccttgtacctcacatgaatccttaagtcataagaactctagagcaactagtattgcagtctttgaggaggtgggtggaggtgaaacagaccacagggtgagagattgggtttggcacatggtagagcagctaaaaataaaaccagatactagaatttcacacacaaaatacaaagttatagataacacaaaatagacagatgccgtacagtatttgaaaagaaaaaatgggggagatatacctaatgctagatgacacgttagtgggtgcagcgcaccagcatggcacatgtatacatatgtaactaacctgcacaatgtgcacatgtaccctaaaacttagagtataataaaaaattttaaaaaaataaataaataaataaataaataaaaagaaaaaatggtagaaaaatcaaaggtttttttgaaggttattgctttttcatatgctcaaaaatgttcattgtaacacagatttttacacaggcactctgtcagcaacctaaatgtctaacaataaggtaatggctacatgaattacagtattcctttaaatactatgatatttattatcatagtatttagttatttagtattgactatgataaagcctatttaaattataattctaaggtttagataataacatgaggtcatgtttatgacatagtgttacaaaaacgtaaagcagagttactctatgattacaactatatatatataaaatacctagagaggaaagaaaaataaaatatgacttaccagcctagtggcatggcgagtgatatttttttcttattaattttaaacggacatttcttttgtgtcatttttaaaaattgaagataatattgctttctcttacctctgactatagtttatattttagtaatataataagctgctgaatgcaacttctcccagactgaccttcaaacctaaaaatttagatcactcattaaaggttctctcaggaaatctttttctttctttctttctctctttctttctttcttcctttcttctttttttttttgtttttttttgttttttttgttttttgaaacagggtctcactctgtttcccggagtgcagtgcagtagcacactggaagctcactgtaaccttaaactcctgagctcaagtgatgctcttgcctcagcctcctgagtagctgggactacaaccatatgctaccacactggctactttttaaaacaaatttttgtagagacagggtccagctgtgttgcccaagctggtctcaaactcctggcctcaagttatactttcatctcagcctcccaaagcactgggattataagtgtgagccaccgcacccagtctcaggaaatcttttctaaccctaaaacatttagggcatcctatgtccacactgtggcccagtttacatttttaaatctttattttacatcccagattgaacactgatctactctggtgtagaccttcgagtctgcttactgcttagtgagccctgcttactgaattcctatgcaaagccagggtacaatgggttaaagaggcaaatgctttgccatttccagaaaatgaaccaagtaagtttaggtgactttccctactttcctatttaactgccctcttagaaagttttctgaaaatagaaaagaataaaaatgtaacattatttaagaaatggtccagaccaaacagtatgttcacctacaaggttcattgtataggtccaaattgtacacagctatttaaaaagaaaagaaagaaagctccccaagaatgtggtcccaaaggtagactgcaggtacaactaaccagaggttgttacacagcagcttcccttagaaaacgtcgagaaggttcacaaatgacctgtttggcagatgaagggaagggatctgaggagtggggttgtttcatgtaagaatctaaaaatgcccaaagaaagatgctcatcatttgcaaccagccttttcccaggaacagctccacacactggggacttggtgtcatggagggggcattttgcattcttactttacaaggtttgcaaagctgctccacagctctgcttaataatgagcagtggcttcctgggcagaaggaaaaagcactgggcacctgttcttgtgctgcctgcagagaagattggagcacataccagaaccacaggtttccataaatgcttcctatcaggaaatgaaaacgtggtggctctgcgagctcaccggtattcagaaaaccaggcatcagtagccacctccacacactgacatttttcagtcattttcttgcttttatttctcaacttaatcccatctttcactgcctccctgttgctttctaaaataaacctaacctttcactctgctctctttctactaatgctaactttaaagagcacagagaattcttggtggaagaccaccccctgaagatagatattttatctccagcttcataaatgaggttttaggaaccactactttccagaaaataaaaatgaaaatattttagctgactcttacttaagactgtccattgctgtctagtcacatgataaaatttttttattaaaccatgagaactataaaatgggctatatggtaagaatcataagcctatttcctttttcatcagttaatttttaagttcataccctcccctaggtcgatatgagaatctcctgagatgaagtggcctctctcgttgtcatagacgtaggggccattgccatgggaaaagtggaaaccctagaggcctgactgaaaagaaataatagtaaaatttccaccaggcatgtttgaatgtttaaatagtagcaccaagaacaggcagcccaatactaaccttctagcattagcctgtaccttgtttcattatcttcaaaatatattattctcttctgtcccctcaaaacctggccattccctttccctaactgacatccaactctgcattcaagtggtcacaaaatcctattcattttctatccttactttcttcaatcactctttccttctcaccatcatctttgccccaccctagttaagcataagaaaattattccaagcctgacaatgaagagttgataggaatgaaaatgacatagtagggtcagtattggaggtaaagcaagagacgtacctggggtgcaaaatttaaggagactctcactctgcggattttgcaagtatagggtctgctgagagtgagtgcctccttgggttttacaaactaggcacttctttttgcctcaccccatctccagctctgatatgtttttttctattattttaaaatatattgttgccacaatctatgtatgcttgtccagacattacacacacttatctagatataacatattcatccaggtgatatactctggctcagatgctgccactaggtgcctgcatgctaggagaattttgccaatgcctaggaatgtttcttgagcagccatttttctttatggatttttttcctctggcctatataacccgattgcattgtctagttttatatcaagacaccagcatgtttttgtcatcacagaacacccttaacacttcaggagtttcagtcagacaaccagcacatgggacagattgttagctttagtatcaagaggcagaagcatgatgccttcagaggtaaggaggtggtgacccatgatggaaggcatcatgaatagaagtgaggtgggccacaaggtgtttgttattaataataaagtagcaacacctgccaatgattcactttttagataaattaaagcagaatcaaggtaatctccataacaacatcttcacgctctctagaattccctggagtactaacatgctttcctcagtggaagagaaaggggtggctttacatctggccttcccagcattacttttaccttttaaacactatgtacacctgtgcaaggtgccattatcccttaaacatgtcccattaggagtaaaaggctgagaatggtgtctgtgagttgagcttggtaaacccaggagggccccaaagatatgattttctcaaacattgtctctcaaacatctctggagtgctcctctcagaaattttcctggaattatctgcatgagtttggatctctatcttgttgaggcctcattggtggatcctgaggtgctcttcacctccttcttgttcagaaaatgcatgtaggttcctctctcccaccagcttttcatcgtagtccttgattaaaagggcctcacctatggtcttacttttttttttttttcctggtgggttggctctcaccttcaggataaacctgtcccagaagacactggactttattggtctccctaggttacctccactcatcctcagtaacaatcatctcactattgtgtgtgcaaacatacatacacacacatttcagttttccttttcttaagttttacacccattttggtcacgaagagtttattccaggcaattcttccccaaattgccatggttgcctcctagcaagtctccctacctccaggccaaatctcctgcattttttattggaataattatacccatgagaagtcctggtgttttggtcatagacatacatgttctcctggatgtatgatggcgtaatggaaaaaggtagaaaggaaccatatagacttggatttaaacccaactccaagccctgttaccctatgtcacatgaaaatggagtaatatcatgcatataaatgaagtaatatcatgccctctgtgtcacacacagttagcacagtgcctgacacagagattatttctctcttctttcctttgttatccaaagtaagggaatctaaggttcagggaagaactgcaatttttcttcagataacctttttttttttttttttacatactcttagtactagcatttatcagtaggcatcccctgattttaagaaatctgggtattctgaaaacagagtttgaatcctaagtttatttttgacgtagttctttggagaggcaaggaagaaaaagaaaaacataacacagatgaacacgtaatttcatgaaagaaaagaaaaaagcctataaatgaattaatgttagcctattgcttttctttcctagtcactttgatttgattgcagggtacaatatcagatgtgactaacatttttttccccatcaacttataccttaagaaacacaaacacacacgtggcatgtgttctctaccctttcagaaataatgttgcaccttcctagaaccaatggtgcattccagttatttgttgtaatgaaatttaccaaatataacacaaataacatttcccattatgattcccaagatcatatgaaaaaatagagcctttcgggcatagtaagccaatgaatgtattctactctaccccagaaggaaatggaattatgcaacataaacatttctttcttcccgtatgacttttattttaaccttcttccctcgaagcttaagtggcatttttaaagagatttttgctgggttaacttttatttagatggtggtgatgttggaaattagaagaagtgtttcttctcattttaacaccctcggcttaagcattttttgttctttcttttgttattaagaagtgttcagtgactcaacgtttacttacatgattatgatactgggggtcagaagaaatttgagaagttgaagcataaatgactagttggtggcaagacaggtttcccttctccacttcccactcacaatgcgataacattcaggcatcccctttgttgtaggcaggagttcttacatgaacgagaaccaaaatattgaatgccttacatggagctgctccttccagaaaatttgttataaccactctaacacatctctctgcatctggccactcatggaaacatgacaatggctttggtatgaagactgtatctttaacacagaatttggttttaagggatcttacctatgccgcgtagatggaattgttctgcccagggagtgtagaagtcttttcttagtgaactgtgaaattggagggcagatattctatccttactcttgctgcctggtgagatggatcaacagcatctgggctttctgatctatgtcaatctcaagttcctattaaacagagagaagagagtgcactggtgggaagggagactgaagactgcagaaatggcctcaaccaaattaataactagtttttcaagcaaattagtttattctctttctttattggcagggtatgtaatgtgctactgtttttgacccgaggccaggtctctctcatgactgatcacaattcttaggagatgcatccactttaaatttaccttttcttgtatttttctcttttaggtagctatagatttcactgcctcaaacggggaccccaggaacagctgttccttgcactacatccacccttaccaacccaatgagtatctgaaagctttggtagctgtgggggagatttgccaagactatgacaggtaagaggcttcaggacatttggagccttatcatctctcatgtgggttcagacggtctttggctgatcctgggcagaaagtggaaattaagtctagtagctccttatgtagtgacttcaaaagtttcattccctctgtactagaaaaactaagtttgtaccttgctcacgctggtcaccaaacaaatcctttctcagccttcttctctcaattgacttgcaagacgattggatagcaattttggtttccattttgtgaagtcttagcctgtgccttgctactcaaaattgcttatgcactagcagcattcttaacctactgaatttgaatctgcatttaacaagatccccagatgatttgtgtatactttagagtcgtagaagcacaggtctattagacattattacatctgatcctcacattaacccttatatagtatgtattccttaaaagaagggaatactgtacaggaggttaagtaatttgtacactatcacgtagccagaggcaggacttgagcccaggtctacccactccacagcttagcctgtaatcactatgcttcactgacctcaaaagctattggtaacttcagcagagggtgtggcacatgtatgtagccaggtgcatgtgtatgtttgcatgtatgtatatagaaaacatgattttaagatcaaatcaatgttctatttattcttacttgatgataaatattggcctttcctaccaagaaaattccctgtaaggagtatcttgcataaattacgttaaactgaatgtattctgcctttccagtagttttagaatgaagtaaaggaatttaggtgcatgcataaggaaagctttttgaaatgaaaccaatgtaaatataaatatgtgtaaatctcagttaactccctggtgtgattgtaaaccaaggctagttagtaatgagcagcaacaaattgacctttcaaaccaggaaaataaagaaagtaactccatcctttaggtttcagaggaattttgtaagacagcatgatttctgttctttctagtgtcataattggtgataatcatactaaaaacctgttatcctccacaccatgggaactgacacattttaaggactagaatgtacagggaaactaataggacagggcaatgggaaaggtgcagtcaatctcctgcctgcctgtgtctctggattcagcttggtcatcaccagtaactcaaatgtagtacaaagccagttggggaatgaatgagcaggtccagtaaaatcaaagagctttaaacactcaggcccttgctgataattcctctcctgtacatccaggaaaaaagtcaatagttattttaaattatctttttggaaaaacacctcttatacttaatcttgaggtattgactatgaagataacttgaatttcaacactgatttcttcaagccccaatgcaggcagtgggtgagggggttcctagagaggtttatatcatatgaagatttccaccagggagagaaaagactggccaattgcatccactacattggaaacttctccaaacgtccccaagacacaaaaacaagaattttcttccttctttataccacacacacagatgcatacacacattagtaatctagtaaaataatgtgtgcacatattgagagacaagaagggggagagtatcttcaggattctcaagttttcaatcttgaaatgcttgcaaaagataaagtaggtaaatgcacttaacacaaatgtcaaacagtagatgcttaattaaaaagttaactctgaatctgcggggaagaaagcagtctcataataaattacaaacagaagactgatgggttttctagaaatgaagatagtaagcctcagagccctcattatagttctgcagcagatttagtggatgatctggaagaagctgctgaacgtctccatttcctgatcgcctcacatgcaaaatgcagagactatagtcagagtggcatgtatatcttgtaaagcttttatccctttgtgagccagacaaagtctggggagcattttttgttccctcaaaaatgcagattcaatataaaaataagatataagatatgaaaccttaagagttacatgaagaatcatcataagtgattgttttaaaatttttaatagagtaagattgaccccaactgaccaagaaaatcaaatttctacagctcagtggagcaattcttttttccatataaagaaagcagctcaacattaaaatgggcaaatacttaaggaagaagaaggaggattgaaaaactccaatgctccttttaaaaagctccctagaagaatgtgtattgcaagctgctcacttgaaaactgacaaggttccgctgtttctcttttgtgtgggtggatagacaatagacaggcagagtcaggaaatttcaagtcggggctctggaattaatttattctcacatcaaagtcagtgtggttggggctcaaaatgaaacacttgaataaaaactgacagaaggcattgttccccctcctgcagtgacacagaggtttctaatccccatgagccttagaaattcctcccagcctctggcagccaagagttttctttttgccttgtacagtcattgctaccaggtcattatgaggtgatccatgaggtagaacagcttgagagatgcataaaactcttttcaggatggccttgaaggaaagcttcccacagacagcttgtcctcaagcctgcctgcctgttctgtccttcagcctctgaaagagatggtgctgctcatttcctctgcctttgaccacccaccccagcacaactacttgtacacacacacaaaaacacacacgcatgtatgtgcgcacacacacacacacacacaggcccacacaagctcaagttgtagcacttctccagctcctgtatcctggtctccctagtctgctcaaagccaaggtgacatcttttccttggggccagtagggatatgggtctctgaaaacctgaaatgttctctaataaaaagcatggtctgtctgctatcaagacagtacagaaactgaatgtgtacatttcctggaaatatggattgccattttatggaagtgtctatcacagaatgagacagatatcagaaaccaaggcagcatttctccatgatgtactagttatggtatgagaagacaaagttagaactgaaacccaatctgacaggtattttcaagtgtagagcagttgcttagtgatgagaagacagttcaaatcacgtgctaccttgtccactctacaccagtcagtggtcctcagccttggctgtacattgaagccattcgaaaagccttaaaatgtgacgatacctgcaccccaccccagaatctctgatttaactctctggtgtgcatcctggaaattagaattctttatcctgctaggtatccagggttgagacccagtgttaaatcatgagagatggctcagatgcaatggctaaggtcctatgcagcatctatttaagccccaaacacctcacgggaagctgtaaagacagaaaaattaatgaagcacaatttttccccaagtagcccacaatctcactgggcagaaacacgtgtaaataaattacagcccagcatggccggggaagtgttgccctgtgtcgggatgggaactgtataaaagagggaagggctaactctgtcctttgtgggaagaggggtggtcaaggagggagtcctggggatgataatttctgggctgatcagaatttggccttcagctttgttgttattagaatgtggatggatttgttctcctttttctgaatcattagaccagacaagccttctatgaggacagaatcaacagggatgatagagagagcatggggaactggtgacagttagacccgggctcaaaccccagctctgctacctctgttgtcataagatttgcattctatgggccttggttttcttcattgtaaattgaagatgtatcgcttcccttgcagagcagttataaggattagatataaagcagctggctaacacaggttctacctttataaatactcaataaatgtcagaggtgattatctttaataccctagatttatgtttcaaaaatgatctgaacacaaagggagacagaactattgtgtcagttctaaagttcactttggaccaatgatctttaaaatgtttttgctcatgtacttttaaaaaaaatattaaaatgtatagctgtcacattttttcactgaaatctgacatttttcatcatgagtttatatagtgataaagaatgaaaattctaatgtgttgtaagtttggacattttataataaaactcttacataactcttgtgactgagtcaagtggaatctaaatgccgtaactatttgatatccaccatcatccattttgtaaaaaatgagcaagctcttcaatgtgagttgagaattgtaattgtttcttccttttcatcgacttatatttccattctcttccctccaaaattttatcctaatgtatcttaataaaattggtttgaaattctgttataatcactgtatatttctgtaataaaattataaatttaaaactttttagtttctaaaaatttctaagatgaaaagattcaaagtattttttaaaatctgagcttttattacaattattactagtgcataattgatcaaaagaacataaatgtactagaaatttcagtgtaatttttgcctataaaaacctatcagaaatcagctcttactgaaacagataatggggtgtttttccaatttgtttatagacctgtggatgagtgctacctattactagaatgggagagtcaagcatcaattctaactcagttttttgctcttatcatcaatgtaaatactaagaaaacctgttcttataaataagtgtatggaaataaataacttgtctagcagtattactcaattctttcaagtttaagttatataccaaaaaaaattacataatggccaatcatcaaaacgttttcttcaatgaactaccagctgacatcagcacctgccaaaatttatttaaagcaaaacttggcaactacctgacttgcaaaaggattttttcccctagtgaatcattcatgtttagaattattcttcttgtatatgatgctacagagttttcacactctggagcaatggactatgatggttaagattcagaataggtaaaagagaaggatacgtgaaagggaaggtatgaatggagaacaggtctctccatcacaggcattcccagaatatcaatttcagcaaaaaacacatatggatgtagaggaactgaatactgatttccctttaaaaaaaaaagccatgtcctcatatccccagaaatgctttgcatttccaggtaccccagttttaagacctctgcttcagagaacagtttttattaaatgtctaggtgccctgagatgccatattgctgtgagcttcatttccttatggatacagtaatttttctttacgtttattaatgttttgatttatctcaaaatcttcaacagaaaggagaaaatggtgattaaaaataaatcttccatctggaggtcatttgacaatagtcattccctaagaaggtcaggacagcttactcattaccattgaagcacgtagggtttttttttattgtattttatactattttattctggttataagaaagattgcctttacccatgtggtaatatacccctcaattttccagattgtctgtctttgtcagtcattttcccagcagttgctaaatggccctttgctgggtgctgagtggatccaatcttgaattcttaaagcgttagtatacagatgctttcttttgtgttcaacttgctttcttttacttcttgcataataagactcttctctgcctagttttattttaaaacagaaataatggatgtttaaatccattgtgcttaggcttaaaactttttctttagtgtgtttattagttagaggctttctggtggctaagttcagagaatttatccctcctggctcattaattattccccttgtaggtgaggcattttccctaccttcctactcttgaaactcgattacatagcagtgcatcatgctcagcaaacattgaatccccaaaagtggcttagaaagtataaaaggaatatcattaacgctagaacaccatagggattagaaatggatggaatgttagagcttacccctcctcaactcatcaaaaaaagaaaataagggtgtggagactcccagtttctctattttgacttctgggtcatcctcgagtgtgaaggaccaggatccatcctccacccagaaaagccttacttcaggcttaactagaaagtaccctaaaatcccccgcacagatctcttctcacacctacccatgcttgttttgtttaaggaggaattgctgaggcaaagtatttcagtatgtccaaggacccagaagtatattttctcctatctatagctaatccttcataagctgttgtgagtctctatttacccacattaataccttatctaatacctgctagatgcaatgcaccacaaagcctggattgacccaacagtgaggagaagtgggagttggtgattttctggagaatttagacttcgatttcaaagaattccagcttccttgtatctcccagcccctaaccccaaatttgatacaattggctatgttttggtaaagttttgtcaaaaccatcattggctagtaatgagctcttaatcagtcaggtggtgataaaggagaatctagctttgctactttgacttttctgtcagcctggggattagtggggctcatccctttttccttatagatgtttaggacagtgagccctaacctgaattgactgaatataccaagaacagtgaaatgtaggaattgttccaaagaacaaatctcagttaatttcttaatgggagaagaaataaaaggtagatgacatgagaaggacacgtccttgccaagagccctatggcgacagccacccgacagcacaactattcgattaaagagggtcttatttgttgtctaggcagggggccagattactggaagtactagcagaaaatcacatttaatactacatataatcattaaattataatggtataacagaaaggtatgggctttggaatcacacaattctccttggtaatcaccataggccacttagcctttctgaggctctatttacctgtaaaatggaaataataagtaggtgaagcttccaggattgtgtgagaatttaataaatagatacatcatctagcagggggctggtacattgtatgcatcaataaatgttaattattctcttccccatcctgtcaactatagtacagtaaagttagagttaagatccaatatatgtgaatgcataattaagagagaaactccagtgtgcataagataactcaaaccaaaggatatgtaagtgattctctcaggttttcacaagaatcctcccttcttttcatagccacattttaataattaaaattcatggattatgtactcattaactactgagcacacattccatgacaagttctataataaatggtggggcagggggcagttgaggcagaagacagtagagatataaagattttaataccaaagacagggtctctttgagttcaaaaaacaagaaaagacatgtaaacaacttatcaccgcttgtatgtgataaggtggtgggcacaatgagtcatgtagagggaaccaagctctgtcaaattagccaaacttacaagctttccactgcttgttttttgcttttgagatagagtcttggtctattacccaggctggagtgcaatggtgcattcttagctcactgcagcctccacctccagggttcaagcaattctcttatgcctcagcctcctgagtagctgggattacaggagtgcaccaccatgcccagctaatttttgtatttttagtagagatggggtttctccatgttggccagactggtcttgaactcctggcctcaagtgatctacccacctcggcctcccaaagttctgggattacaggagtgagccactgcacctggccccattgctttttaatatccatttcgattcagtcttatctgtatttgaactctagctctaattagtggcatgatcttgggcaagtcactttacctctcaaggcatttccccacctgcagaaggggaataactatctctccttgtattttaaaagatgatacatacaaaaggttctaacacagtcaaccattacagttacctagttcatggtcacttttcaaaggaaacaaagttgaaagttgaagtggaggccattgatgaaagggtagggccattttatttcttagtatagaatctagcaaaaaaattaagggaggaagttgtagactaatgactgtaatgaacttaaggggctgtttcttgattttaattatccatgctattgctacccccatcaccacagacaatcaagaagcatgagtcagcactggcatagcaacatggcctagcaacctagtaatgtaggttaatgtttttctttctcattaaatgaataaatgaagcaacttcttgttttttcttttcttcattttggtttcagtgacaaaatgttccctgcctttgggtttggcgccaggatacctccagagtacacggtgagtgagtggagatgtgatcttcttccacttcactgtggtcaaaggataacttggctcttctttgcagcagtctcacactcctgactctgacctaactgtgtcagtagggcctacagagtcagaaattgtcttcagaatcagtgagattaactcgccagggcccgtctcttgatgaaaccctatctcctggtattttggatgggtcttctcagaggtccagatgaagagtttcattgtttagtttcttataaatgtggtcagagtctgagaaaacactcaagaagttgatctccaggggctcagaacctattcactcgtatatcccctaggaaatagaattctattggcaatgccaactgggaaagtccgtgacaatggagtctacagactttcttatcccaagtctccgagtccaagtcttgtatgggagacacagagaagttttgaagaaagaactattatgacttagagaattgggaagctgaaatgttcttctgaagacgttggaatcctatttggttttgataatgatttctcatgacagaaaaaaggcaaagattgtgtgtagataaatttgcactgtaatgaggctgagacactactgtgatattctagatgctcctgtagaacattctccacagagaactcgtgcccactaggtggacagggccttggagagacagcagggtacctctcccagcctccaccttaccagtgcctctgaggtctgagctaagtacaaacaacactgcccaatcctcaatttctcttttactggctgtgtctgagccacaggtgaggaggtagatgctgacatttgctccctcactagagccatcatataaagggctttccccttaggtatcctttttgaaagaggaaatcaatatccctgttgctcctagagtgaatagtggatggaatcgcttgtctccctgacctgttctccttctttcttgccttgtattccacactggcctttctgctgggcatagctacataattctagaagcatttattagaaatacagcttgtggagagaaagaatatagaacaagagttatcaactggtggcctatagacattattcaggccacaaatatgttatatttgacacacttttaaaaaacgaattcagcaattgcatatataaaatgtcagatttctggtttctcttgaaaacctgaaaggcctggcaacactaagattaaaagatgaccgatacaagaataagctggagctgaggagatataggccccttcaaatcgggaatgtaaacaggtgaatgcccactttcttcatagagctgctgaatagctcaatagccatcagcccaactacccagggattcttgagttttcaccacatccccaccaggtggtcttccagcctcaggttggcccaacagggctgaggacagagctatgcaccatacctttttctcactaatgacatctttttggttcccttcctggagtaactaatctttcttgctgttttctgaagtcctcttgttcacttgatcccctaactccatccttcctgtcagcaaaatcccctggttattcttgtttcaataggcatctctcacatttccccatttctggtcccctaatttctcccattcctcagacaagcactgatgatttgagcagctcaggtgcccccaggagagtttacaaggttgccacaatttacttcttaggacaaaatctgaaagtatgcattgaaactgaaacacaagcacctctctttcttagttagcactttctcagaaacagatcttgagacaagggtttggatgcaaatagtttatttaaaaggtgagggaaaccacaatagaggttgggaagtggaagtcagcacagagtatattatcaagtcagttaccgctgttggcaactggtgcttaactctgctgaagaaccctaggagacaatatacagcacacatggaccccaagggataagggagctgggatatgtatacatcacctcctgttaattactgattactcccaagggtcacttttagcctgtcacttgggcaagcaaggcaggccctggaggccaagaaaaaacttaaggtaaacaaagcaaataagatgactgaagtcagctggcttacctggaagtgctaagagcaagggactaggataagcactgagagcatcaccgatcacctcccactaagaaaacaggtgtcttttaacacagtgacctaatttatggatacccaaaagagtcagagcttggaaatatcctttgaaatgaaattctccataaaataccaaatgattcaataaaaatgtccagatgccagaacatctatcttgttttatcaggttttcggaaagaaaaaagtaaacaatatgttatttgaccttgtgcataggttctgccaggtagaggaatttgtgttgaaatattacaaagtatattactttactatgtttccaaaagtagagtgcagtctgttttacctgtaggtatgtgaaaatcctcctgccctgtagttctgcatatcatgttaatgattcttaagtgtcaactgcttagctgaagcttttataaccatcgctatcttcagcagacagcttgggttattgagtttttttgtttttatttttgttttaatcactgggtccaaatagagctcagccaaatctaagcctccagtctgtggccagttctaactagcagctattcaaagtgatctttctgaaatcttttcttggatttttttataagccttattctcccctcctgacagcatttatctgattctagaaaatattcctgtcacctcaactccacagggagcttagaattcaccctccatctcatattgattgtgtaaaggcttgaaatggttcctgctgcttaacacataatgaatataatgggcatttgtttgcaaactctaaaccccagtgccttcttactggattaaagttgtaattcttctttcttcctgttttttaaattttaatcggtgtctaggtctctcatgactttgcaatcaactttaatgaagacaacccagaatgtgcaggtaaagcacaacgtgaaagaaagccagtgtcacagtccttccctttgcagctttcccattttagttcatctctgctggtgtagcatattagttacgattgtccacagaatctctgctttctgtatcaacataaaccatgctactccacaggcaagagaaagccatgataacagagcaggaaaataagaactggaaaagacagaatgcagaagaggtggtcttgagtgtatggcaataatgttgatcccagtctgggattccttgggccataataataataataataataaatgaaacttcacctggtaggcagtgatacaatatccctctttctgttttccaaattttcatcaagtgtttttttttttttttttcacaacttcatctctgtgccgatataaggagaggggggaacatggaaatcatttcccactttcggcatatcggccaaggacatggcctcagcgagtttgaacaagcagcatcatggctttgtgccagagaaagcctgctcaaaggttctggttcatgttccattgtttccagccagaattctctgacatgatttcacaaaataatgatattgaaactatgataataattattataataaattttgttctagaatgattttttctgttttctaacagagccaagtacctatgttgctatgaagatcataagacatttttgcattagaaatgtccatatctctctcttcttgtcaaggaggaaggaggctaaatcaggattaattcagatccagtagagtgtgtaaggcatctagcagttaatggccaagaatatgatatcaataccattgagtctgaacacagtaacctccaagacccaatctccattctgccattttttccactaatgtattcttcatcctcagtttattatggattagactttcctcatccccaaccacccccattctgcaactgtaagagtggtttcccccacagcagaatgaaatataaaccctggtattcacctgttttatactcttagaattcatctgcctgatacttttcaagaggaaatcaaacttgcttatcttaggcaaaagctcaagaaccaaaaaaacataaggagcttctattcagcatcacttaacttcagaaccagactgcaaaatgacttggcatctgtctttagaatgataggctttggggcagggccaagtgggtgcaggattgccaatgaggttgggagcatgtatgtaagggcagaacagaacagaacttgctcatctaaaatacccaagagctattttgcagtgcatggtggttatggagaataatctcaggagggaattgtgtggatccctctggccaaaaacaggactaatgtgctatttcagaatagaaagggatagaaggataagctgaataggggaaggcaagcaataacacaggcacagacaacaagagaagccatttgaataaaaatcatttgtaatgagattattgctgtgggatcagaatgataacatgaaatgtacagtcaagatgtatcaagtactaggagaagctgtatagataggactgcctctcctggcagagtcccatccttttctatttcctgggctcatatggcctcaggatggaagcccccttttaaatgaggggttgtccgtgatgataaccatcacttatctgtactcagtgcccaggagatgagtatatcagccactttgctcattcatcacacacttggtgagcattacatttgctcgatactgcctcaagctctttggggaaatacaaaaaataagtaagtcatgattcctgcccgcagagtataacatctggagagatggtcatgggaactcctgactcttatagagggcacgggtagtatctactagagtcaacaagatcgtgtggaaacaagtgcaacattgaagctagcttgctagtggctaagaacacagtgcttagagccaggcagacccaagtttaaatcctgagtcttgaacacacttgctatgtgacccagggcagatcattgaacatctctaagcctctgtttcttcacctataaaatgggtataacatctatttcattatgctatgaggagcgaatgaaatcttatatataaagtaggatattagggaaaattttgtggaaatcgttgcttttgactttagcttttaaagaggagaatgatttcagtggggaaggagacagcaacactagcaatgtggtattcctttttatcttaagaacataaacatgatgttgataaggactatttgggatatttaatgctttacttttgtgtgtgtttggctataaatatatttggagtgactctggagctgttgatctttgccaatttcacctcaggaattcaaggagttgtggaagcctatcagagctgtcttcctaagctccaactctacggtcccaccaacattgcccccatcatccagaaggttgccaagtcagcgtcagaggaaactaacaccaaggaggcatcggtaaggagggggctatttgcctcctaaggggagcttactcttcctcacctggatattggccgtaagacccatctcactctaacaataaattccaacacttctccctgtgtgaatttggacaaatgacttaacctcctcctatcctcagtcttgacatctgaaacatggggataatcaaacccatctttgctgggttgtgaggctaagagatgacacatgtcaaatgtctaccacattgtctgaacacaggagaaactcaacaatggaagctactatattcactaaagtatgtcatatccacctcctgtccttgaaaagaaaaaagaaaggtttaaaaataagcttgctttttaaggtacccatactacagatggaagcaaagcaccatggaagtaaaacaatggatgattctgcctcctggtggtaaagcgcagcagcacaaaacatcacagcaaaaattggtttcatattctattgcttttcttaagaaaaatgcaaaccaagaccagagtttgagttttgcccctaatattttagaagtaaatatattaccacaataacttctgtatttattttaataacattaatacatgtctttttagctttatgattttttccagatttagtggaatattaccaatgtctgaagtttgctctgtaattttatcctgggtactgagtttttatttaaaaaaatactactcccttatcttcttacatcaattcatctaaccttcttgcactgtcttcatgttctcagccttccttcatgttagaatggatggaggaccatgctcctacctcatgtcaacatcttcttttgtgtacttgagcacatctctgaattatccaggaactttgactctgcagttatattctcgctctttctcctatcatctattgttttcttttctacttccctttgtactgaagactcattcccattaacaagtactcattcaataatatctcctgctttaagttaatatctcccccttgactctgctttgccctttagctactgtccttaactttttcccacttataatctgcactccatgcagaaaccagattgatcttttaaaaatataattagtattgcagcattcctttgttctaaattctctaatacttctcatcatacttggagtaaaatctaaattccctgatatggcttagaagacattataggatctaatctctgcctacctctctgatcttaattcttatcattttctctttcgctccctatatttcagccacactgaccttcttgctgttccacaaacacaccaaatatattcccaccttgaggccttttcacttactgttcccctgccagggtttctctcacccaaacctccatatgatccattctctgactgtgttaacatctcttctcaactctcaacccctctgaaagttccccctggctaccttatctaaaatagccaacccacccacccgcaccatgtctcagctttacttttcttcttagtacccatcatcatctgaaatattttaggtgcatctactaacctgtatattttatgtctctctactttcatatggaagctctacaataagacttgttcactagtatatccctagtacacaaaacaatgcctgcacacagtacatgcttaataaatactacttaaagaacgcatataaagccactctacttttcatatatatatataatgaaaagtactttacattttcttttgtaaaactggtgtgtatcttaaatattgcacatcttgtacgccagaaaatacagtgttcctgttttcattataatttgaagtctctcctacttaaaaagatccaaattcccaaggtccctagagagaacaacagtcactgcatgtctttggttcagtccactggcccttccatacatctcattatcatcttcagctactctgggcttgggtcattgagtgacatgagcaattcctacaagggaataggaagtttgaagcaaaattttgttttagactcataatttttccatgtccttttattaacatagttgaccacagtttcaatctgctacacaacatccatcaggtgacccatagctatccataagaaacaaatgggtctgatctgtggggcatgttctctcatctcctctgttcattacatcatgttcttgaaatcactaaccggtggtttgactatgaaaaggactggagaccctggggagctaagtgtgtgttacttcaaataattactttagaatagtgaatatataaaactgtggatatattagcctttatgctgggcagagacactctgtaagctgagatcttgtccagcagtaatgctgaggatttaatccaagccaagtcttttccaggtgtgaaagctaagaaaatcatgactcctctctgctcatttttcctcttcttttcagaagccatgaacactattaggttttttttttttttttttttttttttttttttttttttttttttttggaaaagggttttggtttttcccccaacctaaagggggggggcacaaaaaggggtcactacagttttaaacctttgggggtgaaaaatttctttggccccaccctcccaaaaagttgggaccaaagggttgggcccccccccccagttaatttttattttttttgaaaagggggggttttgtttttttgcccaggctggtttaaaactccggggctaaaaaaatcctctttttttacccccccaacgttttggggttataggcatgacccaatgcttttggttaaccaccaacacttttaaggattataaaccaacatttcccccagggggggggccctgaaaaggcttccccaaatgcatttttttttgaccacaaagggtttggagcaaatttgacccttcttaaatccaaaatttaggaataagggtgggatgggaccatttttttattttattttttaaccttttttaaacaccaaaaccaatttttaaaatgataacttgcttaaaaactcccatttaaaatagacttaaaaaaacacttttcttgccaaatttggtctaagnnnnnnnnnnnnnnnnnnnnggtcttggtctatcacccaagctgaagtgtagtggcacaatcatggctcactacagctttgaaccttttgggctgaagcattcctctggccccagcctcccaaatagctgggaccaaaggcatgtgccaccacgcccagctaatttttatattttttgtagaggtggggtcttgctatgttgcccaggctggtctcaaactcctgggctcaaacaatcctccttctttagcctcccaacgttctggggttataggcatgagccaatgcatctggctaaccaccaacacttctcaggattatagaccaacatttccaccagtgcgtgggccctgcaaaggcttccccaaatgcatctctttctgaccacagaggtcttggagcaaatttgaaccttcatagatgcaagatttaggaataaggtttggatgtgaccattattttattttattttttaaccttttttcagcaccagaaccaattcttcaaatgataacttgcttagaaactcaacatataaaatagacttaaaaaatacactattcttgccaaatttggtctaaggagtagagtcagaaacttgtccattctctttagctcccttatcctcaagagcatccaaggcatccctaagggctccctggggcccagtttaaaaattggatgatctcatcccctctggggtaccaggactcacatggctaaaaagagaacagaactaacaaaggtctggatttcaggctgatatagaacagcatgagtttttggccatcactcactccctcagggatagctgggtctgcaatgaaaggacaggtcattaaatgggactacaagtaagaagcatccaacccacacatctccatataaattacccctatagaccaagaacataagcttttccccagaggtttctcctgttctttgaaaagtctgtggtccagagtcccttgttatctctaagggtcataaacttgaacatctttggcaagctgtgccagggagtctgttgctataggattttccccttgattttgtggaactcttccaggtaaaaaatgcccctctttatctaaacaggacctcaagtatattcaaagactataatatttcatccatgagcattttcccagtctgactttagaaggaactgttattgtttgctttattggaaatttctatcaggtttcgatcctgcagtctacagcctagtgcctttagctagatgaaacctggcaggatcagattccagaatcctgacaatctcttcagaccaggagttcttaaacttattgttccacaaacccctttagcagctgataaagttcatagatcccttctcagaagtggttttttgtgtttttttgtgtgtgtggttttttgtgttttgttttgtttgagatggagtcttgctctgttgccaggctggagtgcagtggcagctcactgcaacctctgactccctagttcaaatgattctcctgccttagcctcccgagtagctgggattacaggcacgtgccaccacgcccagccaatttttgtatttttagtagagacagggtttcaccatgttggccaagatggtcttgatctcctgacctcatgatccgcccacctaggccttccaaagtgctaggattacaggcgtgagccactgcacccagccagaagtatttttaaatgtacaacataagacccatattataaagtaaaccaattatattgaaatgcagttagcaaaatattttttaaaaggaagatggagacatcataaatacagtaataaaatgcttctgtatttacattttaaattatgagaaccagtagtttgtctaataattctgtaatttctaagttgtgttaaacataaataatacattgaaatatatgtaggtactgtaatataacaggaaaatatgtgtttttttattaataactaagccacaagtagaactaatattaatttgatttgttgattacacttatagtgaaaaaatgataaattttacttagagattagtgaaaataaaaatgtaatttaccccaagtttacagactgccttaaatcttgcagtagtccatggagacaggttaagaacccctagtttagatcagcagtcaataaactataactaaactaaactgtttttcaatggcttgcaagctgagaatggtttttagattttttaattgttgaaaaaatcaaaagtagaataatatttgtattttgtgacatatgaagattttgtgacattaaaaatcagtgtccataaataaaatattattggaacacagcctctcatattcattttaaatattgtctatggctgttttcacactacagtggcagtgttaggtagttgtgacagagaccattatggtctacaaagcctaaaatacttattaatgtcccttgacaaaaaatagtttcctgacctctgctgtagaacattacgactctaaagtttctcaatgtggtagtatgactatcaggttgttttatttcttaaggcatttatcaggtaggggagattcatccactgaactctaagatcagatcagacaggagttaggggaaggtagaggataaaggtaggagacacagaagtgtgattcactcgagggcccacctgctcatgaatcagaagtaatctctttttggatgtgccacctgccctggtcttccaggtgcactctagagagggtgacttatgattctggtatgtcctatactccttccctccatccccaaaccaccaacattgcctctttctgccgcttctctctgcacctccctaccacctccatcacttcatcctactgaaagccttctctaaactctcaagccaacttccttgtgaacatatacaactcagaaaatacagacatagaaggaaacatacaacttgaatgaatctgaaaaccaaactgggaattcagctaggactaggggtgagtggttagttaatggacatggaacagaattagcctttacattagactgtatgaaaagcattcagaacatgtggctatcttcatcacagtgtgaagttcacctacctccagcttacatttttcatttaaaacattttttcaggctcacagaaaaaaaatgaaattctttagtactaccaaactatttgcaacattaagtatatgattctcaaaatcagatgttttcaaaatgtcactcttctatccaatctttctcctttgaagtatggtaacgtggaatggcttaatctcactcttactacctataaatgttaggcatcttgcaggattatattgaaagttcttttctgtttagcctgagctgcatctgactaatctgcttctctttcctcttaccagtaaaggccatcatgatgcctctcatgttgactaaaaataatgatgacctccaatgggtcatccttctccaggccccagagcactttccaaggcttccctgtgctgctgagtacagcacctttcctccaattcccatctctgctgagtcatcttccagctttccagatggaaaggggccaggcaggctgcaggccagaagtcaggacttaaagcaggaagccatgggagcactgcaaccttctgcaagtgtgcctggagaagagctgccacctttgtggcacatggccttcagagggagagactgcaaccctgaccctcttatagcaggactttagactagtgccatccagtggaaatataacacaagttatgtatacagttttaaattcttcagtaactgtattttaaaaagtaaaaagaaacagagaaatccattttaattatatattttatttaaaccaacatagccaacatattgtcattttagcatgtactccatataaaaaaattattaatgaaataatttgcattctattttgtataataagtcttcaaaatccacatgtattttatacttacagcatgtcaatttggatgctaagttatcataaatacttgatctttgtttagattttatagttacagcttaattttaataactacctcactgacagttacaaagaaagaaaaagtagattaatctactgaagttgttccaaacatacttaaaatgtttctaataactgaattggctatccaattttaatgttaaatttaaattcattacaattaaataaaatataaaattcagttcgtcacttgctctagccacatttcaagggctgagtagtctcatggggttagtcatcattgtattggatgtcatagctttagatttttaaatatcttcaagtaaagaagatcatataaattattgggtcccacccctcatttgagaaatgaagaagctcagacacagacgagttaagggatcgtcccagggtctcacagaatgaggctttgaagcctgtcctcctaactcttggcctgctgctctttctttgtaactgtcagtgaggtagttattataattaagctataattgccatgcctacctttaagctccattcatcagaaccctaagcctttaggactatcagcacattcaaaaaatgtctgtcatcactgttgctttggtcaatgtgcagtgaggccacctgggtgtctaactggtattgtattgtccttgtctccctcacctcttcaccccccccatcatcatggggcatctgactgcagcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgtatgcatatacacattggggcacttttcatggaagagcagaaccaaagcatgctcacctcccacatttgtccaccaatgtttatggtgatccaccattcttgaagcaacaccagctatgctctacatacccttgctgtgggagatgacctggcttagctatcccttcctgggccacgtcatctcccacaacaaggatatatagagcatgactctttggagaaaaaaattataaattgagttacagatcaggagccatgctaactattgtaggcaaaatttcactgatgcttgccctataattcatataatttaggatctctagtgcatctaggactgcctacagatgggcagcttgttccctgcctaaaggtgcctgcccaaagtaccaagcagaaactgaaatgcagcttatgttttgcttgtcaagctatgtggcctggcagaagtctgtgtttgccttggcaaagtatatttccaaaatgatagaaacctaaatcctctataaaaaatatagtaagcagcatcaaaaatttatttaactccttcaaaacaagatgataaagttagttcaaaagagtatataaggctgggtgcagtggctcacccctgtaatcccagcagtttgggaggccaaggtgggtgtatcgcctgaggtcaggagtttgagaccagcctgaccaacatggtaaaactccatctctactaaaaatacaaaaattagctgggcgtggtggcaggcgcctgtaatcccagctactcgggaggctgaggcaggagaatcacttgaatcagggaggtggaggttgcagtgagccgagatcacaccactgcactccagcctgggtgatgagagtgagagttggtttcaaaaaaagtaaataaataagacagttaaagtcagtgggaaaaaatgctgaataagtttgctaaggtagattgaaaactgattaatgaccaagagggtaaaaaaaaaaaaaaaaagtaatctttgaattgccctctctgtgggccagaaatcgcctgctatcagttttctataaattaatacctaactttacagtcttgggctcttaccagtaagaaatagtaagtcagtcaagcagcattgcattccccaagggccttgaggcagaaccattagacaatgctctagtatgacatagaaaaaatgctcagtaacaattttcccaccttcccaggttttgatacattgtgtccatggaggaaggagcattttttaaatttccacaaatccctgcacctactgagctgtaatcacccagaaggacatcttgaattcataaaagcctcccttggggctaatggtagtcctgaagacccctctagagtatcctagctgtgtctaggcacctgtgggggtaacttgggtattactggatagcctttgtgttttttgttttgtgcttcttgtgaaagccacccaagaggagagcatatgcccagcccctactttccactgaggccttgccctctgcactgctgcagatgccaacaataccatccccagggctggtgactaaacttgagctgccctggcaacagggaatcttcagaaccttcagtaccgtgaagcttatctgtggtctccttggaaaagaagagaatcctctcctttccatgctaccgagtcccctctgtcacctgagtcattaatgcagtgagatgtgtctccacatctcaaagacccctgctggaaagtatcttcattaacttccactgcagtccctccctgcatagggctcaaatcagttatttgggtcaggcaggatgccatcccctccacttcaaccttatttggtaaagcctttctcctccagtcaaaaactcattcaaatgaatccctgacattcttcatactgagtttatcagatatatccagacacatctgactcccaacttgggttcacactggactctcacctatactgtgtaaggaaattgcagatgagaggtggaaagctaaatggatcatcaaaacaatgatccatccatcctcccacccccatacatacttgactgtaatcctggtaccagtcctagtgtgagagcctttagcatatgctcttcagaaattgctgtttgttgtgccactttctttggacaggctttaaaataagaattcagatagatcaccagctcagcagcctcagctgaactctgtatttcatgacctgcccagacttcatagggaagtaactgcacattccaaggctccttggatgatgaggtattgttcataactgtactgccacacaattactactctacttttaaggagggctgcagtgtaattaaaatcactgaaggagcagaaaaccaatccctggctacagagttgatcacagagagagtttctaagtaacagcaacagcagtcaatcttcccacaagctcccagggctgtgcatgtggatgaggggtaattgtgttgttatatgccatcctcaagtttccctaggaagagattttcaaataaaggtactcattaatgaaagagatgcactaagccctaaagttgtctgcctatggacagcaaggagtagagtcaaaaagaagtagtattctttacagacggatgagctagagcaggctaaatttgctgcaattatgttcattaatgaagctagtttctccctaggtgtctaagatggaggaaagggtgttcttcctgattttaatgctgcattcttttcagacagacaaaatagatagacacatcactgaataccagtgataactttgcatagtgcagcaggatcaaagagttcactctctaggagattcattaacttccccaaatcaccctctctcccctctgcatcccccacctccccacttccccacacacacttgtgtgctgacacaatgtcactgaactatgaaaggttctaacctctaccctcaagtctcctcctcttccccaaaacacttacagaatgcttgttctgtgcaaggcacatgctagtcactaggaccacaatgaaatgatagaaccatggatccacacctcaagacatttactggagaattgcatgactgggagaaaggtattagcagaaaaatcacatgctaagcaacctgtgggtggttgagaagaattaaaatgttgttacaggacctcaaagcagagagaggtagccatgggaaaaggcttacagcttaagttaagtgtttgaggaaagacagagccttggagagcagggaattttggggacattgtcaacaagaggaatgctcagggcagagcaaggaagtagggtgctgctcacagtctctgtgctacacagattctctggctgctctgtgaatgaccaaggaagaacaccaggcgcatactcacccatcttatcttcatggatttcaaatcagattttgaaatccatttcattacccaaactaatctactttgaattcaataagccataaataaaagggaaggtagcagcttaaatcattttatgtaagccattaactcatgaattgcctctctttttgtgctgtgcatgataactcagagctttagagcttacagggcacaagttatgttatggtcttttttcctgctcatataacagaatatcatagactggataaagaacagaagtgtatttggctcatggttttggagtctgggaagtccaagagcatagcaccagcacctacaagggtcatctcatggcagaagtatggaaggcacaagcaaacatgtaagacacaaggagaaggaaagcacaaggggcagactctcttttataacaacccactctcatgataactaacctgctcccatgatactgacatcttatgaggccccacttcccaaccctgttgcattgatcattaagttcccagcacattaatttaggagacacactcaaactatcatatgctttaagctttgtgactctgggcaagttatttaacctttccatgccacagactttcatctataaaatgaggtaaatgatacatgcattgcaaagataaggtgttgtctatataaagcttaagatagtgcctggtccatgtaggtggttaataaataaagcttttattactgttattaccagcttcattcatattcttgaccctttcccacccaatacatgtccccaaagccttatttgcttgccagcacagatatgcaaggggatgggggatcctttgggaacaatgctgtccaatatggtagccactaaccacatgtagctacttacgtttaaattcattaagagaaaataaaatttcaaactcagttcctcagtcagacttgccttatttcaaggactcaatagttgcgtgagactaagacctcccatactggacagcacagatatagaatattaccatcatcagaggaagatctatttgacagcctggtttaggaatattttttgctgcaagcaacagtaaatccatcttacagggattacataaatggtttttaaccaagggtaacattatgccccaggaaacattttggaatatctgacatttttgatggtaacaaatatggggcttctattcatatctagtgggtagaggccaaggatgctgctaaacttcctgcagtgcaccggacagtcccccacacaaagaattattcagccccaaatgtcaatagtgtcaagattgagaaaccctggattatacaaatagaacgtatttttctcatgtagctagaagttaggggctcattgctgctggagtcagtgattcaatagtgtcagagccagcacattgtgattccctttgctcttcctacataatgataaaatggttgctatagctccagtaatcacattctatttcaagatagaaaggaagaggaaagggacatagggccaactgtgtccagagcatgttggctgaagtcccaaactaagtcctggactattacaatggcaaagggattaaaccaaaatgttcatcagaaatgtacaagtcttcagggctgggtgcggtggctcacgcctgtaatctcaggactttgagatgctgaggcgggcggatcacctgaggtcaggagttcgagaccagcctggccaatatggtaaaaccccatgtctactaaaaatataaaattagctgggcacggtggtgggcacctgtaatctcaactactctggaggctgaagcaggagaattgcttgaatccgggaagcggaggttacagtgagctgagatcgcaccactgcactccagcctgggtgacagagtgagactccatctcaaaaaaaaaaaaaaaaaacagaaaagaaaaaatgtacaagtcttccagaacactagcaccatgacctccacacacttttacagagttccgaaatactactcctgctaatatttcatatttaatacttttactactcctgtacttaaaaaaatacatacacctttaaaaatagcacattttggtgatttttaattatctgaaattttttttgcatgtgtagccctgagtccagaatctgttaaactcttgtattgttgaagacttttcacaagggaaaagtcttttaacttttaaccaggagagaaaagctttccaaaaaacctcccccaggaaattttcacttatatctcaaaggatggaattgggtcatattgttatccctagatgtaaaggaagctggaaaatcaaggatttgactttctaacctttgtatgagaaacagccagggaggaaagggtataaatgacttttgtatctgccccagtatacacatggaccatggtctaacacacaaccctgagcagttatttataaaataaagggatatctgtagatcacaaatgtccatcatgctatgacatcttcaaaatgtgaaagatcacttgagaaaaactctttacagtgttttcagattgcttaaaagatacatgtctcttattttgagactctgtgagatagagtgaattatttttcttttctcttttgcctctaagaacagcggggcttagtaaagttaaatggccaagtggcaagccacatagaaaagaaaaaactgaaaaccaggtcacatggtattcagtccagccctctttcttttggaatctcaaacacttgttaagtctgcctcaagttttcaatctcttcaataatagttaataatgaggctcaggccattgaaattgcttgcccaggggttgtacagttaatactaaatgccagagccaggagtaaagcccagctctacatgactccagagtccatgtatgatatcagcttcaacctttctctgctacagaatcatcaccataaatcacatggtcctcctgtgcccctaccccaaaatcatgcagtagatccataaggctgatagaataaaggctaaatgaattagtgtggtattcaagactctccatcacctggtctcaagccaattttccaaccaaatgcccaaccaatcctgcaactacccctaaaccccctcgtcccccacctgccatacacacttccttcagctccatcaggtaactcactatgcctatgatggtcaaatgccattcccctaccccttctctatgtattaaaatatgctcagcttaaaagccacctcctcttagaagcctccaagataagttagtctctatgttttttatgccctggcctcactgtttgtgattctctagagaagagcttctcaaattttaatatgcatatgaatcactagagcgtcaagttaaaaggcagattgtgattcagtagctctgagttgggtctgagtctacattgctaataagctcccatgtaatgtgacactgctgctctatagcatgtgtcatattctacctcatagttaatattggccatgcctagttcccctcgtgattacagccttcctgaggcaagaaccatagaccctcaaaccctagtgtggcacctggaacataaataagtgtctaaaattgagtgaaaattagaaataaaactgcagaacaattcattctcccatccaacttttactcgtcttcagatgtaaatagttttatagtttgagacaggcataaaaatatataataatgaaattaaaggtccattttccaacaatctgacaactattgcttgaagtagacccttgacaaataacgaatgaatgaaagtgaatgaaacttagctgcccagagcaggactcaaatcttttaggatgagtctgattccttgaccagaagccaacgtcatgatgatttcttcttccctgcaggcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaaaaacccacatggtttttgcagttgttatctctaattcctccctgctgagaatggtctctctactaaagaagaggtttatttacttcttctttctgaggtgagtctttttgaggtaagtctgggtcatctagcccagcacctctcatactttatactgtgtacacaaatcacctgagagtcttattaaaattcagattgtgatacataggtctgtgtgggacccaagattctgcatctttaactaggtcccaggtgatgctaatgcagtccctggactataccaagaggagtgaggatctagactttagggtgtcatgatggagaccatcaaaaacagcgtggcttctagtctgcttgagaatggcacctcttcctgacagtagcacaaaagtcctgcctgtctccagaggtgacagtagaaagtaatgagactgactccagaagctgcacacctcaaatcagtctcgctgctttatactcacacctcttccttagataagactagaaagtgctcctcctggccagtccctgccctcttaaaagtggcatcacacaccactgcatggatggtgtcaatccctagaagtgatctcaaagcgtcttcactggaaccacaacaatagaaacttacacatggcaaatggctatgcagtacagctcccgatatctggtccactaaattgacctttgagcttagtgtgggaatttcttgcctcctttctatcacttctgagaacaaattctataagcagaaatgcctggaattattgtctggggtcgaggtgttttgtttcaatataagctggccagtctggaaccaaaaggacgaatgtttaacttgtataatcttcttgcagggaaacaggcaagtgtttttgcaagcataaaaggcacaaagtggagtttatttttggtcagagagatgaagaagtaaatcacaaggcaaaatttgttgtttgtttgaagaggggagcagtattaacaagcaaataaaatgccttctatgatttccacagttacaattatagatcctaatcttgcaaatacatgtcaccaaatgcacaacattttgggaatgatggtaaaattgtatgactgaaaaaatcataaatatttaagctatattgttttattaataaattgggtacttacagaattcttctaagagttgtggtcttgtttctcttttcaaggcaatttcctaacaataatttatttcatgtaggcaatgtggccttagagtagaagtagctctttcacagtccaatgaaaacatggatcactgcttctaataaacaagaaattaaaatatttaggtgcaatattacagaaatatctggtgattatatctaaccccaaaccaagacatgaacttacatgtctatatacctggaacacagtaaacactcaacagacatttaataaatacagagatgactaataaaataagtaaatgaatgaatagtcttgttaatatgccttatgatcaatctttaatccactgtagatttcacaggtaggttaagtgtttgtgtctatcaattaaatgatgcaccctgtcattcacaaagatctgttaggatctctacactcatgtcaggattcctggagtctgtgagatggggcagagaggacagagtgcagttggcctggcagaaccttaaagcagtttactttccttttcacagtcagactcaagttcatctcaaaagaacaataaaaataatatctatgaattattgaagggtgtcttagtcaggtcaagttgctataacaaaataccataaactgggtagcttaaacaacagaaatttacttctcacagttctgaagtctggaaagtcaaagatcaaagtacaagtcaatttggctcctggtgagagctcacctctggcttgcagacagccactttcttactatgtcctatcatgatagagagagagctagctttctggtctcttcttataagggcactaatctcatcacaaggatcccaccctcatgacctcatctaagcctaattatcttcaaaagtccccacctcttcataccatcacattgaggggtagggcttcatatatgaattttggagggacactaatattcagttcataacaaaaggttactgtgtgccaggcactgttctaagtgcttgtaatgtactatctcatttaatcctcccaacatcctcgtgagatcggtagtattaatagccttactttgcagatgaggaaactgagacacagagagattaggtagcttgccaggattgcacagctatggaagttcagagccaggatttaaatatggatactctggctcctaaacccaaattcattgtataatccccatttcggctatccttcttgcactatactcattcacttgccatatcaagcagcagattattaggaaatttgagagaaattagccttaaaatatcctttgctcccaaattcagaaagatccgtctcatctgatgatctcagattgttgttttgggcacttggtgtctcgtgatgtacaacatccccccctgaaagcaatagaaaattctcaagccacagccaggtctccccaacttcttgccatcaaggagaccatttaggttggacattacaaatacagatgcttccaagagctgtgcaagccataggaataactaagaaaaaaacaggttttaacagagggacataaagagtaaagtaagaagaatggagggaaactggaacgcgtgtgtccagaagaaggcagctgctacccaggtccaggggccatgcaagaatgtggacctaatgcagccagcccaaccagttttttaagaaaactgaaaaacatggtatttcacataaaacctactgatctataaatattgaaagctcatttaaaattcagtaactgtttaaaaagacgacaagagctggttgggtgcggtggttcacacctgtaatcccagcactttgggaggccgaggcaggcggatcacctgaggtcaggaggtcgagaccagcctggccaacatggtgaaaccccatctctactaaaatacaaaagttagccgggtgtggtggtgcatgcctgtaatcccagctccccagggggctgaggcaggagaaccacttgaacctgaggcagaggttgcagtgagccgagatcgcgctactgcactccagcctgggtgacagggcagggcaagactcagtctaaaaaaaaaaattgcaagaaccaatctgtgcaagtcaaatgaaaactacctctgggcttatgtttgctctgtgtgcaaatttggaaccactgagttatatctgtgtatggcctgctctccactgggtctcaacagataatatacacactttaaaattcttgaagaccctaaagaggctttatttctgtggcttatatttattaacatttgctatattaggaattgaaactggaaatggaatatatttattaatttatttaaatagcaataatagacccattacatgataacataaataaaatactttcataacaaactatactttcaaaaccaaaaaatggtcagtgagaagtgcagcattgctttataatttttcaaatctttagtgccttgtttaataaaagattgccagatccttatatctgcttctgtattcaatgtgttgtgaaatgatgttttggttaaagtacaatgttgaaaacctggcctcacgtggatatgtagttggaaagaggagagctatttttagctatttcaggtaattgtccttctttttaccacatccaaactcaacaagtggtagttttttaaaggttagttgcaatgtagaatatgaaatcatatcaataaaattgtcctagcattttcaatggttcttttacccatgcactattttgtagcatcatgtactgggcattcagaaaatattgatccactcagctatttagatgttccaaatgcttgcacagtttattttataatatcaaaaaaccctgcattttctattgctgtacaatatcactgctgatctcaccagacagtctttaagtatggagaacttgtcaaattatggtggcaggttcaggctttccaaaactctaatctttgttaggaagctcaaatgttatcattgccaacaaatactgtcagttgtttttcttgaagtgacaggcttacttcaatcatttttaagaaaatatctcccaagtctgaatagctctggcttatctgtcagtcattttacaagtaaaaatgatgttctatgaggaaaaaaagcagctagatcagctccaaacacaatggcatgtatgcgtttccttgaggcaaccattttaggttaaaatgcagcaaaagcactttctggtgctttacaatttgtctcccagcatttgaaaaacatgaactcacgggtcaaaatttaataaaaataataattttcctactgcaccaggaatagtgttaagtaaaactgtatgttttttcttcaagtgtgtgatgatggtgaaaaatacagggaacactagtaccatgtggtgccactttcttgatgtgagctaaagccccaacagttttactcaccatcgcttttgcaccattgatgccagtgtcaatatagagaaaaaggtgaaaaacattttaatgttattatgaaaatagtttttacctcagagaccccctgaaagagtctcagggacctcactctgagaactgctttttatagcctacttgccaaagttgtatttgtttgctatttctgcataacacatctacaaacttagtgtgtaaaaacaacacacattgataatctcactgtttctataggtcagaaatccaagaagactcaggtgcatcctctgcttaaagtctcataaggctgaaatcaaggtgtcagtagggctgtgttccttactagatgctctggaaagaatctgcttccaagctcactccggttgttggttgcagttgcagaactgaagtccctgttttcttgctggctatcagctgggcaagaaagtagaggggagggcagtgtcagggatggtggggtgggggcagacacaatctttactctgaagggcttctcacattccctctcacgctctccatggggccccctccagcactgatgtgtccttctcaaacattgactctaacttctttttctgctgtatttcactgactccagccaaagaaagttttctgcttttaagggtttatgattagattggcccacccagacaatccaagatcctaagctctgtaaccataattatatcattcaagtcgtaaacccataaacagaacatgtttatgggttccagggactagggcttggacttatttggggggccattctgcctaccacaaaagaagaaatgcaaaatattactagatgattcttagagtaaacgtgggttgttcaagaatcgtaaaaaggcttcccatggtaatagaagaaaaatacagaccaagtcaaggagtggcgttaaaaaatactgctgattctagaccttgcctaggagaggttattctaaatctgcttgaatacctcccgttttttagtctaccccacttgataagcaccaaccttgcactaggcttggggtgagaactagggggatgggagttaaagtgagagaggcagagataaaaatatttggtccctgctcctggaggagctcacagcctagagctgccctctgactctaggactttgggatcccattagacatattatatatgccttaacacttaagacatttactatttgtggactttctcacgaagatgttctcaaacattgaaagtagagcagtggtgtaggaagagaggtaaggacacaggtgagaagaacaatcaagccagtcaaccatgtttatcatcatcccctcccttgccctccacatggaatagataatcaaattcctccttaaaaaacttctactctctaatcctgtcttgactcagtgccttcctcttgagcacggtatgtgaaaatacctggtgttttcaagccaaaacaacatgaattcaaatccaatctctgctatttaagagtgggatggtatctctgagcctcaacttccccatctgtagaagagggagaatgattcctactttgacaaattgctgcgatttcagataatgtatgcaagcaccttagaacaatgtctggaggttgtattccctgaaaagcaaactctaagatcaagattagaatgcagatagactattaagggagtattatcaggatcatgaactgcagaaggaaagaaaaggaagaggcactctgatcccataagaagctttgaaggggcagccctttgaagtgatcccaagctggggaaaaggggcctggcctttataccccatcatagataagccagcagatacctcaaaagaagggttggttttggtcaaagcatctcttctcaactaaggaaatttcagaaaagttgagcctctgggtctcagcaactgaaagaataaattctcaagcctgaatggggagatctgggttgcaaaacacaacatctatgacacctggcatttgccacactactcggtatattgtgacatttgcaattattactgccatcatttttttgttattaatttttaaaatttttatttattttttgagacacagttccactcttgttgcccaggctggagtgcagtggcgcaatctcggctcactacaacctctgcctctcaggttcaagcaattctcttgcctcagcctccttagctgggattacaggcatgcctggctaattttgtatttttagtagagactgggtgtcaccatggtcaggctagtctcaaactcctgacctcaagtgatccacccacctcagcctcccaaagtgctgggattacaggcgtaagccaccacacccggtttttattattatattattttgttgagacacagtctcactctatcgcccaggctggagtgcagtggcgtgatctcagctcactgcaatctctgcctcccaggttcaagcgattctcatgcctcaatctcccgagtagctgggattacaggcacctgccaccgcacccggctaatttatgtatttttttagtggagacggggtttcaccacgttggccaggctggtctcaaactcctgacctcaggtgatccacctgcctcggcctcccaaagtgctgggattacaggtgtgagccaccgcgcccgaccccggctaattattttcaatttttgtagagatggggtcttactatgttgtccaggctggtcttgaactcctggcctcaaacaattctcctgcctcggcctccaaaagtgctgggattacaggcatgaaccacctcgtccggcctctccctgagtaacttcagtcactggtttcacgctcacagtattagcgtacccagtcattgacgccaggcatagcgtccacactcatggctgcagtccgggcatacagcaagggctcaccacagaacgaacgcagtggagctgggagaataccggaggtctgagaggaacctaagcagttcccgcccctcctctatcacatggcagtcgggtaaagtgaggccgggagagagaggcttcagcggctcacccggcccccgtgggcctggatccagggcgtgaggctgtgcgcgtgctctacgctgagtccggcccgggtgtcccccagctcggccacgcgccggctcagctccatggccagggccaggggctcctgggaaggaggcggggacccggggcatgctcggcttgggcgagagctgtcctcccggctacagaacagctccaccaggcgggcgaaaaagccggaggccaggctgatccgcttgctgcggcagggcggggtccgaggccagcagggctaggcggagatttcagttgctcttgctgttccagccgctgggccaccaaggcatagaagtctggagtagctgggccaggctctgaaccatagcaggggcggatgggcagagaccaaggccgaggggactcagagggggctgctcctcgccccagggagcagggaagacatcttcgaaggcggctcaggaagtctgttggctcttcttgggcagggcttctaggtggatttggaacaggagacccagcagcctcaccacgcctaaggaaggcagctaggaccctcagcgtgtcttcccggagccccagctcttcagagcctgccatggaggcacctgatctggggccccactgccacctcctccgctcaacttgccatctcctccactcaactcctactgtcatcatttttacacttctttgtatagccactgctcctgacttattctaaccttatcccctcttgtctagaatgtaaaagattttcctaactggtttctgtaatccatattaccttcatccaatctgctctccatactgctgccacagtggtagttaggaaataaatctaagcatctcattgccctgcctaaaatactttagtggttccccaccaacttcagaatgaaatcctaatttttgaatatgaccttgaacataacatgcatctgactttcatcctgatccttgcacactttttctgcccacttttagccaccccaccccaccctacactgctaacaaactcttcacattggtttgttgtttcccccatcccaccccttcacccagttaatgtctacttatcttgggagactcagctcacatgtcaactcctctcagaagccctcctaggcctggcacggtggctcatgcctgtaatcccagcactttgggaggccaaggtgggcagatcacctgaggtcaggagttagaaaccaacctggccaacatgatgaaaccccgtttctactaaaaatacaaaaattagccaagcatggtagtgcacacctgtaatcctagctactcgggaggctgaggtgggagaatcgcttgaacctgggaggcagaggttgcagtgagccaaaatcgtgccactgcactccaggctgggtgacagagcgagactccgtctcgaaaaaaaaaaaaaagaaaagaaaaaaagccctcctaaacctctcttccctaccctagattaaactaaatatttaccttgtggattccctttttacctgtgcatacctctgtcagaacttttctccccacctagtacctcagtttctcccagagaacagagccctgtcttacctttaaactgagaccctatttagtgcccaatatgtgattagagcatgcagaattaaatctgtaagagaagtcatccttctggtgggaggggaaccacttacagtagaccctcagtgcagttttttaggaaatatagctggcccagcactttgggaggccgaagagatcgaggccaccctggcaacatggtgaaaccccatctctactaaaaatacaaaaattagctggatgtggtggtgggcgcctgtagtcccagctacttgggaggctgaggcaggagaatcacctgaacctgggaggtggaggttgcagtgagccgagagatcacaccactgcactccagcctggcaacagagtgagactccgtctcaaaaaaaaaaaaaaaaaaaaaaagaaagaaatatagctggtaagcacaaatcaaattctggtgcattaactgttattacaccaaaattctcagtttagcaccaagattttgaggcaaacattattaagtacaacaagcttataatacaagaaaatgtgaccagtttcccaaggtttatgcaatgcaattatgtaattcagatgtcccccaagtttctccagccttccaacaaaatatcccgacaggaatgttatcatcctgttggggtattttgttggagctagatagaggtggtggctcacaacattttgaatgtactgtcactaaattttccactttaaaatgactaattttatgttatataggttatgttatgtgaatttcacgtcaacttaaataacacacaataaaatgttgtaataccccagtttattagattagcatgccacccagtcactcacctg

SEQ ID NO: 419 - DNA, 1965 bp, Homo sapiens
ggttgacaggactgaggtgattcgcacctgcataaacccagtgtactcaaaactgtttactgtggacttttactttgaggaggtgcagcgcctgcggtttgaagtccatgacatcagcagcaaccacaatgggctgaaggaggccgacttccttggtggcatggagtgcacacttggccagattgtttcccagagaaagctgtccaaatccttgctgaagcatgggaacacagcagggaaatcttccatcacggtgattgctgaagaattatctggcaatgacgactatgttgagcttgcattcaatgcacggaaattggatgacaaggatttcttcagtaaatctgacccatttctggaaatttttcgtatgaatgatgatgcaactcagcagctggtgcaccgaactgaggttgtgatgaataacttaagcccagcctggaaatcattcaaagtatctgtaaattctctatgcagcggagacccagaccgccggctaaagtgcatagtatgggactgggactccaatggcaagcatgacttcattggagaattcacctcgacattcaaggagatgagaggagcaatggaagggaaacaggtgcagtgggagtgcatcaatcccaagtacaaagccaagaagaagaattacaagaactcaggcactgtgattctgaatctgtgcaagattcacaagatgcattctttcttggactacatcatgggtggctgccaaatccagtttacagtagctatagatttcactgcctcaaacggggaccccaggaacagctgttccttgcactacatccacccttaccaacccaatgagtatctgaaagctttggtagctgtgggggagatttgccaagactatgacagtgacaaaatgttccctgcctttgggtttggcgccaggatacctccagagtacacggtctctcatgactttgcaatcaactttaatgaagacaacccagaatgtgcaggaattcaaggagttgtggaagcctatcagagctgtcttcctaagctccaactctacggtcccaccaacattgcccccatcatccagaaggttgccaagtcagcgtcagaggaaactaacaccaaggaggcatcgcaatacttcatcctgctgatcctgacagatggtgttatcacagacatggccgacacccgggaggccattgtccatgcctcccacctccccatgtcagtcatcatcgtgggagtagggaacgctgacttcagtgacatgcagatgctggacggtgatgatgggattctgaggtcacccaagggagagcctgttcttcgagacatcgtccagttcgtgcccttcaggaacttcaaacacgcatctccagctgccctggcaaagagcgtgctggctgaagtcccaaaccaagttgtggactattacaatggcaaaggaattaaaccaaaatgttcatcagaaatgtatgaatcttccagaacactagcaccatgaactccccacacagttttacagagttctgaaatactattcctgctaatatttcatatttaatacttctactactcctgtactttaaaaaaccaacaacatatacacatttaaaaatagcacgttttggtgatttttaactatctgacaattttttttgcatgtgtagccctgaggcctggatctgttaagcccttgtattgttaactttttacaaagaaacacagataacaataacttactatttacattacagcatgtcgccttgaaataaaatggtatctgtatccattttttatacaggtttgttgaaattttgctaaatttcttatctttacactctaaagcattttgaaacatttactgaatgttgatagacgaaatatacttggttttatctgctataggatgagagactttttaaaatggcagatgcatggactgtattttgcatgtttaaaataaaaaaagaa

SEQ ID NO: 420 - protein, 497 aa, Homo sapiens
VDRTEVIRTCINPVYSKLFTVDFYFEEVQRLRFEVHDISSNHNGLKEADFLGGMECTLGQIVSQRKLSKSLLKHGNTAGKSSITVIAEELSGNDDYVELAFNARKLDDKDFFSKSDPFLEIFRMNDDATQQLVHRTEVVMNNLSPAWKSFKVSVNSLCSGDPDRRLKCIVWDWDSNGKHDFIGEFTSTFKEMRGAMEGKQVQWECINPKYKAKKKNYKNSGTVILNLCKIHKMHSFLDYIMGGCQIQFTVAIDFTASNGDPRNSCSLHYIHPYQPNEYLKALVAVGEICQDYDSDKMFPAFGFGARIPPEYTVSHDFAINFNEDNPECAGIQGVVEAYQSCLPKLQLYGPTNIAPIIQKVAKSASEETNTKEASQYFILLILTDGVITDMADTREAIVHASHLPMSVIIVGVGNADFSDMQMLDGDDGILRSPKGEPVLRDIVQFVPFRNFKHASPAALAKSVLAEVPNQVVDYYNGKGIKPKCSSEMYESSRTLAP

SEQ ID NO: 421 - DNA, 35359 bp, Mus musculus
  misc_feature (1)...(35359): n = A,T,C or G
acctcagtcttagctcaacagccccaacctcctgcctgtagaagctgcctgtggctgctcctcctgaaatctcacatgactagttcctcttttctctctctgaagcattgcaaactctcccttgctccctcttctgcgtctgccagcttgcctttctagaacccagaagtccttcctattctttctgcccatcagttggcccatggcttcctttctgatagatcaagaaccaattgaagaacaggaccttagcatcagaaccatccctacagaagacaggagaatcccagaccagctagcctgatgcacacagctgcaagcaataaaaagacctggtctcaaaaaggaggaagacaaagcctaacagagtctttgtcctctaatcccacttgtgcatcatgctactcagcctcacacacacgtgcacacacacacatgccattgtagtttaaaataattaatcagtgtattgccctgcttctcactcactataaatatcaaggcaaagagacatttgacattccttaaagatgtgtggatgatctagctggtgctaactgaaggctatatgatcctagagctatcgatctggctcaagcatagttgagcagaacactttactcactgctcagctgaataatttttcagggtcaagtggtcacaaaataggtcagattctggggtcggaggttaatgcagctcttcagagttgaaccacctgggatccaccccgcatgatgtttctgcaaagttttaatgtggtggtggtggtggggggggtgttagcaaaacttcactctcctcaaagttctgtttcctctggacatcacataatcgcccagatttccttgttccttactatcaccagtccttcacagggtcctgttttatgaggtgattctgaatgcccgggggcctctaggctttttcaataccagtgtcgtcatctatagatggacaatggcccttgtcacagggactcatttcactcctgattgcccaaattaaggtttagagcttatgtggtgaactatcatccattacacatgtcccatgccatgggtcatcttgccctgaatacatgtcagtgctgagagtcttgtacacagcactacctggagttatacgtgagaagttgtccggcctttaattttcagcaaatcttgaaacaaatgcttatttaagatactaaatatggatttaaaagaacacaaactctcagaaagaaataaacctttaaagatttttgtccctttagtcagagcttaaaattagactagaatcagtcttttaaagtattcataaaatatttttgcttagtagttcatctcgtcttggctgctactgaagctttcaggtagtgagaacattatttttccatcagagttcagtacggttgcatatggagactcttggtagcaaggtgctttataccctcatcaccaagcacacttgagtacatcacgcaggatgtagctgcacggggcatcccacgacagtgaaatttgaagtgtataatttgtttctcagaatacaatagggcctgtgtcatacacacatacacaaaaacacacacacagagatgtcggggatgtagtggtcaaccttgtgaaggaaaagtgggatggggagtcaggtgccacaggctcctgggagtcctcaaggagtcctgatctgccataaatgacattagaaccaaaatggcttccagaacactggtgaggcaacaaaaagaactgaggccaaggcagtggctgcttcccttgtctttctggaagtcctaactgatgatgcactccacaaccccttgctccttctgagtaacttcatcagacagggcgctcactggggcacggtgatagcatggtgagatgattggctgatgatttatgggcttgggattggtttgagcactatataagcaactcagatatgcaccctgaaaaaaatttttgcttatcttttcttttacaatccataattcctcagcattccaccacatacatagtaaattcaatagcttttaggaataaaatgtattgtgggatgtatgttgtggtgtgagtgtgtgaatgtggtgtatgtgtgaatatgtgtgtgttgtgttgtgtatgtgtatgtgttgtggcatgagtgtgtgagaatgtgtgtgtgtgtgtgtgtgtgtgtgtgtgtgcgcgcgcgcaaggatactatggttagaaagatggctcaggccgggcatgatggcgcacgcctttaatcccagcactcgggaggcagaagcaggtggatttctgagttccaggccagcctggtctacagagtgagttccaggaaagccagaatccctgtcttgaaaaaaaaaaaagagagagagagagagagagagagagagagagagagagagagagagagagatggctcagtgggtaggggcccttgttctgaaagcacgatttaaattcagatccccaaacctgagtatgaccatgtgcaagcctatagcctcagtactgtgtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccaagtttaataagcacaccatgtcttaaggtaataaggcagcaaaatgatagaccattcttctctggccactgcatgtgcacatatacacatacacatgtagatataactctcatacacacacacacacacacacacaacatcacacaaaaagaactatatattccatagctactcttattgctgtgcatgtatttttttttttttttttagcttgtattgtggatctgtgataggatcttgtattaggatcttttctttgttagcacattctttggtgttaaagtttggagttatgctatctcaaattttatattctatattttatttgtccccacgtagctctggaagtcaatggagaaattctaattcatcagagttttacagagttaaattccttcaatcttcttggatatatatttttcatcttttaatttcattgttcattttgcacatgtttggccagcactatagcctgagcctaagtcaccatcttttttgttagtttgagacaacgtctcactaagttggatagactgaccttgaactcactctttaaatttgcaggcctcctgagtgactgggattattgaatcagtccgtctggcttaagtgtacatgacgtcataattacctggaggaaatcagacgccctggcaaccagcagttaatgttcctactttcattttaaagacagacgttgcgatggctagtcttgattgccagctggattgtattcagggatgcctggagactaataaagcacacccctgtgggtcattgccagatctgattggatactgaaaactctaacctaatcaggaggttaatcccctggcgaattagatttcaatggcatttttgggaagtggtggaaattggggaagcttgaggaaataggtcactggggatatggctgtgaagagtccatcatgtcctagaaccatcctactttacctcatcttctaggctgccatgaggcaagaaacgttctcctactgccattttccaccatgatagactgctttactacagacccagaaacacagagctgagctaagtgaacatgtgaccacaggctttcccacccacactcaagttccccaaataacaactctgagactgaattgtgtcttaataaatgcctaggctatacatgagggcctgttcctaattagcttataacttaacttgtttattctgttctatgaatgccacagggctggttacctcttctcagtttcgtgcttctgtctccattaacatttggggcaaatctctcccctcatctgactctcatcccagaatcctctctccctgctggaatgccttcttcctatttcttgccgaagctgaataggctaacagctttttattgacagccgctgcttccacacagtgcacaagagattctctctacatgaatggaaaacctgagccaaaagaaatccccttccctctctctaagttgtttatcttgggtactgatgtcatcatagaaatttcatgtaatataaagttcattagcatcactccagatgacaatgcataaaaagtatgtaaaatacagaataaaacagactatcctcatatgtgttaatgagcaccattaggtccactcagggtctggataaaacgaaagtctcttttttctcctcctcctcttcctcttcctcctccttttctcctcttgttctttttcccttgctctattccctttccccagctagaactctcgagctttgtcatccttctattcctgtgttcagtgattatagttttcatttctaaggcccaaaactctactctaagcacaagcatcctggattccagagcttcaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattacatttgcattataagaagaaataagccctttcctctccaccatgaagggaagtcagggcaggaactcaggaactcacactgaaacctggaggcaatagttgaagcagagaccacggtggagcacggggcttgctttcatgcctggtccagtctgctttctgataggacctaggaccacctgcccaggggtaccaaagccctcggggtgctgggtcctcccacatcaatcattaatcaagaaaatgcctcacagacttgcctacaggcaatgtgataaaggcattttcccaattgaggttcttcccaggtgaccctaggtcaacttgaccaaaacaaacaaacaaaccaaaccaacaaacaaaaaaaaaagataaaacaaaaataaatgaaacaaataaataaaaacaaaaacaaaacaggataagaaagagatgtgctttaatgtctttttgtaaaaaaaatctatatttgatagagattttgaaattacattgttcaaataatgtaatttataaccagcctcaaagattaaagttttaaaattaaatgtaaaaagaatggattcgcttattttaaagaatctcgttttgtaaatgagattataaagtagtttaagaggtgcactggttaggattgtgaatgagataaaggttagtatgaaaggtcatatggaaacaaacattctaatcccaagtatgggttattggctgttttccacactcttgtttcaaacagctctctaaagactttagcctatattatcacagtcttttcaagtattgttaggtgtgctgaaattctttcagctggtgtgaaacatgtaccagatgagtacatgagtggggtaggaggaggatggagggagtgcgacctttaggtcttttattttctctttcactcccgccccagttacagcaagggagcagctgtgcccctggtttgaagtgctcctcaaaaccggaggagaaggctcagtggtgaagagtaatacactgcccttgcaggacacccacgtcgagtggctcactgccacttataactctatctccagagaatccgatgccttttttttgccatctgtgggacacgcgctcacacacacacacacacacacacacacacacacacacacacaaatctacaaatctacactcatataactaaaaataaaataagtttaaaaccaaggatatgttccacaaaatgagagtatacaaattgtgaataaggaagagaaggggaaggtggtggaggagtgtgtcttccaaactgtgttcttcctgagagtcagattctgatttttaagctctgggtagagcctgacagtgtgcctttttaaactggctcggggtgctgcagctgctcgtggtacagggcttacactaagcatagccaagatttgtaaaaacaaaaacaaaaaacgaattgtattaggaatgaagaacagagaaatgagaagagagagagagagagagagagagagagagagagagagagagagagagagaaagagagagagagaggatgtgaagataaagggaaggaaatggagggaggtaaagaaaagagaaaagataggtttacttagtgttagacaatagtgcaataggaagggaaagggaagccgggcggtggtggtgcacgcctttaatcccagcactcgggaggcagaggcaggcggatttctgagtcaggacagccaggactacacagagaaaccctgtctcgggaaaaaaaaaaaaaaaaaaaaaaaaaaaaaaaaaaaaggagagaaagggatggagtgcaaaaaattaattctttaaatgagtagaaacaaagaaaacgaaaaggctgaagtgaggcagcatcttaaagctatctctcttgagcatatgaggacgaagtttatcgctccttaagaacccaaattcaatagtcatatagtctaggttctagcgcacgctggcgctaggcaatgggcggggccccggatgtagctcagggggcggtgcttgcgttcgggggggcggggccaccccaggtctgcggaccgggccttgcgtcctcctccgtctcagggggcggagcctggtctctaaattggcgcctctgagtggctaagcggcagctcggattggcggcttttgaacccggaagcactagcgggcgctcggaagcggcaggagcgcgggccttggctcgctcgctgcggctgcgggatggttggcggtggcgggaagcgccggacggccggggcgggaccgcaggtaggcgaggcgggatgcgctgggtatggggacgctatgggccgtggaggagccgagggccgccctgcggggcaatggcccggggaagtcgttcctttccagcgccagcccagttcccacgaagctctgcagccagcggacggaccattcattcattcattcattcactcactcactcactcactcactcactcactcactcactcattcacttactaaccagctgatggaaactggaggagctgccagggcggcgaggcacacgcgaacaaacatttcacctttcgtttttttttttgcttggggttaacgcaggtgtgtaaaagaaaatgctggaattaacaagccctggagttattaaagacttttgtttaagacagtctctatgttgtagccccggctgtcctggaacttgatatgtagatcagaactcaatatgtagcctccaaatcacagagaccctcttgcctctgcctccaggacacgaaccaccactgcccggctactttggtagcctgacctggaagtgtaagggatacgggttctcagatgagtgatagattggccagtctggactcttacatgatttcatgggttccttaagcatacagtagctaatgggagaagttaagcagggaaacgaacgtttaacaaaagtgacaccagctatgttttaaactgggtagggtgaggcgattgctaaggcttaacggccagtggatggcgaacataggtattattctcgttgtgttgtgttttctcacaacaccaagttaaaaatgtggtttaaagagaacagccttgtcaggcagaagcaataagaccaaaagttcagtgtcctcctcagttacattacaagttcaagaccagcctgggttacaatagacctgtcttaaacaaagtccagcttgatgacgtagagagtaatagtactgatgacttgaattcagtccctgaagtcatgtggagttagggaaggggacaatgtgaccaaatacgttgtatgtaaaaccactcccacagttctgcatctacccatttgggtgccttttcctttttgcctaagcatttcctgccgcttctagtcactgtggctatcaccctgaagttggagttacccttgccttcttgtagagtttgttgtttccttaaaaagcttttatggtacatcttgtcttagtcagtattctactgctgtgaagagacaccatgaccattaaaaaaaaaaaaaagtgcctagctggggcttgattacagttttagaggttcggtccactatcaccacggctggaagcgtggtagcaggcaggcaggtatgctgcaggagaagcagagagttctacatctagactggaaggcagcaggaagggagagactctgggcgtggaatgggctttttgaaacctcaaagtcttatctatcccctagtgacacacttcctccaccaaggccacagttcctagtccttcccagtactgccattccttggtgtactcaaatttataagtgctattctgtttaaaaccaccacacatctatctaatcttggggggttttcttaattgaacatcatacaaagattgagccatgttgtctaactgtacttctctttctttcatttagttactgttccccagtgtttgaaagccctgtaactatctattttcctgttggctggcatttcaacctcctaaggacagtgctgtcaaaaacaattcttacccgatgcctgacttgtacatacagtgtgtaggcttggaatgacagttaccaatacatatggttggacccctgagaacatgtagttatcaacacctgggtgagaaatgccgactctagcggcactggcttgctgagggcagctctcccgcgcactgggcggcgttgagctgtatcccttagcctctgcagcactaggtgccgctggtcctgctgcgggtagaatgtgccgagtttcgcctggattcagaaccacaaggatctaagttcccagaaagaaagagattgtacttagaaaacaagacagatacgcaaagtaagcaagttgccttggtagcactgagccagtttccaatagcatcctttaacctttaatttgcatgggtgctagagatgcaaatcttagcattacaaagccttttccgaaagacatggtttttagctcagaggatattcccatattgatccttaactataccatacctctcctctctttttgtttggaatgtcaaaaggaagttatctggttttaagtggaagggtagtaatgattgtggtaagtagtgcagacctaactatggttggagttcctgaaaaaacagcttttttcccccattatttatgttttaggttagaatacaaagaaattggtctcatcctggcttactcatgcatatgtgccattgtacattcgttttgtttgttcttaaagatgtatccgacgatggctttgctcaggcagtcctcttaagtgctatggttgctgggtaataacatgacaggtgtgtgcccttgtacttaacagaaacagcttttatctgataagtcctttgtatccagttacttgtgatcgtttgcttctggtgtgcgtgatgagtctgtttaagtgaaaggcctgatgatgtgatggcatcttggtaccaaaatagagctgaaacttttatgcctttatgacagctttacattttccctttgtttcttcttggtttgtttgtctctgctatggagaagcacatttagagacatgctttgggtggtattttttgaccaccgtgtaaactgtgttctttgcacaaaagaatctcttggagtttacttaagtatcacgagctcatgcttttgttattgcttttgtttgtttgtttgtttgtttgtttgaacatgttaaaatggaggtagaaagatggctcagcagctaagagcatgcactgggcttgcagaggacccaggacagtgtccactctgttgggcaactcccagctccagctccagggatcagtgctctcctctagcctcaacagcagccactcacacacacacacttcacaatcataaggtatttaggaaaatgtgtatggtgcccataaactggccagtaagcaatattggtgtgcaagggtggttgttgaagttcgttgggaggacttaagtttcatatgccaatttcagtgtgaaaagacagttgaggtgaagaagagtaagttttctgaggctgatgtctccagtgaccttcgaaaagaagtggaaaatctttataagctttcactgcctgaagatttctatcatttctggaagttctgtgaagagcttgatcctgaaaagccagctggtgagtctgtctagtctctctctgctcctgtgactgcaagagatgacaggaaactggaggaaggacagaaacagctcatagagaaagtggttttagccacacatggtgacatgcctattatagtctcagcaattaagatactggtttgagagtaagtttcaggctagcctaggatacacagtgagaccatcttaataaagagaagacaaaagaacattcccacagttctttctagtgagtgaggtatgtagtcagagaacaagttaatatttctgtcggtcaacttcattgctgggatgtgaaaagacagccgagcaggaggacagcgtccgttacatcatggttttacccagcaggaggacagggacaggtcagaagtttctgactatggttagtttgctctattgttttggggtcagtgataccttatgtcatgaggatgtgtcagaaagtgcctacctcatgtcagacaggaagcaaagagcattagggagcaagagtcctgggataagatgaacccttcaaggtcatgtaaccattagtcacactcatgtcattagctggggactgtgctttccatacatgagctgctttggtttaaggtcatatacaaaccataatgctaaatatgctactgtcacctattggccaaggcaagcagtttcaggacactccttcatttaaggaatacagaattaaggaaagtgagcgggtgcatatattgtcattttacgtctataaacgtgtcttaatggactaggtaaactaagaatttgcatcaaggctatttactggagagagagacagggagagggaaatggcttcagtgtttgtaaccctcctaggaaagctgcagacactctgaagttggaagtctaaagacctggagtgacagctcatgagaaggaaagggaatggtttggtttggttttgttttctatccttaatctatgttgtctccttaacctgtatgtttgtagctatagcagatagtggtgaggtaaggtaagtgcatggcttttaggcctggaagggtgcacagcagcttggctggggccaaggaaaggcagaaatgctctaagcgtaagctaatgcagtagtaagtttaagggggaaagcataaattcagtgctacatttctgttcaactgatgtcctttccattgagtaaaaacatttttacagactttaaagtgttctttaaaacaactgcttaagaataatttagaactggtaggcagagacaggtggatttctgagtttgaagccagtcagatctacatggtgagttctataagagtcagggctgtatagattaaaccctgactcaagaaaaggaaaaggaaggaaaagaatcttttagaactgggtatgatggttcacacctgcagtcccagcacagatcacgtggttctcggattcccaggctagcctagtctatataaagttctagtctagccagggctaatagtgagaccctgtctccaaaagggggagcagggtggagagagaaaggaaaagagccataccaccgtggtgaaaggcattagtttctatttgcctctacaaagtgttgcctcataaacttattttccttatagatgcgcttgccacaagcctgggtcttcggttagtgggtccttatgatatccttgctgggaaacataaaatgaagaaaaaacccacaggcttgaactgtaatcttcactggaggttttactatgaccctcctgagttccagaccattattattggagataataaaactcagtaccacatggggtatttcaggtaaaggctcttctcttctctaaaatacagctgctctgctattactgagtctcagtggaccgtcactggcatccaggctgaaaggctccttctcctcttaccagtgcctccatggtcgctctgttattctggctaccttccacctctttagcctgcgtgggttggtgaactctttacaccaaagttcctggatttctttctctctttgactataaagtttttgagttatttttgtttttgttttgttttgttttgggttcagaagaactttgcagccaagtaagataatgtagaccagcagtttgacttacaccctgcacttccaggggctggaggactcacagattggtcctgccattccttatcttgatggcaggatgccagtcagtgactttctgtgactccgtgcacagaaagtcttgcacacatttgataggactgctgtgagaactaagcgaagcatgtcagcagatagggcaatgtgagaagtgctctgtccacttccggaggacgctgggacctgaagctgaggtgaaatagcagaagaaaggatgactgtggctagggagaagcgctgcacagaactctggggctgggggctgggggcggctcagacagctttgttcttgctttggcactgatggactgctagaacctccaccgagaaccgtgactctctctactagtctctttaatttaaaataaaagggtgggatacagacatgattaagatgcttcagtgttttatatctgtcctgtttcctttcacttttacttcacttttctctcctgcatttttttcttaatatactctaaagtgaaggtgaccagcagttgtttgtaatactatgttgacagattttctttccttatttctcattattcaagtaaaaattaggtactaaaaagcttagctgtaggttctgatacaagctttattgtagacagtctaaagatacttggaggttaagcctagcaagtttattctactttttacagctacgagtttgtctgtagacccgattttctgcttgttggcattataaattatggatagctaaacttttattatctttaattaaaacagggattctcctgatgaacttcctgtatacgtgggtacaaatgaagcaaagaaaaattgtataattattcaaaatggagacaatgtgtttgctgccatcaagtaaggaaaagtttgatttcagttctcttcactcgttgtccttatacagctttgctgcttgtcatcaaaaccttctggaactgcttatctaatgaacatattgctgggtcctagggtgagctctgaacctgaagcagagaatgctgttagcatgttcttagcatgtcagaacctctggaattcatcctgtgcagtgcaaaaaaatgtgtaagaagtgtttgatcttcatttcagatgccccagggaaaaatcagggtttttttttctctactaaacatcacatttaaacggtgtcatttagagttcattataagaaccaacagcaatgtagttcaaactggaaagtttttaggagtaaggaatttacagaatccttggaatggctgctgcgacaagctgagcctccagggataacagttgcaaggctacttctcatcatcggcgagtgtctctgcagttatccagaggctgggcaatgagctgctgtaggccatagcattgatgtatagttataccagaacagttgctgccctgccatctgcccctacagcttatatgaagtaggaataaggaagcatggctgctacttcccactccttccttcagacttgaaagaagtgcttctgcttggggtcagccaggtctgatgcggaatcagctaaaaatagcatgagaaatgcaccagttttctatgtaggaggggtcagaatccagctgagtgaaccaattggtattggccacaaacatgatttgaagtcattcgttagtaggtatgcagtgtacgttgtaattcaacaggttaatctctatcacttgaaatagctagaccatgttttgtatgactgtaaagggctttatgtccccctgacttaatagtataatttattattaaaggattcaaaccaagtcagtccaaggtgaccactgttctatggtgtatatacactgatgtacctggatgacagcagcattctgttctttctcttgtaagacttgagtcttacgtaaaatctgctcgggatttgtaattgctataagttctctttctcccctgggttgttggtttttatttttagttttgagtactggggactgaaccagggtcatgaccatcctaggcaagtgcctactacttgttatatccttggcctcagtaacatttcttctaaacctttaagatttgtcattcagcttaaactggaattgtctgtattagaaactgtagttgtttactggcatatggtctgtctcctgtgctagcgtgtaagccccacaaggacaagggcagtgtcttttatatcgtgctgttcccttagcatagaaatatatctctttttaaatttctagtgctgggaaccaaactcagggcattattattataaattgttgataaaaacaaattctagaaaccacatctagcagtaaggaagataaggcaaataaatacaaaccatttgcattataaattatattttatataaatcatataataaaagcactataaatgccgtgattatgattggtgtgaagagggcaagtaagagaatgggatgattctgatttttcatgtctaatgcatgtggaaaataatctatattcaaagattttggtctttacacaacagaagtgatttttgtttgtctttcggctttctttccctaaaactaactgctacaatagttcgaactgatggacctgtggtagtccataccaccttagatacaaagtagtaatgcaatgggttctgggtttttgtttgtttgtgcaccagtggcacaaaggtagtggttgctgttggtggtactgttggcatgcttgtaagattcagcatactgacactaagttagcgcagaattgcattgttcattgttgcgtatatgtttaaagacatcagcaatgcatgcctccaagcgcattagatctctctctgcagcccagtatgtcctgcgtgaggaaatgggaaataggtaggagtcacttttggacattgaagtgttgtgagttgtgagttgaactttcactgacttttgctgaggggtagtgattggcagactttatttgggcacaagttataggagcagacattttctcaatccaaaggaattgccaattatatttggtgtcattgctaaaattgaatgtttagcacaaataagataggaagggctagtaaccaccatgatgagcgtttccctagaacatcctaatagtcatgaatgagatgtttttcgtgttgcataatgggatgaacttggtggagtgagaagtttcaacgtgagatttacataactttgtgagccaatatgttctaaataatcattccagaaggctgtaaaaaaaaaagatgcatgggtaaagctttattcagacgtgcaggcgttccagtgggtctaacaaagtggctgtgatcactgcttcggtcggtttgcatgctgcacgcctttaaatatcatctagcagcgtgtttagtagctttgagtggtattgagatgctcacaacagcttggtggggaaagggtcttggtggctgcacagtaccttacttggaatagtggggggatgtcttctgtgaaggaatgtgtctaagggagagacccagggtatttgaaggcctcctagcctccttgagcgagcttgaggaaaagattcgttcatgttttgacagggccagatctagtgcttagtagatctcttgatatacacagtccatggtggttaaattaagcaatgagaatgtgctgatgtttgtggtttgggtctccatgacatgcagtccatcattactaccttttgtgcctcagtttcctgatatgtaaagaggactgaagagttatatggcttgaatgactactgaatttcctagggtaggttgcaaatagttcattccaggggcctgctacgagggttataaaaatccaaatcctttttgtggacagcacacttgtgtttccctcttgagccagcccttccaggcagaataccatttctcagtttccagcagtacgacttaaactccgcctccgcttttcgatggttttcctctcgtgtttgcaatgaatatacacagtccaggcgtgcgggctcactctgtgcttccagcttcatattggctctcttatgccttgtttgactgcctgtgagggcttggagaggatcatatggaacttgacgtttttgtctcagctccttgacttctgtgtatagacagaggccagcagtgtaacaatagcttttgcttcttttccagattatttttaatgaaaaaactcaaagaagtaacagatagaaagaaaattagcattttgaaaaacatagatgaaaaactcacagaagcagccagaaaactaggatactcactggaacagagaaccgtgaagatgagacagagagataagaaggtagggtcgcacgtgttcatccgactgttgtgctctgccctgggctcctccccacctgcaccacgtacttttctctagtcctgtcctaaggacagctgtatgccatcccccagggactctgggatgtccctagctggggtcaggtggctcctgcatgtgcacattggcgtgccgcctgagtcctgtaactggagcccgttcctgtggttgcataatgcatcgtagtcctttaatcttgttgtattggccattgtgtaaaggtagagaaaagcagctttgtgcttaatactgaacttcattgtctggtggctgagttctcgttttagtgcaaggtattgtagtggtgcagttctgtacttaagagacttaactaagacctcaaaggttctctttctagaaacagtatgggttaagatttgctaatttcctcctgaatcctccttgaccctatcagcattccctcgagcttgcagtatgacagagtatcttgtaaaggagcaaggaattctcaggttaggggttcttctgggttttcagcaatggatgtcagaatcagtctacagatatgtgagagaacttctctttgtgggcattcctcctaactactgggcaagtgagggctggtgttctcctgcttcttctctcactgttgtcttctgaagctggttggtctgaacatgctaagccatacgaagtccttgttatttctgagttaacaggtactgtgaaaagtttgtagtacttagttactgaagacctgcttcattctttattcttgactcagtggcaggcatgaatcacagccactctcttagtaactctgtctgtagtcctacagaccagagtttctaaatgtgaggtaattacagtgacagttaacattttatagtcttcttttaccttactggctgtcaaggaaaattcttactagaagaaagagacatgtatctcactttactattatgtattctgaagatgtccggagtactgagcatctgtggatgtgatggtcagcaagttctttgagaagacccttgttttattgttaacagctataccttagttcacagaccttactgcttttcttcatgtgtttccttcatggttgaaacttcagtttcttgttgtgcttattctgactcctcccaagtctatattcagtgtttgtttttcattaaaagatagtaacataaatacaaggtaaaccatttaaaagagaattttgacttttctccttccctgttgacacttttcagatcccttttttttaagatttatttattttatgtatgtgagtacactgtagctgtcttcagacacagcagaagagggcatcttatcccattatagatggttgtgggccgccatatggttgctgagaattgaactcaggacctctggaagagcagtcagtgctcttaaccactgagccatctctccagcccttttatatcctttttaatttatgtataattcttaatgttactgtgagatttccatttaattcatactttcctgtttctgagaactcagttccagtagtatgctggtgactttgccctagcatatgagcatacagtctgcattgtagtactgagtgtctcacagcagtgtatagtgcagcatatgagcatacagtctgcattgtagtactgagtgtctcacagcagtgtatagtgcagcatatgagcatacagtctgcattgtagtactgagtgtctcacagcagtgtatagtgcagcatatgagcatacagtctgcattgtagtactgagtgtctcacagcagtgtatagtgcagcatatgagcatacagtctgcattgtagtactgagtgtctcacagcagtgtatagtgcagcatatgagcatacagtctgcattgtagtactgagtgtctcacagcagtgtatagtgcagcatatgagcatacagtctgcattgtagtactgagtgtctcacagcagtgtatagtgcagcagtgtttgcgagtacgtggcaccttggactactttgaaatgcagtctgtgtgagtcatggcatttgtcccacaggaaatctgtacagagcagaactttcccctttcttctagtattttagttttgttttcacatttaagactgaaagccaacctaagataatcctgtgtaaatattaagacataaggctgtaaactatctttttctaaaccattttccatgtctgtaaattccttctgaacattctgccctctggggtagcttagcaaaggctgatagaagacgtggagggagggctaatgggagagtgggaggggtgtggcctttaacatacctgggctaggtgaagactttaaaagtagaggtcacagccaggcgtggtggtgcacgcctttaatcccagcactcaggaggccgaggcaggcggatctctgagttcgaggccatcctggtctacaaagtgagttccaggacagccagagctacacagaaactgtctcgaaaaaccaaaaaaaaaaaaaaaagtagaggtcacttttggactgtatttttcttctgtcttggaagctttcactaaaatacacagtggaatactgaagatattttactagaaaataccaagacctagtatgtcagtgcatatttgtaaccccagtactaaggcagaatcatcaagaattctagccagggggatggagagatggcttggcagttaagaacacaggaccagggttggattcccaggacccccatgaaggttcaccatcatctgtaactaggtccagcagatcttttgttcttttctggtctccgcaggcaccagacacgtaagtgttatatagacacacatgcaagcaaaacacccatatacataaaatgaacaagttgaaaaaaattaaagccagcctgagataatgctaaaagtaaaaataattgaatgtagaagtaaagaaaatgatgtaaagctaatgctcaaagcatgttcctcagaaggctgtgattgtagcacctagagctgggtctcttttcatctttgaagatgaatgcttaaacaggccatgtgatttgtctataaaagcactagctgctttatgggagtttattaatgagtctgaatttcccagttcaaaaagaggagtctgaatttggccgttttgatgaattctgttgtttttctacagattctaccctattgtctcttcttttcaaaccctgagtctttatctaacaaggactgctattcggacatgtaacaagtctggtggttttctgaagtatcaacacaaacttgtaaatgactagcatgggctggtgagatggctcagtggttaagagcgccgactgctcttccaaaggtcctgagttcaaatcccagcaaccacatggtggctcacaaccatccataacgaaatctgatgccctcttctggagtgtctgaagacagctacagtgtacttacatataataaataaataagtaaataaatatttaaaaaatcaatcaataaacaaaatagaaaatattttttaaaaaatgactagcatgattcatttaatccacttactttattttataattacttgaaacgtttgacttttggtttaaaacaatctattctccccaagatccaggttttctaagataatgtctctggatgctctgttttgacaacattcagggtttgtgtgtgtgcaggtggggaggtagatcttttgttctttgggttctctttgcatggtctcttttttttccctttggtcatttgttttgttttcttcttgaatttaggttgtgacaaagacttttcatggtgcaggcttggttgttccagtagataaaaatgatgttggttaccgagagctccctgaaacagatggtaatgtgttccctgtggaaatatgtgcatgtatgtatataagcatggggaaagctttctcttgtgttgagaaataggtaggtgttacgagcaaactcaggctttcctagcttgatcttgattgaacaggctatttagtgtgaccaagctgtatctttttcatctgcaaaataggcagtggtctttagttcatagggtgtctgtaatgtgaagggctatagagcactcagtgtgatgtcaccaatgctccaagcaaggtgagtgctttggagactctaagggactcagcccattcaatagcttttctttctaaccttctttagcacctttgacctagtaatgactgcatttggttgcagtcacaaaacactagtcttggtgaacattttagttttcatactcctaattcttcatgcagtcatacagaaatacttagttacacaaagttaatactgttgaaaaggagtcatatgttctgtttctttactgtgaggccccaccctccatccccccaccctcagccccccttgtcattctttatatttttgtttctgtggacataaaatttaaagagaatccaaattagtatctcctcaaggaaagcaagtactgttgcttcatacacatagctgcctgctcctcgggacgatggggcttagtaattgccaggctttaattcttacgtggtgtatacagccagtacgttgggatgtgttttggcgcgatttatatttcatccggcttgctatagtaggaatttatagaggaactgaagctggctgataaatggctcctgaacacttaacctgtggctaatgccacagacaaatggcataatttaaatttgtttacatttataagttaagccagcattaaacatttttatattgattatacgttgaaatagtgctacattaggcatattgggttaaattagtttcaactatttttagttggggggccaaaatgggggaggtgtgggaggaggaggggagagtgggagcgagaaatcaccacatgctctgaggtgcatatggaggtcacaggatcgctcttggtgattagtcctcatgctgcctcatgaaatctggtaatgaacttaggtggcctggcctttgtaccagagcctataatccagagccctatcaccagccctctcgtttttttagtgtggctattttaaatgtgaattatatatttctctcactgatctgtcttgtctgttccctgaagccagagataatcaatctctgggaaagcctaggggctctggctcctggtgcccaggcttctgcttgaatcagaacggaagtaacatgacagacattttcatggtggattaataagatggcattagttgagttagtagaagacatacagaaaagccttacttaaaatcccccattaaagatgattgtgtgattttgtagttgatatctttacatcatggtttttttcagctgaccttaagagaatctgcaaggcagttgtcgacgctgcaagcgacgaggagagactgaaagcattcgctcccattcaggagatgatgacttttgtgcagtttgctaatgatgagtgtgattatggcatggggctggaattaggaatggacctcttttgctatggctctcatgtgagtaaagctcctccttctgcagtactgaatacacaaactcacggttacttatcttctcaactccagctgccgagggggggatccagctcctatttccaaacctttggaagtgatttgaaagtaaaagttctaaaacgatttgaaatcttatattgaggcaaaggtgaataagcagaattacttcctcaatgtcatattgaactcagcttgtgtatcggtatctcgggggcgccatctttgcggggtctggataggcttgtggatatggatgtggaaatgtatatgcccctttcttttgtttttttttggggtgggtgtcatctactaccacgtcttaaatactgttttcaagtattttaattaaaatattggagctagtagtctatcattgaccctttcccacctgtaaaattgccttctcatgggcacatgcatgctcctcactgtacctttggtaagccactgctagggcaccatctccaggctcccaatggcagccccattccagtgtctaagtaaaggattcacaaactgcagatgcttgggagccaccgtagttagtattaatgcaaactatatgagtaggtcagaggtgtggccctgctgtcattaacattgccatgtggcaagaatgccaccactttatagactatcctgaggagcaagactaagccagcatgcatcagtcatccagacgagacggctttgatcacaggttagtgtttccttgtcccccactttgaattacagggtggttcctgacaaactgatccgactggtcaagaaccctgactgagacccctgtttaaagcatcatatggcccctttcttcctggcttctagttatcagtaaaaagtgtccaaagtgttacacaagcagaatgatatagttgtcacaaaggacctaaccataaatgccattgatgaagtaggtattaaaaaaaaaaaattacatgagaaatgaaaagatgtggtacactgaatacgtgcttaaataaatgctagttctcacaaaagaatgttaccgggtttcctgctagggtgtatgtaaaagcaatgctgtgaaaccattcagtaaacctgagcctgaactctaagcaggaaagaaatgcttacatggtagagaatgagctgagactaaaggggaggagctggagagatggctccgtggggtagaacacccagagggacccagttctattataagcatccacaggcactcacaagtcaaatatgtggtgcacatttaggtaaaagacatatgtaaaattgtttaaaaaatgatgaagagatttgtaacctcatatttgtcatacctattacaaggtctattaaaaagtcttaactaatacaaatagttaagaagaaagcatttaatggaactttgggacaaaaatgttgataaaattaatggaccatgagaaacttcaatttgtaatgcctctgagctcctttcaggacttggtgaacagttgtctttagggcagaagagcagggacatggcccatgtttagggccaactgggtggactttgttgcacaggtgtgttcccatgtatttttcagctgtacctgccattttctcaccctgatgttatgttctttgctttttagtattttcacaaagttgctggtcagcttttacctcttgcgtataatctattgaagagggatctgtttgcaaaaattattgaagatcatctggcaagcagaagtgaagagaacatagaccagcttgcaggatgaacaagctgccctgttagtgcagtgctttgaagtgggaccagcagacggggctttgtttttaaggaatggagaaataaataatgggaattttattaaaaactttataatacggctcttctagtgtttctttcacttgctaattaataagtgacactgctcaacattttagaaattctttagtttctgaggttcttttctgagtatggtcctcaatattagcttgtgtataaaagagtgcttatccaaaatcaaataaccatctattagctagaaatactaggctagttaaaactaaaaacacttggggctagacaaatggctcagcagttaagagcactgactactcttccagaggaccctttcatttcacacatggcagctcacaactgtctaactggcttctgactaccttacttgtacatatacagaacaaaaataacaacaacaaaaaaaaaaccctctcagtgatgacaacagtctcaaaaatacggttttaagactttatgttccataggaccaatatgaatcccatccagatttatcaagatgaaagggaagaggcagcttttcatccatgccacccacaagctaacacggagctgtgtttccaaagctgtgctacctatcagaaccaagacaggaactggacacagcatgactgttattgtgggctgaaaattagctcagccatagagcactttgtctaatgtgtgaggccccaggcttgattccagaattatttacacagcaattacaacttggatgtttgtgaatacagtaatgaggataatgagataactgatctttcagttactgagcatttcattagagagcaagctccctggtatagaatacggagcctgacattctcaccactttccttcactaaaggcagtttgaattgactactatacatatttaacctaggggtctgactggaacacattttaagtgcctaagcacattcacaaaccaccatgactcaatcaggattgtaatccaatttaaatccattttcttatttctttgggcccaatgatggaattcctatgttaacctttcaagcatttatgttgaaccatgcccaaggacatggaatgctatgaaagatattttataatgacctaaactcacattagctcaaaactgagctcgtaatggtattgtctctaaattatcctaccataatcctttcactgatgcagtgtacagacctcagttccaagactgttgtcttgttgacaaacctggagctggtcagtaccaacaatgaaacttcagcccagttccaagcatcgaactacctattaccctcaacagtccatcatcttcctctagtaccccatttttccaacctataatctccttcacccagccttaaggttcaatttccatcatcatgcatacctcaactgtgttgcatttacgttagtactcaaaaccaaataaactacattttacctgaattctcagaatcaagtagctaggaaggagaaaaaaaaaaaaaagcagctgtgtcatactgaggacattttaacctcagatggctattttagatacccatgggacctagttctttttgatctgtgttcaagctccaacatctcccccattctcggttaatgtcagagaaaaagtgacagcaatcagaccagacttaaggtcacacctttgcctctttagcctacataaggaccctccctccccacatcattaacataattagaagctataataacctacacatcttaaaaatctcatctcaaactattctctcagacgttgctatcaccaacaggaaaagctacgtcctgcaccttatttcctgaaaacccagaagaatcacaactctctcctgcctaacagacccatcccacttccactctcgctgccaccattccgtcaaacactcaggcaagtcatcagtgtgctcacactggctagctctgaggccttgcttcacctctcagtaaatacctggctgctgaggactccttgaaactcctttatttggtttatatcactgtgcttcagtggtgcccctttccatctcattggcagttctttggctgtctcattttaccattgattcttctgcctcgtctctgttcaaacttaaatcctgttctggatggtgcctctcatttagctcaaggctgttctttaacttgaatctcacatgtgcattagttcctacttgtaatccccttactaacacatcatgacttggctggagagagagagggagagnnnnnnnnnnnnnnnnnnnnatcaagcttagcagttaagaacatttgcacctatttcagagaactagaactagatctgatggctcacagctaccactgttaacttgagttccaaagacacctgcactctcctgtgcataaacacacaaaataagaagctggagagatggcaaagtagctaaaaagcatgtattgtttttaatagaagagtcaagttcagttctaaacgtacacattagatgtatcccaactgcctgtaactctagctccagaggacctgacgtctgtcctccttggacacttgcacacattcacagtttaaattacacacacacacacacaaaaacacacaaccaaacaacagcaacaaaaacaaacaaacaaccccttagtattgggctgacaagattgttcagtgggcagaggaactttccagcaggccttaagcctgagtttgatctctggctcccacatgttggcaggaggtaactggccactgaggtacactgagccctagcctgttgcagtgcagtgtacacgcattctcaatcatgctggcttacactgaccacacagtgcggctgcgcaaaggaagagctgttggtacaggtgcaattaaaagccaaaccacacttttaagtagagattttaatagatcttaactcatcacagtaatcatttttactgtaatgatatgcagcttttactacactagtataaataaaaacagataaatacagctctaggcaacatcacaggttaacaaactaagcattcttcatgaaccaaaaccaaaaacgattattaatagatgctgacacgctcgcccattttcatcataccttcctaaaaagggtactcaaatgaggcgctgcacttagtatattggtcaataagtttgccaattagctaggcacatgtagttcatggtatccactatcttatttggttggaaatcaaccaaacctttatgaaaagagaaaaacagaacagatagtaatacccaaaagaaagaaaaaacaaactccaaacctctgaacgcattaaaaacacgtcacttttcatgtgtttcagcagtaagacacatcagatagagaaatgtaacaaagaaaatgaatgctttaatatggatcctgaaatgtcagtctctgaagatgggtcatgaaaccagaatatgaaagaaaaggaaatgtgggggaaaaaaaatcatgttcagtttcatcgcgttaaactacaaagaaactggcgtctcctttgaagacctggaactcagaaggggctgagccaccaatcagcagtgctgaagagttcctaccccagcagtgtcttccatactgcaagaatactttcagagctacagaactaccattaaaaatgagtccactctatttagccaaagagcaacgaggaatattgaaatctgccatcaggagtaaaaagacaaaatatcactggcagacagcaattttggggaactttggatcactcgaatatggcttcctgattttctaagtcttcaagatcatacagacctaatgtgatttcatatttattaaaaatggctcatgccagttgtttcagaaaatatctgtctgcacaaatgcatttggcctttgaaaaatgcatacttgaagactagctgggcagtctagtgagtaaacaccctttgccagttggaaattaagaccatgattaaaacactgccaataacaactccttatactctgaggtacattataactaatctgtaaaacgtgcaccatatctactgaaatcatcacagaacacttcagggatggctgtgacctacccagtgattcaaaggttataaccacactgtgattttcttgttttcatttttgattgatttttcttaaaaaaaaaaaaaagtttggctttaatctagtactagtaatttatggtattttcaactttctagtttgtggtcaagatggacaggtcaaagggcataggccaggagatggcagtgagaaatcagaaggtatcatgtgtactctgggtcacggacatgactacctcttcttaaacccttgtgcccatggtaatctttactcatacctccatatttgtaagtcagaattagtctattaaaaaaagtcacattaaaaaggtaaaattatttatgtgcaatattaactgatctgcattttataaattttaatccataaaaatataaataaaaatggtaaatttttaagaaaagaaatatacatttagtgcaagttatgaattacagttcatctccagtgtcagcagtgaaacatcctgaaataaaagaatgatctaatttgaagaacaaaattccagtgtttaacatgcaattaataccaggtacagctaaacagactccttcctcctctttacagtcacggcagcagcgcttgctttcgttatgctgaacagcacttctctgtcatagtagtcatctcagaaatagaaaatttgcataagactaggtcacattatccataaagtctgagaggaaaaaataaaactgattagagtcaagtttgttttagattctgaaccacacagcacacaagctgggagattgcattcacacctccagattttccctgcttggccagcagtggtgtgtgcacacattcccaagcctttagtgatggtacagactacatggttaatggcacaagaaacattcccttcttgtgatgaaacgtcagtaaaatcacagtacatctcaatatgagaaaggactgcttcaaaaggacacaccagagaggtttcgttacagctccagaggaagggggagggaggacagagaagctcttttggaatgtagaaaggtgatgcgtaactatacaattcatgagtttaacacaacagttctggtataaaagggcaagaccttgcagtcttaatagatggctcaattcaaagtagtccctccagaagtagggactgtaatgcgtctctgtggtgctgagggaaccgccagacgctcgaggatcccagggacagacggacggctccgcggaggctcaagcctgcactcccactgcactcctcagggagtgcagccagtgaggtgcagagcaacatgagatgaattactgttccaggtagctagggaaatacctcactctttcccttctccctccccaaacaatccctctgctctcccagcattatttgcaaaccgggttgcaaagctcgccttgtatttccttttttttttttttttgaaagaagaaaaaagtggacgagtcccgcagattaaagaattgtgctattcaacaaacgaacttcctcttctgtctcctctctgtcctcatctacaggactcagttgaacattattgaagcggggtcttggtttgccgtctgggccatatgacggaggatatctttttttgttataatgccaaggaggcgtctgaaaaggataaacagaaaaagctattaaaataaaagggaaaagacaagaggaactaaatctatggataaatcctttttgttgacaggaatagagagcaaagcaagcagcctgattgtgcttattttaaaaggtgttttactgcaaagacaatgaaattacccagcaaccatcctctgacaaaaatacagtggccacgtagagtgtgaggcccttcccactggggctgggacgcaggcctcactgaagcagggctgctctgattcacgtatgccaacagaaaagtagcaaaaactgggacgatgtttgaacagaaagtaatactgatccagtttgaaaaggaacctattgccattatattagaaaacaatttaaaaccgcaatagtttatagaaccaaaatttttaagaaataatttgcctagttgtatgcagactattgctgaaagcacatacaattgagatgagatacataaccaatgatctgcgcagagcttcacctcccagacttgacagtgtgacaacccaggattctgaaagcatacttagggtctttgcttttcaattttgtgctcgccccaaagaagatacagtgctttattcaaagtttggatgttaatgtttacattaaacagtaggtaagaaatcaagaggcaatcctgaaagattatgtaggtgaggcagaaagcagaatgaatgggaagctactatatttggttagtagtttaaaaaggatgcatgaaacacttgtgaaatattagcatacaatagaaatacgtacttaaacaaatggggacaggtttcatataattatgagaattgcaggtcaaaataatttgaggtattaattgttaaagtcacacaatttgttatgcacaaatcaaaactgtatctctaatcaatgacaccactaagacataaagcctattaagacaaaagctacctatgacagtctagaaacacgaaacaaaggggcacacacgggatctatggacaacccataacgaaatggaagacacacattttgactgtgagaatctataagggtagcagagacagaacgaatgctttgagagctcatctccgcactgtgctccagttagggtgccagttaacaatgtactccgtcagcgcttctgctgctcagctcagttcaaggagcttagattcacatgaccacagattaggaagcaaaaaaaaaagggggggtttgggggtgaaggcctggggcagacagggttggcagtttttaaccagtcaggagtcttctgagactggtgaatccactagggtagacagacttttcatgcttaaacaagtccaataatgttctccgcattacccaactgtcagcaggacttaattgtaactaattctgacgagagatgttagttgctgcttactttctaagaatggaattttagacagtatatctaaatttgtctcacagacatctgggcagacaccagtgtaagtggcagcaggtgggactgtggcagggagacctgaacagttcacaagtttcatgcctcctgacttctagggtgtctagtgaggacagctgacacagctaatcaccaagggctccacgtgctgctttagttgctcgagatgctctaaaatgttcttctttgtgatgatccccaagacaatcctgaaacagattattatgctaataactgtgagaaattaaactgaagggggttccaatcataatgataaagaatgagagaaggaaataaaacataaaccgtaagaatgctcctcatgaacttgagataaaaataagatgatttaagaatctaggttccattttcagacattctactaacttaaaaggtgacacaatactacttttagtggttgagtttatttttaaattaaaaatcaaaataatgaaagtatgactaaattttaatgatggagatgaataaaagtgaaaaagaaacataatgacacacagctaccggccgctacacttgggactgctttcagtgctctttccctggatgaccagctctcagtttctgaggtaacaacctacacannnnnnnnnnnnnnnnnnnntggttttggtttttcgagacagggtttctctgtgtagccctggctgtcctggaactcactctgtagaccaggctggcctcgaattcagaaatccgcctgcctctgcttcccaagtgctaggattaaaggcgtgcaccaccacgcccggctaatgagaaatctcctagacctctactattcatttggaaatccaattaaggaagaatacatgtaaatactaccgacctcattctcaggaactgaatctcatttcttaagagatggtaataaaacattcatgggtactccaaatgagttttaatgcatatttttctaagtaatttttctcagtttatgtcattaccatcacatcttacaaaaaaattctcataaattctcatgaagatacttgtaactagactgcttttaattattaaataccttgatagttattttccaaaaataaatgaatttgcctacagtatgtgatgatataaatttcagaagcccttctaaaatgccttcagaataatcaggcatttccttaatgatctgtctgcttaagtcaactttcttgttaagctgccttggaaatatttgatttcttttccttccttcctcctttctttcctttccttttctcattccccctttccctttttcattcctttcccttccttttttttttttggtgacacaggctttccctgtgtagccctgggactcgctctgtagaccaggctgcccttgaacccagagtggcctctgcttcctgagtgctgggacttcaaggtgtgtgccaccataccccaccaaaattgtgtacaaagagtcactatgggacttgaaagcaatctgaaaatatttagaaacatttccctcatgaaacaatagctggggctagagaggcaggaagcatattcacattattttgtttaaaacaacggtgtgaagttttcagagcatgtgaatgacctctccagaaagcgcaaccctgtactgtataaatgtgcatttgtcccctagaggaaggaaggtccttgggcaaaacacttgaggggtttgagggttttttgttgttgttttagttttggggttggtggtaactatgtttaaagtatattgtacacatgtatgaaatgtaatgaatttcatgattttgtacaattaattaatatataataataaaaaacaaggctatttcttaaagctataaagtctataggtttttatggttaggagatgtgggattcttagcacttaaatatagtaagagcagtttgattcttgtgtgtgcttttttatccaattaagtagaatggttaatttcagtttcccatttgtattagtaagctcggtcagtatttgacagggtgaggaacatgacatatttgcacagacaaggcagcacacttaggagtatacacgtgtatacatttggatacactggaacatttacgaactttctcatgcagaatttttaggagaggaaaaactagtcataaagttcctcttcaccagtcaagattgacttgagaagatgaagttagtttcaggtttgctctttcagttttaaagaatgaaatgaaaagaaaaaaaaaaaaactcaatgcaaaatgtttctgatctatcagtaatctgacgtttatttttgggctaacaaacaatgatggggaagttagtaaggctttagaaactggcatttcccaaagtatgctctaagaaacagcaattccaacagtgcatcaccccaccaaaaaatgtcagcattttcaggcaaactaggtaagctatgatttcattactgacagctggagaatcaaaagccatcaacatcttcaaagtccaaagaaatcttcaactataacttaattcaatacttctcaaacttatgagtcacacaacttttattactcgcctgtttgtcctataaactgtgagaactagggtttcttaaacaaactcagatgttctgttagcatataaaatatgggacgacactgacatgacatcctgtctgtatctgttctcattacttctccactctttttacctggacctagagtccctggtttgctgcattttaattcccccaaataggtcttttccactgctaaggtactacatgaagttggaaaacaaagaactacctagaacttcacagtcttcactttaaagcatgctgtctttcctcagttttagccattttgagaataaaacacctccctacttagtagctcaagacaataaagtcaagagtttcctccccaaatgatctttttctttccaagtatatttatgtgaactaaggaaaatatgatcaaggctgtgagacgtgaccctggaggaaagttccttcactttgtttatatgccagcggcagcagataaaactgtatgtaactaattcttgtccccctaaaaaataatttaatccttttgagggtctatactgccgaaatcctgtcaattaaccagtaaagtaacatataaaaattaatctacacagtagactaatttaaccacaagaactgaacagaaccgaacagaactggtgtttgtcgatgcaaaagagaacctaagccaggcacagggaactcaaagccaacagtggcttaagaaaactcacattcggttccaagcaagccatataatggctcaaagggcctgaggcaaagctttatttattaaattttaaacaaagaaatttggtagcatttttaaaaattaggtaagagcaaacaaaataaaacagtagacaatagtattttataaaacatctttgatttctctctatcacactctagaaggtggctctaatagtcctcacgttctgcttcgtgctgtttttaagtagaatgagtaactatgacatactgctgctcctaacccaatgtggtataatgtagaggcccagaaaatgttttaagagattaagaaatcatgaggaaagaacattcattctgtcagtaaactatgctatagcaggattctgggattttgtcagctggggagttaatttgaaaacatctttacacctgtcaaacagaacctgacctacctggttttctgagctttatgatgatgagaaaaggtgtcaaagtattcaggaagttgtcttcctttgttttttctttttgttttttaatgtcaccttttcctagagagggctcatacgttctgttacccacaagtttttatacaaaactttaaaaagataaaattagttgtgattctctgatgtatatgctacagtatttaatcagcttcactttgttcagggtgagccacgggttcataacaaacccaggaaacatggttcccttccctaacacttctgtggcaagatttcacacggagtgttctatggattccagcaagtcactggcaagcaagcaaataaccataatctcagtgtccctgaagctcacaagggtcacagactcgaggccagctccaaatacagtgaggccccgcctcagcaacaaaatcaacaaataaaacatttaaaattcagcaaagaaataaaatatagaaataaaaggctctcaatacatgaatagttttaagtaattaacagttcagtttatgggtctgatttgttttagagaaggtaaactaaaataaataaataaataaataaataaataaataggtaagaaggaaaaccagagttatagatttttaattaaactgcaaattttcacatattatttcattaatgatagatactggctcaaatagcacataccaaaatacctggaaaaacagttacaaaaaaccctatacataaaaaggaa

SEQ ID NO: 422 - DNA, 1226 bp, Mus musculus
ctggccagtaagcaatattggtgtgcaagggtggttgttgaagttcgttgggaggacttaagtttcatatgccaatttcagtgtgaaaagacagttgaggtgaagaagagtaagttttctgaggctgatgtctccagtgaccttcgaaaagaagtggaaaatctttataagctttcactgcctgaagatttctatcatttctggaagttctgtgaagagcttgatcctgaaaagccagctgatgcgcttgccacaagcctgggtcttcggttagtgggtccttatgatatccttgctgggaaacataaaatgaagaaaaaacccacaggcttgaactgtaatcttcactggaggttttactatgaccctcctgagttccagaccattattattggagataataaaactcagtaccacatggggtatttcagggattctcctgatgaacttcctgtatacgtgggtacaaatgaagcaaagaaaaattgtataattattcaaaatggagacaatgtgtttgctgccatcaaattatttttaatgaaaaaactcaaagaagtaacagatagaaagaaaattagcattttgaaaaacatagatgaaaaactcacagaagcagccagaaaactaggatactcactggaacagagaaccgtgaagatgagacagagagataagaaggttgtgacaaagacttttcatggtgcaggcttggttgttccagtagataaaaatgatgttggttaccgagagctccctgaaacagatggtaatgtgttccctgtggaaatatgtgcatctgaccttaagagaatctgcaaggcagttgtcgacgctgcaagcgacgaggagagactgaaagcattcgctcccattcaggagatgatgacttttgtgcagtttgctaatgatgagtgtgattatggcatggggctggaattaggaatggacctcttttgctatggctctcattattttcacaaagttgctggtcagcttttacctcttgcgtataatctattgaagagggatctgtttgcaaaaattattgaagatcatctggcaagcagaagtgaagagaacatagaccagcttgcaggatgaacaagctgccctgttagtgcagtgctttgaagtgggaccagcagacggggctttgtttttaaggaatggagaaataaataatgggaattttattaaaaactttataaaaaaaaaaaaaaagc

SEQ ID NO: 423 - protein, 367 aa, Mus musculus
LASKQYWCARVVVEVRWEDLSFICQFQCEKTVEVKKSKFSEADVSSDLRKEVENLYKLSLPEDFYHFWKFCEELDPEKPADALATSLGLRLVGPYDILAGKHKMKKKPTGLNCNLHWRFYYDPPEFQTIIIGDNKTQYHMGYFRDSPDELPVYVGTNEAKKNCIIIQNGDNVFAAIKLFLMKKLKEVTDRKKISILKNIDEKLTEAARKLGYSLEQRTVKMRQRDKKVVTKTFHGAGLVVPVDKNDVGYRELPETDGNVFPVEICASDLKRICKAVVDAASDEERLKAFAPIQEMMTFVQFANDECDYGMGLELGMDLFCYGSHYFHKVAGQLLPLAYNLLKRDLFAKIIEDHLASRSEENIDQLAG

SEQ ID NO: 424 - DNA, 48459 bp, Homo sapiens
  misc_feature (1)...(48459): n = A,T,C or G
gtcacaatgtggtacattgttttgttcaatttcagactgccttgtttacaaagcaatttgggaatatggattatgacactaagtttattcctgtctgtgaagccagcagttcctctaagaatttaaactaaggtaatattccaaaatattttttaaaaccttatgtacaaaaatgttgaccacagggttatacatagcaataaaaagttatgacacacagtaaaaacttataactacgagaacagttactttatcaaacatttgtccaatggcatatttatgtagccattaaaatattgatgaagcatttttacaatgtttatttgttattaagcttactttttaaggcctattaccaaattttatgtgcagcattatttcatttaacaaactataataagatacatgtagaaaaatactgaatataccaaatattgtctgaggctacatctaggtggcataatataattaattttctttttatttttagatagtattcaaattttctaaaattattactactttttatagagacagggtcttgctatgttgcccagactggtctcaaactcctggatttaagtgatcctcccacctcagcctcccaaagtgctgggattacaggaataacccactgcccccagccctaaaattaagtataactttatattcagaaattaaacacataacttggaaggtgaggagaatgaccttatacaaggcaattactcaatagtaatatcctgttggatccttctagtaactgctccctacattcccagctcctgtttccttggctattttccacaatcttgatctcagttgctgcttttgatgttcccttgtaacatcacctcgcaaactcctcatattacctgagcttgctctctaccatatcgccctttgttgtgtcacttcttatttcctggtggtaacactagtcgttcagaatttttgctctgatcaactctgtgatagtcacagagtaaaatgattagatcaattcttttaaagagactactctggagcaatgtgtctggaaggttggagtgtgataaagacttacataattcttacactgcttctatgtgactagcaggaatactgactgtacatttataggactcctcagtacactataagctcctggaacatagcaactgtgtcatcttggtcttttcagtgcctaacatagttctgacacataattgggacttaataaatgttctgaatgaacaaataactgaatggatgaaaggatgggcaagtaactatttaatgatggtgactgctattcattaaagaggtcgataagccaattaatatttaccgagcacccattatgtgccagtttgtgctcagagctagattctaagaaattgtggtaggaaaagaattggcgaatcagctggaattttcatccactgtaaatatgaagactggagaacctctggggcctttcaaagatgtgtttggatcatccaactagtgctaattaagggttacatggtcccagagtaactgatctggattaagcataattgggcagaccagtttcaccaccatttagctgtataatttgccagagtcaaagtggccaaaggtaaggccaagagtgcagtgtcaaagattaatgctacagctcatttgcagcccatcaataacaattgtctaggatcagctctgcctgaagcttctgctaacttttatacagcaaattagaaaaaaagtttatccttcccaaatctgtttcttctgcaatacaatcacccatatctcccaaattaggtccccctgctatgaatagcccctaaaagaagtcctattttacagcctatttgggaatcagaatcataaggctatgggggctctgggccttctcaaagctgatttatcctccagggttggccaacagcgtgagtcacaggactcagctcaatcctgactgccagagtgaatgacttccatcatttagaaccttagaaattcaattggataagcctgtaattccttacacatgtgctgctctatgtggttattctgccctgaatacacgttaatgctgaatgtctggctacactctcaagtcctgggatcctaagtggcatcttgtcttgtctttaattttcagcagctctcataacaaaggcagaaagaaatgcttaagaagctagctatgacatctatggccttcaaagtgcacaaagattgaaaaaaaaagaaaaaacttgtaaaaatattctctttttttttttttttttgagacagagtcttgctctgttgcccaggctggagtgcagtggtgggatctcggctcactgcagcctctgcttctcaggttcaagtgattctcctgcctcagccacccaggtactaggattataggcataagccgagcccggctaattgttgtattttttagagatggggtttcaccatgttggccagactggtcttgaattcctgacctcaggtgatccgcccaccttggcctaccaaagtgttgagattacaggcatgagccaccacacccagtctaaaaatattctctttgatctagagcttaaatttagatgaatgctagaatcagacgctcttaaagaatacataggaactcttgcttccattttctgtcttttattaatccatgtttcaccaaggactaccacctacatagcaaatccagtaacttttagacctgaaaaatatacatttcatagctactattgttgtgtgttctctaaatctgtattgtgattaggatccttttcttttttagcattttatttggtttgagaacctcgaactgtgccatccttacatttcactgattttacttgtcactctatagttctggtagcccacatctgaattctcatttattagtattctacagaatcacattctatatatcttgtttgacacagatttctataaaaacacatattttaagttatcatattataattattaagggaaaatcaaaggtgctggcaatgaccaatcaattctgctttcatacagataatttttccacgtaagctcactagcatcatccccaatgaagacatagatctaaaagtatattgatgaccattgtgtcaccccagatttgacaaaaaaggaaaaaactatacaaacaaatataactttctccccaggcaaagtcagcaatctgatacaaagctatggacatattatggcttaattctagggaaactggcaatttttaaattattttttctaataaaactgatatccttctagttttttctgtctttctttcgagacagggtctcactctgtcacccaggctggagtgcagtggcgcaatcttggttcactgcaacctttgcctcctgggctcaagcgatcctcccacctaggcctcctgagtatctgggaccaaagtcatgtgctaccatgcccagagaatttctgtgcttttagtagagacagggtgttgccgtgttgccaaagctagtctcgaactcctaagctcaggcaatccacttgcctcggcctcccaaagtgttgggactacaggcgtgaaccactgcacccagccaccttctaactttttctttgtttcactgagaaacttaaaaaaaaagtctttcaaagatacaaatctcaaaagaggatattatttatgtcaaactcactagaggaaaacaaaacattgagaggctaaaaattctgcaatttcaaaccactcccagtgaattttatttgaaaatttcccagcaaccataaatacatgagaaaagctccagttagccctagtgaataagagaaggtaagttatcttcctgaagtagtgacaaagaggtcctcaatcaacttaaagagggcagcagaatagttaaacattgcatttccttatttcctcttttactggccgttttgaaaatgagggacccacagttttgtccactctcttgattaaagggaggttcagaggatacagtaaaacctatgtatcctggcaggacgtggtggctcatgcctgtaatctcagcactttgggaggctgagatgggaggatggcttcgagcccaggagtttgaggccaacctgggcaatacagtgagatcctgtctctctctctttttttttaaagatgcatcctttagatacaaatttcctaagttaattaaactaggattaaaaatgcaagtggctctgtgaactacagactttatttaatctggctgattgctagacagacagtattgcatagcgttgaaagtactctgaaaggatagactattcaggtttgaatcccacctccagagcttgctgtgtgactttggaaaattcacttaacctctttgaatgttagctgccttatctgtaaaatgggagtacaaataggaattacctcacatgactggtatgtggcttatatcagtctcagcaaagcacttagtattattgtggtttattcaaaaatgctcaacattgctagttatcagagaaatacaaattaaaaccacaatgagatagtacctgacacctgttacaatagcaatagacattatcaaagataacatgggttggtgagaatgtaagaaaaaggaaactcttgtacactgttggtgggagtggtaattaacacagccattatgacagtgtggaggttcctcaaaaaactaaaactagaactactatatgatccagcaattgcactcctgagtatatacacaaaggaattgcaatcaacatgttaaagagatgtctaggcatccatattgattgcagcattattcacaatagccaacataagtgtccatcaacagatgaatggataatgtggtacatatacaatggaatactattcagccttaacaaacgaaattctgtcatttttgacaatgtaggtgaaactacaggacattatgctaagtgaaataagccagtcacagaaagacaaatattgcataatctcacttatatgtggaatctaaaaaagttgaacttacagaagtagagagtagaatgctggttaccagaggctgggggttggaaatgggaactgcagagatactgtcaaagggtacaaagttttagttagacagaaggaataagtttttgagatctattgcaccacatagtgaacatagttaataataatgtattacatatgacaacattgttagaagagtagatttgaaatgttctcactccaaaaaacaataggtatttgatgtaatgaatatgtaaattagcttgacataatcattccactgtgtgtatatatatatcaaaacatcacattgtattctataaatatacacaattatctgtcaattaaaaataaatattagaaaagaatagtattgcatagtaagtactagatataaaacatttattaataataactttgtttcaaaatgacagacactgataacctgaagaagtataccaaatttggtcaactctacccattccttcaaaatcactgtggagtaaacatatgaacaggataaaatatattaaatgtcaaatgtttgaattaaaatagaaatttcattctataaaagatggttacaaattattattcagagcaaagttttagttctgaacttgaaattgcatataataagtgcagttttacaggttacaactgccaacctgatgttattcaactgaaaaatagcaacaataaatcctccagttaacatacttaacataccttgaaaacatcgactttcctccactccttaagaagcctcactaaaacaaagataaagaaggttaaaaagggggacagatggaccatatactcataaaaacaaagaaaactggagaagagacaactgaaaaatgccacaaaactttagaaatcagttgatgtggttgaactgcatccccccaaaggatacattgactgtaaccatatttggaaatagggtctgcgtggatgtgatcaaaataagataaagtgacagccaggtgtggtgctcacgcctgtaatcccagcactccgggaggctgaggcaggtggatcgtttgaggtcaggagctcaagaccagcctgaccaacatggtgaaaccctgtctctactaaaaatacaaaaactagctgggcctggtggtgcgtgcctgtagtcccagctactcaggaggctgaagccggagaattgcttgaacctgggaggtagaggttgcagtgagccaagatggcaccactgtactccagcctgggcaacagagtgaaactccatctcaaaaaaaaaaaaaaaaaaagataaagtgatactggattagggtgggccgtaatctaacggactgctgtccttacaaaaagaaagttagacacaggcagatgcacagggagaacacgtaatgacagaggcagatattggagtgattcatctgcaagccaaggaacaccaaggactgccagcagtcaccagaagctaaggcaaaggcatggcacagattgtccctcagtccccagaaggaaccaacctcctgacaccttgattttttatttctagcctccgtaactgtgagggaataaatttccatagttttaagccacccagtttttggtaattgttatggcagctttagggagctaatatactggtgaacatatggacttcccagagaaaacccaagtgttttcagagatgatgcctggaagcaagctcactgacactgcagaacctcacaatggctcaggaattggaagtaccatacctcttcagtgggttgagctgaaaagagaccattaaaagtcccagaagcagttaagactcctagatttcctcccctggcaaagtcagggaaacattctctaacctccattcccaacctgaagattgtttcttttgggagatatggaaccagaatatggattcagggacaccagacacagctgaaggtaaaaatgctattatgaaacagtggtgttaagtgaaggtatgcataattatatcttatcttatttttgtttgagacggagtctcactctgtcgcccaggctggagtgcagtggcgtgatttcagctcactacaacctatgcctcccgggttcaagtgattcttgtatctcagcctcccaagtagctgagactacaggcacgtgccaccatgactggctaatttttgtatttttagtagagatgaggtttcaccacattggccaggctggtctcgaactcctgacctcaagtgatccaccctccctggcctcccaaagtgctgggaaacaggcatgagccgccacacgcggtggagagttaattttatgtgtcaacttgactggaccacaggatgcccagatacctggttaatcggtattactgagtgtctgcgggggcactaagtaaaagagattatcctcaccaatgtgggtgggcatcatcttatccattcgggtctgaataaaacaaaaaggtagaggaagggaggattcactctctctctgctagattcttgaactgaatctttgatcttttcctgcccttggtgatcctggtttgcaagacttcaaactcgaactggaatctacaccattggctccccagttatcagggcttcaaactacaatatgggctttctggatcttcagcttgcagacagcagattatgcagcttctcaacccctataatcacgtgagctaatagatagctagatacagatgtaggtatagatatagataaatagatacctatttgttctgtttctctggagaaccccgactaatacagtgcatataatgaaattattaagactcccagcctccttcctgcattgggctccaagaagtctgtatattctcaaagtgagtaattagaagattactctctagaagaaaataaacagctggttctttccccatcatcttacaccttgtccagcagtaaacaagccttgcctatgtccccaaagcacctttttagagcctcatttttacatataaattgacagcaaggatcaccacacaagatgaagaatgcctctagcagaaacaacaggaaccaaatgtaaacaaacaaacaaccaaaaaagactcaaaagaatcaaagtcaatgcagagttacgtagaaagcatttttaaaaacgctataattgacatcttcagagataaaaggagctatattcatgaaaaataatgtaatgctataaaagaacagagaataaaaagagcactgagaaataaaggtataatacagaaattaagtaattaatctttattaagtataataaagaaattaagtaattgtccaattaagttgagaaagtcacagagaaagtagaataaaaatatgaagacatagaaaataggacagacaggtaagaaaaaacatcagccaagaaggtccacgatctaaataacaaatttcaaaaaagaagagatacgatggggggtgggggggaagaaatgatcaaataaataataccagaagaattcccataactgaagaacatgtgtttcaggattgaaaaactggtcgataggaatgagaaaagacccataaccaagacactcaatagtgttttagaacactgggaataggccggacgcggtggctcacacccgtcatcccagcactttgggaggccgaggagggcggatcacgaggtcaggagatcgagaccatcctggctaacacggtgaaaccccgtctctactaaaaatacaaaaaaaaaaaaaattagctgggcgtggtggcgggcgcctgtagtcccagctactccggaggctgaggtaggagaacggtgtgaacccgggaggtggagcttgcagtgagctgaggtggcaccactgcactccagcctgggcaacagagcgagactccgtctcaaaaaaaacaaaacaaaacaaaacaaaacaaaaaacactggaaacagagaaaagatcctaaagcttcttgagacaaaacaaaacagaaaggaaagcaggttacatatcaagaaatttagtgacctgtgaaggagaaggaaatataacgacatagtttcttaacaattctggaagctaaaatattgcggagcaagccctccaatattccgagtgaaagttattttcaacctagaactgtgctcagccagaataaaaacatttccagacatgcacactctgtgggaaaaaagacctggcagcaacctctctcaaggaactattggcggatatgttccacaacatgagggtatataatcaagaaaaaggaacacccagattgaggaaatagagaactcatctcaggaatgaggaataagaccttcccaggatggatgtgaaggaggtccaaggacatcagttgagagttgtgccttccaaattttatgtgcataggaattaccaggggatcttgttgcgatgcagatattgattcagtaagtctgggtaaggcctgagatttggcgttttaacaaattccctcaggatgctgaggccgctggttcagggactacactttgcatatcagcggtgtagaggaaaaacagtccaaattgtaccaagaagacgacggtacagagacagagaccgacagacatttatttccttcttggagacaatcgggaatgaattagtgtaagccaataaccgtacagtagggtagggagagggatggaggagaaggagaaaaggattaatattttaagtaaatataaatgaagaaaaaacaaggaaggggctgtattgagaacagccgcatacatccaaccttgcctctagtagacacctgaagaggaaggttggaccactctaaggattcagattcagtagtctggggggtctctggagcgaccctggaagatgctccagaaagcctagatgcagactacgctgacagaagacgctccttgcacgcgcccagcacgggagtgggcggggcctcaacgcgtccggtgccaggtctcagggggcggggaatgggcggagcctttcccctaaattggcgagcccgggcggcgctgaaattcggcttggaggcttttgaacccggaagcggttggcggcgctcggaagcggccgcggatcggggaattctgctggcgctgcagctgcagaatggtcggcggtggcgggaagcgcaggcccggcggggaggggccgcaggtactgccggaaaggctgtgcgggctacgcggggcgctttgggtgacagccagggcaccaggaggcagcgcttttcattcatccagtgactattaagcttgctgtgtgtccaggggctgcggtttgctgcggggatcctgcccagggccgctgtttcgcgctctgcagggggttggaccaggaaagtagctcctctgcatcttctgcccagctcctcttggagcatttcctggggaaacggattaagccaaccaatggttcattcgcccagccagattgattgggaaccgattacatacctgacattctgtggggcgctgcggatttgggggtcaacctgcttgctcctgctgcttgttgagccctcggcctggggaggaggggcacaagcaaatatgcattctactgtgacttttttgtttgggattataacgctggtgtgtagaaagtgctatggaaacactgaaggaggatttaacaagtcccagggggtgttaaagaagacttttaagacaactctttgaaaattggttttgaaggcagagaagtaagattctgagacataaaactgtaggagatgtttgggcgtagcggagcgttcggcttggctggagccagggaaatgggaaaataagagggacctgatcataaaagcactactgagaggggaggaggagagagtgtgtgcattctcatactttactacgatttcggaagttctgtaaccactacagtagcaataaggggaatcaggaaagaagtgccattgtgataactaaagttttagaaaagttactctggtagtgtcataaatcggacagggtgagacattcttagagggcttaactaactgttaaagggccatcggtataggcatccttcatattgggtcatgcattctaggaagaccagggtaaagaagaagtgtagcctctgaaggggacagctgttctaaatcctagttgttagggctatggagatgctgaactagtgtgtgagtaaaggcacagctgaaaaaattctctttttgaaggtgcagtgaagaactgctttggtggagtgatgtgcttaactagaaatacaataacagaaatgaagatgagtctgtagagactataaccgtaatggccagcatttgtatattatgtgctaggaccgttctgtgtatttttacatataataacattccttgtaacaaccccgatataggcactgtatgccctttttgcagatgagaaaacaaagcacagagaggttaagtaacttgcctaaggttggaaatcagtagagtcaggagtcaacccaggcaacctaactattatgcaaaactgcctttcagcaaggcagattaagccttttctaacatcttaagttggagccagtctttgaacgtctgaacaaagacagttatgaaaacagaagataggatagctcaggacttcatatgttcctactgttctatatttgatgttggagaagcagcatagtgaagtggttgaggatctgctgtggacccagatttaaacctgagtttaaatcccttctcttccacttcctagttagggacgtagggaggttaacctcagtttcctcagctgtacgatgaggttaatggtatctagtgcatgagacagttgaggactaaatgagttaatccacagaaggtgcttagaacagtgaaacagcacaaaataagttctcagtaagtatcacttaactacttgtttttactattatattatctttactattactatttgctattattgatactcacttttggattcattgttcaacaggctttttgttgaacgtaattttttttataaatcagacacattataatccttggcataataaactgttaccatattcatgatcgtctttgaccttatttatgttaagtaatgtaacaaacaccagtgaacccattgcccaatcccaaagctgaaacagacaatagctctacatctacacgtgttcctctcctatccgttcagccttcttcctgtcaattattttcagtgtagctatcctgaattttgttttcccttgccttttaaaaataggcttatctcccatgagtgtatacctaaacaatatttattcttagtttttgaacttcataaaaaggctatcatgctgcatataatcaagagcttttttcctcattaaaaatattgaatataggttggtccatattgtgtagccatagagtaaccattcggtaaatgacggagattggttccaggaccttaggagagcatacactaatttttaaagcaacaagaaaacaaaccatctcattagccaaagataacacagttaatagtctagtatacagtaacaaatttccatatatccccaaatctgagcatacccaagttccaaagttggtcctgtggaacccgagtatacgaaaagttggccctctctataagtggatttcacatcccaagaatactgtatttttttatttgcatttggttggaaaaaaaattcatgtataagtgggtccacaaaattcaaacccttgttgctcaagggtcaactgtaatattaagtgtaatagtctattgtttgaaaaccttacaactgttctcctaacaataggtatttcatttgttctgtttttgctcttggaattaatgccaccatgaccattcttgtatcatctgattacattttgtagacgttgaatgatacctaacgttaataaacttcagactactgagaaaatagaagaatataaatatgagggggagggggggagggatagcattaggagatatacctaataatgacgagttaatgggtgcagtacaccaacatggcacatgtatacatatgtaacaaacctgcacattgtgcacatgtaccctaaaacttaaagtataataataataaaataaaaaaatatataaatatgagaaacatctagctcagaatttctcaacttgagcactgttgacatttggggccagtagtctttgttgaggatgcctatcctgggcattataggatgttgagcatacctggcctctgccccactagcaccgtttcttccaattggtgacaactaaataggtctccaaatgtcccctggggggcaaaatcaccaccggttgagaaccactgctctaggtaggaagaataaaaaggaaagaacttaatccaaaaagaaagaatctaggttcatagaaaaacagattgctgcttagaaaactaaacatacgtaacttccaattaagcatattgtctttacagaaatttatcaaatatctagtaggcattataaaacctagtatacttatataatgaacctgtattgtggtggtcctagagatgagtattataacttcatcctggcattaaaaggccttttctgaaataattggatttttggcccagagtttagtgctattctgctaactttattaggaactatagatgtttaacattgtcactaaccttccctctttatctggaaaatcaaaagggaggtatctgtttttaaggctgggtaatgattgtagtgaatagctcagacacaactctagaagttgctaaagaaacagctttttaactgatgaattgcttatatccagttacttctatttgtttctcatttgatcaatgaatctgtttaaaagactcacacctttaaccaaaagagggcaaaatctgccctttctttattcctctcttcctgctctttattatttcttttttttacctttttgttttttgtggtttccattatcttacaaaaatatatttaaagacttgctgtgtggattcctcttaaccaccatataaactactcttttttcctgtgcccaaatgaattcccagattttactcaaagaccatttagagagttttaaggaaaacacatgtatttcatagagttgggtgaacaagagtgatagatactgttatgcaaggagagttactgaaatttggagaactaaagtttgtgtgccaattttcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctggtgagttgctccagaatcattcttgtattaatggaaagagtaatgtaataggaaaccagctgggtgtggtggctcacactctgtaatcccagctgaggcaggaggattgcctgaggccaggagtttgagaccaacctggtcaacatagtgagacctccacaaaaaaattaaaaacaaaaacaaaaaactagacgtggttgcatgtgcctatagtcctagctacttaggagactgagatgggaggatccctccttgagctcagtggtttgaggttgcagtgagctctgatcactccagcctcagtgacagagcaagaccccgtctctaaaacatagaataattggccaggcatggtggcttatgcctgtaatcccagcactttgggaggctgaggcaggcagatcacttgaggtcaggaattcgagacccgtctgggcaacacagtgaaaccctgtctctactaaaaatacaaaatttagctgggcatggtggtgcacacctgtagtcccagctactcgggaagctgaggcacgatcattgcttgaacctgggaagcagaggctgcagtgagtcgagattgtgccagtgcactccagcctgggtgacagagcaagaccctgtctcagaaaaaaaaaaaaaaaaaaaaaaacctaaccaaggatataaactgttcatagaaaacaaatattttccaagatgtttcttctagtaagagaaaatatagaaagaaatatagattaatgctatagtaatgccactgtcacctagtttattggcaaaggtaatttcatcacattctgggggaatgtgaaggaaagcaagctctttcatgtgttgcaggagttataacagttctgcttccaagaacttgtcttatggattacataaactaagaattatgtttgaggatatttacttaaagaaaaaatgggaaatggcttaaatgcctaccaataccacatctattcagtagatcttcattattttaaaagaatgaagcagatttttaggaaataataaactatcatgcctgaaatatgttaagtgaaaaagaagagtgtatagagtatgctaccattagtatttttttaaaaatagcatgggggagagagagtacacacatatccctgtatacttttctgtgtgcttattttgtctctgaaaggataaagaaactgttaatgggctgtgttcattactttgcactatactatttaaattttttaactagtaggcactgtcatacactattgatggaaatgtgtattgatacatattctgaattttgccagtagatcagaacagaactgtgtagctgtttctttaaaaatagtcatgcctttagctgggcgtggtggcgggtgcctgtaatctcagctacttgggaggctgaggcagagaattgcttgaacccaggaggcggaggttgcagtgagccaagatcacaccactgcactccagtctgggtgacagagcgagactccatctcaaaaaaaaaaaaaaaaaaaaagtcatgcctgtatacaaacatttattagcaaagatgttcactgaaacattttagaacagaaaaaagaaatagtaaatatccctcagtaagagaatagatggttacctctttataatgcagtattatgccctattaaaaaatcatgtcaaataacattgaatagcatggaaaaatattcagaacatttaaatgggacaggatggaggacaaaagcagattacaatacaaaacaacccttctcagtttgttacatgtttgtatctgttcatgggggtggagagtatggaaatttgttactgtataatagactattaactgttatcttcggctaatgagatggatggttttagttttcttcatgctttaaaaattagtgtatgctctcctaagcttcagttaagctgaactatttttcctgtcaagttatctccatgcttctattcatgttattacctcttccaggaatttttttgttttcttcatccttccctccttataaaactgggtcctgtctggggtgcttccctccatcttagaagtaaggacccatttgaagttatgcattgtacacttgcacagacttcatgtctttgtggtttatgaacactccctgtctgtgatccgtgaatagagaaggaagatggagtcatccagggttagggttggccaaatagattgtcaaagagtcaggggaatctggtgtgattagctgaggtagaggaaaggggatagaaatgttttttaccttttttttttttttttttttgagacagagcctcaccctgtcacccaggctggagtgcaatggcgcaatctcgtttcactgcaacctccacctccagggttcaagtgattcttgttcctcagcctctccaatagctgggattacaggcgtgagccaccacacccggctaatttttgtatttttagtagagacggggttttgccatgttggccaggcttgtctcctcctgacctcaggtgatcagcccgcctcagcctgccaaagtgctgggattacaggtgtgagcgaccacacctggcctgttttttactactcttaatccacacatttttgctatctttctctcccttaacctgtgtgtactacaagtatttgaggctaactgcagtgtggtaatgggcctataggaatacaaaccagtcttgctttggccaaaataagaaacaacaggaatgtctgaaatgttaggctaattcagtggtaaatttaagaggaaatcctaaatgtaaataccacttttcctgttactctgacttcttttccattgaatgtttataactgacatcttcacacataactcaagatttttttagtttagaaactttttaaagacaattgcttagaaatagtttactaaataaaagcattatttcctacctgtctccagaaagtattgtctaaatttattttctttatagattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcaggtaaaggatcttttcttcgcctctaaaatacagctgctgtcctgctaatgaggataaatagttattcactagcctcacccaaggtgaaaggcatattttcccctgttggtggatatatgagccatctgttgttcttgctgttaccgttttaaccttccctaggatgggtaaactctttaggtttaatctcacttgtttttcctttccttgtaaactttttttcccttttgggttcagaagagctcttttggcccaagaaagataatttagagcagctgtgcttaataagccgtgtgccagagtggcaactggtagttaagagtggtctctggagtcacactggtcctcttgtttattatctgtgtgaccctgtatcattactgactgtgactttctgtgactcggtttcctgtcttgtaacaatagggataactgtacatacctgataggaatattatgagaattaaatgaatgcatgcagaatacttagaaatagagaaactccaggaggaaaatacttgtccgcttgtaccagtagaaatgctatcctttaaagtgaagattaaatgtaaggtaatagaaggaacgtgcccaggaagaagtgttgtagtacagcagaatgcacatgtggctaggaattgaattatactgtagccaaggtcctaacttactaggtccttggctgagtaatttaacctctcggtatttgtttcctcaattttaaaataaaaggtttggttatatacgtgaataggatcctttcatctctaatgttttacaatcctttttcttgtttttccttttttttttttttttgtatttgagtataaaagcaactaggtcctaagaatcttagttttaggttccattatataagatttatcatagatattcctaagaaacttggagcttaaaactggcaaatttgtttgaatttttttaaaaatgcccttataaaaaaggcatcaacctagatccttgggagggacctggctttcctttttaaaagatattttactgaggagctgatgaaaaatgactagtgtggggttagcagatcgaataatttgaagtagaccatgcagtattcctaccactacaatgtaatcatcctatttgtgacagagaaagggaaaaaagtgtaataataggacgatgtacctataatttggataattttgagctattgaaatgtctttgtaattttcacaactgttgtccgttgtttgaggatgctacctactaaactgaaaacattcattccatatctactacatatacaccagcaacagtataaatttaagcctaactttgcaatatttataatactttagtgatggaattttttaacatgcagtatgtaaatgtgcagattttatgtgtgttgacaaaatttttcagcttgcaaaatgggactgcaatattacatttttcacttaaacaattttttacatctacgttgttgctttctaaaatgaatgtgaatgccatcttttatgactgcaacttgccttttccattacagaaatttttgtttgatgtaatcgataaattctggtatgattaaaaaaaaaaaaaggcctccaaaaaggaaaaaaaataggtgtaaattgttgtctgtagacctgaaatcccacttgcctgataatataaattatgggcagctaaatttttaatgtcttttgcttacacagggattctcctgatgaatttcctgtatatgttggtataaatgaagcaaagaaaaattgtataattgttccaaatggagataatgtatttgctgcagtcaagtaagaatattttaatttatatttgtttacaatgtttatactacattagtccattacaaagggggtttgaggggctgggcacagtggcttacacctgtaattccagcactttgggaggccgaggtgggcagatcgcttaggtcaggggttcgagaccagcctggacaacatgggtataccccatctctactaaaaatacaaaaattagctggaggcatggtggcacacacctgtaatcccagctactcaggaggctgagtcaggagaattgcttgaacacaggaggcggaggttgcagtgagccgagattgcgccactgcattgcagcctgagtgacagagtgagactctatctccaaaaaaaaaaacaaagcggatttgagacaagcccataattgtagatttctagagataatttccatgacttttgcaggtagtcttatctatactgttattttgtgcctcttcaccaaaaaaatacacctcttatgtaactattttacttaacgaaaataatacttgacctcaggtgttccatggcaacatcaacagttttgttagacatctgattttaaacacctgttaagagtttatttcttatgtatggttcaaacagaaaggcttaataaagtaaaaagaggtggtcattatatccttggaagggttgagggagcaggctgagcttccaggaatgacagttgtgtggctcacagtggattttgtctctgccaccatcagggagctgggaattcgagaactgctgccacagtgagtggctctaggaccacattatctttggtataatctgggccaggtaaatggatgccctactctttgcctctcagcccccgtgaagctaagaaccaggtgctgggatctcagctacagctgctgcagaaccatcagatgcctctacagctgtgctcattgatggagatcgtggaagcacagcctccatgtggtatctcttctgcctctgagatttcaaagtattgcagctgcttggaagaagataggtcccatgtggagcctgagctaaagagtagtatgggaaatgcagtgaactttcatggggaaggggttggaatagaggtgagtgagccagtctgtgctatatcagccacagacatgacttgaagccattttatttgtcagcagctgtgtagtttgcattgtaatgaagaaagcaaactttatcacttcaaatacaagtagattatcttttctttgacctcttttagtactgtctctttaaagggctgttgttccctgtgatttgatcatacaaatttgcagtaaagtgaattcaaactaaatcaccctactacaaccactagactatgctacgtacatactggtgtatctacaaggcagctacattgtagatgtccaaaaatgttctttcttttctaatacctctcagtttcctataaaatgttacttggtatttgtaatttataacttcttttaaactctttggatttatcattcaatttaaattggtgccatctttattagaaactcttgttgttttcttgcttattgtctgtctcttgcactagcatgttaagttccacgagggcagagtatctgccccatactagatgctccataaatattaattctataaataccttggcatgtaaaaacacctaattttttcaggctgggcaacatagtgagactgtctctttttcgaaaaacaagcctaacttttcatttgtgttattagtcatgtttttttttttttttttaaaaaagataacataatagtggtcatgtaacataacccaagactcttctggtatctttttttttttttaagctaattggagaacatagacaatgaaaaagaaaaaaaaaatacatgggtgatatttataacttaggtgaagatcagcaagtgagtatttgaggaactacctccaataatttatctcaaacaggggtaaaaaattacttgagatataactattttagtacttttaaagtattataacggttttagttttttaggtactacctccttaaatcagctaaccagaacacttaatttctttatatattttaaaatttatttttatggcagactgaataaggtctttcaaggcatacctttgatcaacacatttttatctttagttattattaaatcttgtgtctgcaagatttaatagtaactaaagaaatgccaatttaaccagcaaagattttttttaaaggttaaagaatggtaataaccaatgatggttagggtataagaacccttactgatgtgttaattggtaaaacttttgtagaaagcagtttgaaaaatgtttaatgttaacatttgaaaaatgttaacttagaaagcatattctaagatttcttaataggtgacattgtcaggtactatgtgaagtacacatttatacccttaagttagcaatttcacttctagctgtttattaaagggattttggacaggtacagaaatatgtgtattacagattgtttatcaaatgaaaaattggcaacatatccagcaatagggaagattaggtaaatataaactatccatatactataatactttggtattgatttgttgaatttgttatgaagtgggcaaataacaatagtgtagaatgattccatttcatactgtctaatgcatatggaagtaaacataattcttaaataactttgaacaacaaaggaatgattttttttttccttctgccttatttattttcctaaaataactggggtaaacagttttgaccttgggtcagggacccttaaggtcaaaactatttgtgataataaaatgttatttttgcaccaatggcacaaagtaaatagtggataatactgttgtcaccttggcaggaatcaagatagtgccaccagggtagcagcagtcattgcattattcacagcagtaacatgcaaatgtatttaaaaatgtttgtgatggagccaggcatggtggctactcgggatgttgaggtgggagcattgctcgagcccaggagttcaagttcatcctaaacgacatagcaagaccctgtgcctgaaaaatgtcagtgttggagtatacatgtattagatgtctaccattgagttcatctctttaacattctgtgatgaaataggaaatacatagaaagcatttctcatactgaagtactgtggtttgtctcaagggaaaaaaaagcccttgtatgattgaattttgagatgaacttttccccacttttagaaagagtgactcattgactgtgtgcctgtcaagattccctctggttttctggctagaaagctcacccatttccagtttctaagagtcagttcagtggcagagccaccagggacaagtaagactcttgggggtgctttgaccctgcctacctgggagcacacttttcccttccctgatgacctgggatggtggccaggccgtgcccttgctgtcgctgggcagtgtccttttggaaagggagctgccccagggtttagtgcagctgccaaccctgttaggcccggcctctcgaggcctcttccgacttcaagggtcacacacccccaaagatcctctcacccatggtagttgctgtgcatggttctgtctgtccgtgcacctatgcacacacaccaccccaccaccctactctgaaattggcgagtgagttgagagccagctctgtggggtcatcctgcagccatggttgtgcctgtccttcatggtggtctttcaggttatcttggcaacatgtacattgcttttctttttttttcttttttgctcttattgtacagtcagtactataaaatttctctttgagttttatacctttgtagcattttagatgacattgtgtttgtactttgttgtgtagagtggaagaattgtgttgaataaacccaagattggaatgcaaaaaaaaaaaagagtgactcattgacaaactggttatttgggtctagctactggcaggaattctctcaaatgaaccaaagaaaacaactgactatattttttgtcagtgataaaattcagggtttcaaataaaaattagattgagaaacttgtaataccactgtgagcgcaatagctttttttcataatgttatgtaatgaatttgatatataagtttcaacacttacatctatataacttagtaaaccactatttccaaagggccattgcatgatgccatataacatgcatgggtacaaattcatttgcgttgaagacattctaatggatttaaagtcacagcacaaaatgttcacgttcatggttatggcttcagttgcacatcgcaccttatctttaagcatcacacagtaaagtgttagagtaggtttcggcagagacaaaaacttacagagatagtcataataatgtcatatgtatgggaaggcagctaccaagtgccttcaatagtggcagaggtaaaagaggatattttatgtgggctttgatggatgcctaagaacttactagaaagaatgggaagaaggatgttttaggtaagggagcagtatgtgtgtgaaagtgtgaaaatacgtggcacagggtacttgaatggctatattgccgtgccagagtgttgaggaagactgtaaagatcgattgattcacataggactgacatgatcaaatctgtattttatggttgatataaaaataccctctagacatacagctggtaataattgaaggtaagatttagtgtaaccgtgtgctgtaatcagaagttagattttgatggcttgggtttctgtggcattttaatctaccagttctactggtaactctacgggtttaatctattagctctctcaacttgggtaagttgactatcctctgtgccttttttttttcctgataagtacaatgaagctaagactagcacccactataaatgttctaactccctaacagtgttgcagggaatactacaaactctcagatgttggcagtgaatagaagtgagtttcttcctaggagttgttactccctcagccttcttcctggaagtctggcacactcttgccgctcttcattttactcctgaccttttatattgatggcaaaaatcttaacctgtttatgacaaaatataaaattatttccataagtggcattaacatgatatatattcacatacttttgagaactactttggattatgcttttgtataagcttacaaagtagctttgctttccttttgtgttttctaaatttttcttaacacaaacttcaacattaaaaaaaaaatctatcgacctttagtgttataatagtgtcctgtctctttaaaaatgaaaaaaaaaaaaaaaaaaaaaaaaaggccaggggcagtggctcacgcctgtaatcccagcactttgggaggccaaggcagatggatcacctgaggtcaggagttcgagaccaccctgaccaacatgaggaaaccctgtctccactaaaaatacaaaaattagctgggcgtggtggcatgtacctgtaatcccagctactcgggaggctgattcaggagaatcatttgaacctgggaggtggaggatgcaatgannnnnnnnnnnnnnnnnnnnctgggcaacaagaatgaaacaacatctcggaaaaaaagacagttttttgtttttttttttgaggcagtcttaggctgaagtgcagtggcacgatctcggctgactggatggctgcaacctctacctcccgggttcaagtggttctcgtaccccagcctcccgggtagctgtgaatacaggtgcatgccaccatgcccagctaatttttgtatttttggtggagacagggtttcactatgttggccaggttggtctccaactcctgaccttgagtgatccgcccacctcggcttccaaaagtactggggttacaggcatggaccaccatgcctggtccctgaaaatatatacatatatttttttgagacggagtcttgctctgtggcccaggctggagtgcagtggcgcgatctcggttcactgcaagctctgcctcccgggttcacgccgttctcctgcctcagcctcccaagtagctgggactacaggcgcccgccatcacgcccggctaattttttgtatttttagtagagacggggtttcaccttgttagccaggatggtcttgatctcctgacctcatgatccgcccgccttggcctcccaaagtgctgggattacaggcgtgagccactgcgccttgcctgaaaaatttttttgatgtctacttttttttgatgtctacttttttttctgttaggtcagacttctccaaagtagtatgccatatcttagtatcaagtgatacagtttaaaccttgactaatctcagctttgcaaataccccttatacctttattgtagacattagagtgctaatataaatttgaatcgtatttgctctttctctgactggcagttttttatgaatattgcttttctcttatttgaagaaaactattagggattttgagagaagtgttggtaattattctgtggacttattcttgtatggaatttgacatttttaccttggctcaactttcaaaggtctttgtacttagtacagtggcctgccacataatgcggacttttacttctttttcagattatttttgacgaaaaaacttaaagaaataacggataaaaagaaaatcaatctcttgaaaaacatagatgaaaaactcacagaagcagccagagaattggggtactcgcttgaacagagaaccgtgaagatgaaacagagagataagaaagtatgatttcaacctgttggtctctgttttgctatagcatatttttttcccctcttgattccttcccatctctactttacccttctcttccctagtcctatcttaagaactggatgctgtcccttagggatgttaggaggatggcactgaaagaggatggcactgaaacaggggtcagatggctcctttgggttggtacactgattgaattgcgcaactggtgatatcactgctgtggttgaataactcatgccagtatttaccactcttttaatcttgtttaccatttaatcacttcataaagttaagtgaaagctgctttgtacataatgaaatttacatacatacattttctccagtaaacgtgtatataagcagtgctcctttctttttccttattaatcctatcatttccttttgcatctctcctaatgtctgcaatatgaggggagtattttgtaaaggagcaaatacttgttagtgttggattcttttggtttttcagctatagatttcagagtaagttaatgacaagctggaagatttctggtttggagtaaatgagaattctataggagtttgttcttatggcctctggggaaaaaacaaaaacaaaaaaaaaatttgtcactggaatgagggctccccagtctcctccagcctctcaccatttgtctgcccatgctggttcatctgaatgttctaagctaaatggagaacttgctattccttaataaactagcactggtaatgaagtaccttagtgtacttaggcattaaatcctacttcagttccttctctgatcttgattcagctgcaggggtgacatttgtatcaagttctaggcactctttagtcctatagactggaaagtttcttaaaacatacattttaatgaaacccattacaatatggcattttaaatattaagattttatattgccatttacctttctggttatcacaggaagcttcttccactttgtgactaggaggaagggtagcatttgtaacctagttaatgtatttctaatttgttttgactaaagtctgagcatccgtacacataatagctgttagcaaattatttaatcagtctttttttatttttctaccacaagctatgatttatttcagaggagattttcttaattcttccccataaagaagatatgattgaggtttaaatttcatagatatttttgtcctagacccctcccctatgaagtttcattttagtatttgttttttatacaaaaacagctggtaaaaacaaagacaaaaaagaactttcaagacaatcatgtttttaatcctcccctgttaatgactatactttcaaacccttttctgttaaatgcaaggttgttcttttattgtttttgtgagatcttcattgaattcatatttttctactgaagaattcaattccactagtatatgtgagttagtggctttgtccttgtgtgtgagcgtaagcatatttccactctagtatgatagagcactgtgcagcacactagaaatcagtgtttttatactgatagtaacttagcatactttggaatgcagagtctttatgagttatatcatttgactccctacaacaaatctgcaaagttggaattatcctattttatagatgagtaaattgagggttatagaggttttgtgtcttgtccaaaatcttaaatgacacatgtaaaacccaacttcatattttccatatttagcattctttccaccccatcttcttactaattggctctctgccacttcacctttttcatacctggatttcttcataaggaacgttggttaaatgatgcataaaatgatggtgtggcactccatccacctgtgatcccatgcttcaggatgtcacccacccctatacagctttcctaaatttgtaatcttattcttcttaatttcttaataaaattacaattctgatgacttcttaattgattcctcttcatggacaattagtacaggtaatcatctgtgaaaaatctgaacatattaccatcattctttatgttgttcagcctgagctggcaactatagcactgctgtctttttctttcattatcagtgctttatgtcctgctttttacacttatgaatatggtatctttatcatttcatattgccaatttaagatctacctcataattttgagcggctgcagaatactgtgcttatggtcaaagtttgggttgcttaagatttttcacaaacacaatcctgccatagatatccttttatacctttattctcatacttatctggttatttttttagaagaaattcctagacgtagtattgccaggtccaaagtagtttgtgtgtgtgtaggtgtgtttgtagtttttctttgcttgtttctaattttggggggttttctttagtctttttagttttttccatgctggtaggtataaaattctgcagttttaattagcatttctttaattataaaggacgttaaatacttttctctgttggccattgtattttttttttaactgcctgaactctgcccatttctctatcagggttagaattagtctttttcttacatgtgttctaatttggatgttagtcttttcctttgttagactcccttatagtttaaagacattaatttttatttactattacattttgcagatatattttatcagttaatttgtcttgtgtacttgatttcactggatagactttttatttttatatagtcaactcttctctatcacaaaattattttttaaaatttaccttcgagtagttttatgtctttattttttatttattatgctttaaattttagggtacatgtgcacaacgtgcaggtttgttacatatgtatacatgtgccatgttggtgtgctgcatccattaactcgtcatttacattaggtatatctcctaatgctatccctccctcctccccccaccccaccacaggccccagtgtgtgatgttccccactctgtgtccaagtgttctcattgttcaattcccacctatgagtgagaacatgtagtgtttggttttttgtccttgtggtagtttgctgagaatgatgggttccagcttcatccatgtccctacaaaggacatgaactcatccttttttatggctgcatagtattccatggtgtatatgtgtatggttttatttttacatttaattctgaaatccagctgcagattatcttgatagaaagattaagatagaagacaatgacttcatttttttcccaagtggtaagcagttgtctgataacttcctttgaataatctgccctttctggcagcttaataaaggataatgaaagaagcaagagactgggagaatagggagattagagagaaaaaaatctttaagatatagagacttaggtgagaggcctttaaaattggagtttggtttttgggttgtgtccttcctctgccttggaaacttttcactgaattgcacaaagaagtggaatatttgtacagatgtttcgctaaggaaagacctaaaaataatgtcactaacatgagctaaaggaagaatggaaactggaagggttatggtggtagttgtagttgggcctgtttttgtctttgaagactaccacttaataaaagctcactggttatgtgatttgcctccataaaggacaccacaaacctagaaactgccctacttttgggaagtttgcagagaagcctaaatattccaggtaaaaataggggagtctcaatttggcaggatggatgagaggagttctgtcctaccatatcttcttgctgacaagaactatttcttactctttttcttttagaaccaggttcctctgtgctttctaccagaaggtactttgaccttagaggaaaccaatattttgacttgccttctaggatgtattgggttcttccttaacaaatcagggtgcagacttccaagtgactggcacaattaagaaaagccaattatttcactgttctgtgattacttcaactgtttaacttttagctgattttcaagaaaaaaatagtgttaaatttttaccctggagtccaaatttactgaaataaaatgtgattaaatgttacattttggcagaaatgttgagggtttatgtatttggggatttttttttttgatgtctgcttaccatgattacattttattcttttctttaatgtaggttgtgacaaagacctttcatggtgcaggcttggttgttccagtagataaaaatgatgttgggtaccgagagctccctgaaacagatggtaatgtatttcatagtaaacatgtgcatatatgttaatgcacatgaataaaggttttgcttatattgggaagtaggtatgtctatataccttttctgacacagtcgctagaccttagtaataaagagtaagctgaggttttagagtcagtcattcctgaattaaaaccgagttcatagctgtgtggccttgaacaaattatttaaccctgtgaaatcttgtctttttcatctgtaaaatggagctaatcatatgcacttcataaaggaatttgtggtgtaaacaagtattaaaatacttaacaaaatgcttgcctcagtgttcaaaattcagtagtttctttttttgtttgttttttttttttttttttgagacggagtgttgctctgtcgcccaggctggagtgcagtggcgcaatctcagctcactgcaacctccgcctcccaggttcaagcgattctcctgcctcagcctcccaagtagctgggattataggcacccaccaccatgcccagctaatttttgtatttttagtagagacggggtttcagaattttaacccattgcctgcttcttgggaactatttccgaacctttgacattacagtcaacttgcaaagtagtaattattgaaattgtgtttttatggttctttgtgaacattttttcatctgcctataaaatgatttagctttcagaagcccaagatcctgaactacgtcatctgtaagtataaaaacactttgaaaatggaccactgcacataatctagttattgctacgttaaacatcgagaattaaaatcgcttctcaattcttttccccttgtctccattcccttatcgtgaacagccctgctggtattcctttattgatcatcctcttctggggggataaaacttaaagggaaatcaaacttagcatcttctcaaagaaccacatattcctgcccaatgcacgtatttggccgtctgcttttcagaacagaactaactagccttggtagttaccagtctctggggggttgtgacctggacatctgcatttaaaccaattctctaaagcagttcttctcaaattttactgtgccagagtctccagccagtaggtagagatgtcttagatggcagctactcatacgggacctgtttttgctgtacccctgccacttagaggagtgccatagggaagacgaatgtggctgagctgtccagtgtgatggccactgagtgcctcacaggtggctcctgcaacaaaatttgtaactcgtatttattttttacttctttttttttttttttttgtgacagggtctcactctgtcacccaggacggagcgcagtggtgcaattaacctgtctcggcctcccgagtagctgggactacaggtgtgcaccaccatgcctggctaattggtgggttttgtttttgtttttgtttttgtcctgtagagacggggtctcactctgttgccgatgctggtctcgaactcctgggctcacgtgatcaacccacctcggcttcccaaagttttgggattataggcatgagccactgaacctggcctgtaattttctataattttaattagtttaagtttgtaaattaaaacaggattaaatgtttcttacattgattatatgttgacataatactattttggaaatatgggttaaataaaatatcttaatttcacctgttttttgttgttggttttttttttttttttttagctccttctcctgccccacctgtttcttttttcatgtggatactggaaaaaatgtaacccacactgtatttctcttagacaggctgatctgtcctatatctcctctttgaagccagagtcaattagtctctgatgggaccattgtgggccctagctactggtcagtcttctgcttctacactaagtcatcttctcttcatgtctctgctcacagagagagctttaaaaagcatgattactatctcgtttgggaaaggttgcgcacatttgttgtagagatgggcagtctctaaagcttttggggtgatggatgttaaattgtagtgccctggagtaaagcctgttaccctgcggtagttgtggttctggggttttatatccaagtctactattctaggcattagatccttctgtatttaattagttttgaagtggtagcaaaacattaagactgaaggacctaatcttcttgctcttgccagtgtcatttgccaagaggtataactgactggcagtttgttaatgtgacaatgattagcaaatcacaactaagtttgttcttaaccctttgaagcttctcacaataacgctttaacttagcaaataagatacgttttattgagcaattcttaaatgtcagtgtcatgattcactttaacaagtgatgtatttaattctcacccaactctttattgtaggtcttattcccatgttcacaaaggaaatagactcacggtgcttagcattagtcagtaagggctctggttttctttttttctttctttcttctttttttttttttttgagatggaattttgctcttgtcacccaggccggagtgcaatggtagggtgtcagctcactgtaacctccgcctcccaggttcaagtgattctcctgcctcagcctcctgagtagctgggattacaggcacccaccaccatgcccagctaatttttgtatttttagtagagacagggtttcaaccatgttgatcaggctggtctcgaactcctgacctcaagttatctacctgccttggcttcccaaagccccggctgagggcactggttttcatacttggttttctgactgtagagtgcatactactatccgaagtaagaagagttgcctgcctagttgcctgatttttaccttgacagaactactgtagcttaatttaagtattctagttgatagtagtggcagggatatagtaagaattcagcagtgaaactcctaactcattaaattgagtattttgagtagaaacatttaagtcatcatttttgaatagttaacttaaggcttcactcatgttctttaagtttgggtttcagttaaatgaaatttctgtagaatgttttattgctggaagaacatatttttccttgtactgatggtgagctgaatattttcatctctgttcttcagtgtttttctagcttagtaattcgcataagttgcttattctttttagtccatatgtgacttgccaggtgtaaaaatagaaaataagatactggaaagcgataaactttaaattcttcacttccatacccaccctgatttgtagtggctgactggagcacagcgagagagattctaagggtcccagtcaatcagttacacccacgataacagggaggaaccacttattttccatccttaaggagctttttggagaaagcttcatctgttttcttgaaatgatcagcactgatttttctgaagaaaggaatgtcatgaagctcatgtaaaataatttaatttgtaaaaggtttcaaaccaacaaatatgtcactactgtttatagatagttagaaacgtaggtggtgcagtttgccattcgttcaatgcgatactggtccaccaaaagtgggaaagggaacaacacattttgtgactggggtaacagcatgtattctgtactgtcgtcaagactgaaccaaatgttattcatagactggggttaaaagcactagtatatagtatatttttaataccatccttggtaattttttttttttttttttgagacagggtcttactctgtcacccaggctggagtgcagtggcatgaccacggctcactgcagcctgcacctcctgcactgggtgatcctcccacctcagcctcccaagtagctgggactacaggtgtccaccaccaagtccagctaatttctctattttttgtagagacagggtctcaccacattgcccaggctggtctccaattcctgggttcaagcagtcctcctgcctcagcctcccaaatcctcccactaggattacaggcgtgagccactgcgctcagcccgtccctggtaatatcatacctgatatttttcgttagtctcatcagaacgttgtgcctcatacatagaatttaacatcacctatcattcttgagtataattgttaatgttttaaccagtcttcctctcccccagtatggcagccacctgtttggaaatgttttgttggtttgtttgaataatatccattcttttcattctcaaagaagtactgtttgttaaaaaggacatacaatttgtcaaaaggaagtctaaatagatattgttcatacttccatctcatttgcgtcctgaaatcggatgtacattaacatccagaaagaatgaaaaaaatcttgaaagccaaaattgaaatgttaatttgtaaaaatatattctttaggtaaatattagacattttctctctattcttacctcaaacgcatgcttgccatgcctactcttctcccaatttggtgaaggttttagttaaaggtttaattctgcagtgatttcttgtctcttacattgttgtctttttctgggtttagttcaccacaagtcacaagtcagtaattttttttagcaaacaaggtaggacagggcaaaaagaataaattttgcctacttggattattttttaatccagttgtcttagtatcaggacctcgaaggatacccagaatctgatgctcaagtccctcaaataagttggtgtagaatttgcataacttacgcacatcctcctgtatatttcaaatcatttctagattacttagaatacctaatataaagtagacactatgtaaatagttgttatactgtatttttaaaatccgtatgttttatttttttcctgagtatttcaatccgcacttggtttaatcgaaggatgtagaaccctcagatacagaggcaactatatagtgcatgaaccaggctggcagactttccatgtacagccagatagtaaatgttttacactttgtgggctacataatctatcacattcttgtttgatttttcaaccatttaaaaatgaaaaaaacttagtttgagggcagttaaacacagggtgagccaggtttgcccaaagtttgccaactcctggactagtctgctgaatctttaaagcttatgtaaatgcatgatgaccaccatggaatagactttttaaaaaaatcatgactgtatctgggcccagtggctcacgcctgtaatcccagcactttgggaggccgaggcaggcagatcatgaggtcaagagatcaagaccatcctggccaacatggtgaaatcccgtctctactaaaaatacaaatattagctgggcgtggtggcatgtgcctgtagtgccagctacttgggaggctggggcaggagaattgcttgaacctgggaggcagaggttgcagtgagctgagatcgcaccactgctttccagcctggtgacagagcaagactccgtctaaaaaaaaaaaaaaaaaaaaaatcgtgactgtaactaaatcctgtgaaatagtcgttaataaagaaatacttgttaacctgtttttaagcttgaatcctaagtagaaaagttaccaaattgccattctaaattagagtgctgaagactactacccaaggtggcacaagttgtattagtacaaagtcttaggaggaaaaaccctctttataatcttcttacttttgaagactgattcattttctaactatgtagataatcttttatattattgatttctttcagctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacatgtgagtaaaaaaaccctccaccttctacccactgccacacctccctcctctccccgcgacatacatccacacatgaatacgtgcacatttatacccccaaattccagcagaggtaagacagggattcagcttgtatttcaaaatgaagtttttgaagtgattttttttaacgtagatgtcctaaaaatgttttaaactcatcttatattctggcaaaggtgaatatttgcattcactcaaaggtgaagattatttgcattcaggcttacattaaagtgaatttactcattagacacattatagggacatgccttcttgccgtgtgtgtacgtttggggctaggtatgggggtgtgtgcacacaccttaggctccatttcgtttccattgtggtgggggtatttgttattgtgcttaaattcttagatgaaaaatgcactttaaattatttaagctttataagagatgctgttttaccgttaactaattgctcattaaataagaaaattttacttaatagctaaaccagtgcttactcgaccatagttgcctgaagatcaaagaggcaataaggtgtagcggatatgacctgtttctggggccaaactggttgtaaatcacatcttcccagtgtgtaagatcgggcaagctttccaacacctttgcatctgtttctttacctgtaagatatgtgtgcacatgtgcacgagtgcatacccacacgcagatcatttaattctcatttaacctactttgtaaccaagtcacagagaggcaaagcatcttgcccaggttcacacaagcagtctggctccagaatcagtgcctaaatcagtgcagtaattcccaaactaaaatgcatatgactcacctgcagacattgttaaaatgcactctatcggtaggtccagcatgagatctgagactgcatatctgtcatgctcccaggtgacggtcatgctgctgctctacagaccacactgggaaaagcaagaccaaaccagtagctctccagctttagcgtgcatcagcgtcaatgggaaggcttgtccaaacgcacactggcagtcttcccaccctccccaagtttgattgagttctagggtgggtcctgagaatttgcatttccaacaagttgccaagtgaagttgatgctcctggtcgggggtgtacattttgagaaccctgctataaaccatattatactacttttctttgcccacctcatagatagttatcagtaaaaataatcaaaatgcttaacagccagaatgacagtcattgaccaatccaaatagtacttgacctgctagagaggccctagccataaataagtagagccataagatgtgaaccagtgaatagcaaacttgcttgttgtgagaatgaaataacatgtatgagttataaaaaggtttagcacagtgcttaccgcatgttaagggctaaatgtttattatgatcagcaaaacggtggtatatgtagataatagcagtaatctcaaatcttttgataagcctaaggcagtgactcttaacagggattgggaggcggtacgtgttggggatgggggagagaaggaatttgaggataaaggcaatacgatctgaaaactttcagcatagctattcttacagaattgaggaaaataaagcttaaacttttgcctgggaatacactagagagaataaaaagtatttgtgggcattgtttggggtgagaaaaagttgataaaacctaagggaataaggaagctcgatttaatttggttttcttaattttcaagatatgccattagtcatctagagcaacaagactgcctcttagaatgccaggcgcctgtccttaaattatgttcactaaccacctgagggtgtagctaaaatgattttggaagtagcctttgttaaacaagtgctttgttgatatattttctgctacttattaggatatctgctatattctctgcttaatgttatatttttatttttcagtattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtttataaggttcttctgcctggttttccttctttaatgtgcaaaaaaatggcagtcaaatcacctaaatggtgaccctaatcacattttggaggacaattaaagtcaccctctgatatgtcacaggaagccactgtctaatgcctgtggctataactagaccatccttacagagtcctgtttcaatatttatcatatgggcaactaagaatatttcttctgagtcttgagttaatagctgtagctttaaggatcgggtttatggcaggagaagaggggaacagaaggaaacttagaaggagactcatgacactgcaataagcactcttccagggtgcctgaccccgacctacccaaactgcattttgagtagtagctccaggtgactcccagtaagtagtccagttatcccattaggtatattattttaaatcttctcttgactcagtcatttactaatacagtctagtatattgatacatagtatatagttttagtataagatagtaatcagtataccattactttagattttaaagtttttcattgcaaatgatttcaatggatgtttagtacgaatctgtggatagctgtgttttactagatccagattttccttaaacctgattacatgtccttcaccttaaaagtagagggcagggccgggcgtggtggctcacgcctgtaaccccagcactttgggaggctgaggtgggcggatcacctgaggtctggagttcatgagcagcctggccaacgtggtgaaaccccatctctactaaatatacaaaattagctgggtgtgatggcaggcgcctgtaatcccagctacttgggaggctgaggcaggagaatcgcttgaactcaggtggaggttgcagtagatagccattgcacaccggcctgggcaacaagagcgagactccgtctccaaaaaaaaaaaaaaaaaaaataggtagagggcagaccatgaaatgcagaatagcaaacttcctggatggggctgaggagtgtataagcttttttcccctttctatgaagttcaacatggaaaagcaccgtccccccatcccaggtcatctagttaaacctccacattgtgtaaaattgatgtgatttactcaaataacttattgactagacagtagttctccaaagttctgtcagctgtccccttaaaatatatttgaggtacttactcttttttatataagggtatgagtaaactattaaaagacaacacttagaattttaaatataagtagcattcctcatctccccaattaggctgcaagcttcttaagggcatgtattttatggatgtatatccccctcagtaacacaaacctttggaattgcactttgtgaataaaatgaccctgtcacatgttcttcaatgctagacagaatcaaactggcaagagctgggaaactgataagatgcctgggagttaaggattcttgacttctcagacaaaaagtcttctggggtcaaaaatctctgccacaaacaaaatctgttcctttctgccaatggctcatgttgcctttggaggcaggtaagatgctttcttcaaggtaggtatattttgtataatatcttaaccaaaatgaaactgaaaagatcttcagcttccctttcataactgtgcaggaacttttacagctcttaatggggaggtcttaggttttaaggaactgccattttagttaggtaagtagctccaggccctggaaccatctgaactattaacttgttttatattaaaacattacagttacagttagctcacacatattttattagaaaaagtgaccaaatcacattgatcttaaatgattttaggctataaattttaaataaaatgttagaagttcgagctttgttcctcagatttctttagtttctaacgggctcaaccatttctaaatactgcccctaatgttaacacacttaaaaaatatccaaattcatgtatctcattaaatatttgtttagctagaaacattagattcctttaattttgtcacttggtgatccaacagtctcaactgtatagtttgtaagattttttttttatatgctttatcagtaatatggattccagaaggattttttatcaaggaacaaatgaaaggggacaaaaaaggtgaatcggcttttcatccattccttacagaaacctaatatgaatgtatcttcaggaagctgggcacatcagagccaagacagaaattggacacaaactctaagaatatggtggttataattcagatgatacagttgtgaatggagtttcctgaagacagtaataagaaatgtggatttccagtctcaaactccaaccagttgtgtcagagtgctactaacctgtttcaggaggtactatcttccaactactgaacatttttcattaaagagcaagctccctacaggaagataccaaattttatctttttccttaactaaaggcatagtccacttaaacctagttcactaaatattacctaggatctggtcactcaattgctatagtagcttccaaatggcatctatatacctctgttctctgagaacacagtttaagtgcctaggctctttcatgaatgaagaaccttgatccaatcaggatttaacagaaaatcattaccagttcacatttagctaagctcacctcttggagttcaataatggagtttctgtataacctctcaaacatgtatgtagaataacacccaaggaaaaatgaaagctgcaaaacagattgctataaactaatctgcagtgtcctaagacctttgcattacctcaaacactgaccttaccagcttaatggcattctgtccaaactattcctatcataattaattttaatgtctggctggacacggtggctcacagctgtaatcccagcacttcgggaggccaaggtgggcagacagcttaaggccaggagttcgagaccagcttgggcaacatggtgaaactccatctctactaaaaatagaaaagattagccaggcatggtggtgcacacctgtggtcccagctactcaggaggctaaggtgggaggactgcttaagcccaggaggcagaggttgcagtgagccaagatcgtgccactgcactccagcctgggcgatggagtgagactctgtctcaaaaaaaaaaaaaaaaaattatatatatacatacatgtatgtatatatatatatatgtaggtgatccctacaatactctaacctctcagttccctgacttactctttcaatgatctagattagggattgattgacaaactagaaactagtaccttctcagtaccaataatgaaaacctcccaaatctcaatctcaagcatcctactgtcttaacatcatcactcatccttccatctctttccctctagtaccccaaaaattttttcaacacgacagtcccctacaattcacaaatgtaaccacctttttcattcttcacccactccattcctgattctctctttaccgagcctttagattctactccccatcattacaatcacccccgcatcctccactccactgcccttctctccatttgttgtatttatctgttaaccttaaggcagatttttaaaactgcctattccttaccagagtctgctcagtatcaggtagctggagaaaaaacacaaccatggcagcttgtcttattttaacctcaagttggccacactggatgcccatcgatcctactttctcatctctcaacccccaacccccaccctcatcctcagtttatttcactgagaaaatagaagccaccaaaataactttaacagaatcccactgccctaccaactacccaaggaaggttgaatgtgtgcccaagaccccatcctcccttgcctactcgaggtcctctcctctatttttcctctcaaacattcctatcattaacaaaaaggctataatttcctgcatcttaaaacccgaatgttctgattaattttccctgtcaaaccatcaacaggaaaagaagctataatatcctgcatcttaaaactatcacgtattactttcctggaaacctgataggaagaattggaatcgttgtcttcaattcttcaaatctctgttggacccactcctttcaggctttggcttgccaccatcgcgctgaacctactctgggggaagttatcagttctctctttattggtccattttgagccctcatttacttcacctatcagcaacacgggacagttaatcatcgctccttgaaactattattcatttggtttaggggactacccttgctttttgagacagggtcttgctctgtcacccaggctggagtgcagtagcaccatcttagctcactgcagcctccaactcctgggctcaagtgatcctcctgccttagcctcctaagtagccaggactacaggcatgtgctaccatgcccagttcatatttttatttcttaattttttgtagaggagacctagtctctttcccacgctagtcatgagctcctgggctcagatgctgctgccccgccttggcatcttgaagtgctacaggcctgagctaccacacgcagcttattttttaatatatccaccagtggaatacccttctttgaaggtcactactcctaacccaaccatactggcagctccctcatttgctggctcctcacctccccaaatctaaacataagcatgtgtcagtgctcggtccttgtacctcttctctgtctgcattcaatgcacggtactctcctgtctcaggatgatgccgcccctgtgtagctctcaggctgggcctttctcctgaactcgagtctgatacatgctaatgcctatgtgacacccccacttggaagtctaaaagacatttaaaacaatgtctaaaaccaaaattcctctgcacacagcaccccacccccaatctattcttaagtctttcccaactcagccagtggccattccattgttctgtcattactcagccaaaaactttgcaggcatccttgactcctcacttaccacactacatccaacccattcacaagtcctgtccattctaccttcagcatgtctcgaatccaactgctttcaccacctccaccagcttcaatcaggttcagatctctaccacatctcacctgaattattccaagagccttctagctggtagcctgcttccacccctgcccccttatagtctattcccaacaaaggagtctgagagatattttaggtcacattatgtgacttttctgcctcactggcttctcatttagaataaaaatcaaatgcctacacccccaacctctttccttaccactttcttccctcttatccctctccagccacagtgatctactcagtgttccttgaacctggcaggagaatcctttgtatatagcattttctcttcttacaacattttttctcacggataaatgtccttctctaactttctgtaggtttctgctcaaatgcttccttatccctgaggctttccctgatcaccctctataaaaatggggtgggtgcacacaccttcactttttgtacattacaaaaactataacaggattcttgactgattttgtatattcgtaacagtgtgcagtacataaaaatccttttttaaaattgctgaactaatccatatttatcaccatctgacatactctagatttctcttcctgctggaatgaaaacttcaagaacatagaatagcgcctggcgcccagtaattgctcagtaaatactcagtgaatataaatgatctactctgaacttttagtgtgttcctttttactaaaagcttaatagtaaaagaccacatcttaatcaaaggttgttacttaccaccctcttttggcagttctattagcaaatgtccaaggtgattttttaaagacatgtaaataaatcgttttacctcttttcatgcaaatagcgtaatttttcttgcgaaaaaaaaaaaaatcacttttgaaagtgagctgaaatgaaatcagttttctgtggacctgcagctttcactgacaaatgggggcgctaaaccattgctggtggtatgaacatcctgctgtcaatccagcatctatctactcttctattgctccttgcttgcaaagtgtagaaatgctttgtaacctgagagaagcattataattattacctttttggggctccctgtgccaggcatatcggcctacactgcgtagggcagcagtgaagagggaggactgttacagatataattaaaggccaaaccacacattgtcatatagattttaatagattttctgattaactcatcacagtagtcgtttttactgtaatgatatgcagctttactacactagtataaataaaaacagataaatacagctctaggcaacattacagattaactaagcattcttcgtgaaccaaaactgaaaacaattaattattaagaagaagagatgctgacacccttgcccattctcatcataccttctcaaaaagggtattcaaacaaggcgctacacttattatattggtaaattaatttgccaattagccaggcacaacaatttcatggtctccactatttcattattttggttgaaaaggagacacacttcaatgtatgaaaaagaaaaatggaacagataacaccaaagaaaaccactaaatgcattaaaaatacggcacttttcctgtattttagcagtaagatagaaatactagggatagaaatataccaaaaaacaaaattaatgctttaattaatatccaccctgaaatgtcagtctctgaagcaagatgggcaattaaaggaggagcagaaataaaaaagggaaatatgataaaataaactccatgtgaagttttacgaagctatctgcaaagaaaccgatttgtcctttgaaggctattaactcaggacaattaagttatccagcagccatgctgaggagttcatagtctagcaatacgttgcacacaggcaaatacacttaagacgagttggagatatacagaactatcatttagaaatgattttactctggatggctcaaaaaactttgaaagggctatgaagaaaacttgaagtctgtcaaaggagagaagtaataaggaataattttaggcagatagcacagctaagaatgtttcccaaaatcccgaaaattttgctcaactttcaatcctcattcttatatggcttcatgatcttatgtcttcaggatcttacagatcttaataggtatactataattaagaactaggaagtgaagaatcactttcaaaatgtaaaaacagctcattgccagttgtgtttcagaaaatgtctgtctgggccaggcgcagtggcccacgcctgtaattccaccactttgggaggctcacgcaggcagattgcttgagctgaggagttgagaccagcctgggcagcatggcaaaaccccatctctactaaaaatacaaaaaaattagctgggcatggtggcgtgtgcccgtagtgccagctacttgggtggctgaggcgggagtatcacttgagcccaggtggtcaacgctgcagtgagccaagaccatgccccactgcactccagccaaaaaaaaagaaaatgtctgtttgcaaaaatttcattttcctatcaaaaatgcataattacagaatatttagcccagtcctttgagtaaactgcctttgccaattgtgaattaaggctgtgattaaaacagacaattccaaaaacaaaaatcccaaatataatccagtgcattttaactcatcctgcaaaaaatgttcaaaccatcactgaccacttcaaatatggacataacctagcccgagattcaaaggttattttcagattaaaattttaactgctatctttgcaattctattgttttcacatttttggtttgattttttttttaagaaggtatacacgaactttcggttttattctccaaagtaatgtagtttttcaactttccagttaatgtagtttttcaactttccagttaatgggtcaaaatggacaggtcagaagacataatccagaggatggcagtgaaagatcagagaaaggtttatgtgcacactggatcacagagagagaaccacaacctttttttaaacctttgttcccactgtaaactttgttcatatctctgtatttgtaagtctgaattattctataaaaatcacattaaaaaggtaaaattacttaagtgcaatattaactgatctgtattttataaattttaatccataaaaatataaataagaatggtaaatttttaagaaaaaaaatatacatttagtgcaagttatgaattacatttcttcttcagtgtcagccatgagatatcttgagaaaagaaaagaatgactgatctaatttcaattttaaaaattccagtgttttaacatgcaattaataccagatacagctaatcagaatacttccttctctttactgtcaaagcagcagcattttatttaattatgctcaacagcacttgtatatcatagtagtagttttagaaatagaaaatttgcataagacccggtcacattatccataaagtctgagaggaaaacaaaaaagaaaactttatcctttaaaaccaagcttcattgttttcggttttgagccacacggcacacaatgagagatttcgttctcgcttccttcgagactttacctgtttgatgagcctttgttgtggtgcatgtgtactgttccaagcatttagtgatggtacaaactacatggttaatggcacaagaaacactcccttcttgtgatgaaacctcagtaaaatcacagtacatctcaatatgagaaaggactgcttcaaaaggatacaccgatttaaagaggctttgttacagctcagtagagagagagagagagagagagagagagagagaaataaaggctcttctggaatgtagaaaggtaatgcttaactatacaattcatgaattaaacagaacagttttgattaaaaaaaagggcaagaccttgcagttttatagatggctcaattcaaagtaatccctctagaaatagggactgataatgtgtctttgcaatgttggagcaacaggccaggtgctcgaggactctgctgtcatctctgttgaggcgcaagcctgcactatcaggcacatcctcagctgaatgcatccagtgcagaacaataggagttgatacgctgctttctgttagacgggaaatacctcactcctttccttctctctcctttccctccccaaacaactcctccattccaccagcattatttgcaaaccatgttgcaaaaacccggcttttatatttcctttctttttttgtaaaggaggaaaaaaaagtagatgactccctcaggttaaagagttgtgctattcaacaaataaacttcctcttccgtttcttctctctcctcatctgtgagattcagttgaacattattgaagcggggtcttggtttgccgtctgggccatatgccggaggatatctttttttgttataatgccaaggaggcgcctgaaaggaataaacagaagactcctatgaaataaaagggaaaataaaaggagaagctaaatctatagctaaatcctttttgttgacaggaatagagcaaagcaagcagcctgattttgtatttccaaaaagtactttattggtaaagatattaaaattatccagcaaccatcctttggtataaaaagttactatggtcactaatagtatgacagcctttccaccgagagtctgaggactgcatgcctcaatgaagcagagctattttgattaatgtatgccaacaaaaaagtaacaaaaactggatggatgtatgactaggaaatgatactgatcccatttgagaaggaaaattgatttccatcacatgaagagagcagtaaaatgatgaccaaatcctctcaatattttctctttttcatttatttatttatttatt

SEQ ID NO: 425 - DNA, 1189 bp, Homo sapiens
gatcggggaattctgctggcgctgcagctgcagaatggtcggcggtggcgggaagcgcaggcccggcggggaggggccgcagtgtgaaaaaacaactgatgtgaagaaaagtaaattctgtgaagctgatgtctccagtgaccttcgaaaagaagtagaaaatcattataagctttctttacctgaagatttctatcacttctggaagttctgtgaagaacttgatcctgaaaagccatctgattcactttctgcaagccttggacttcaattagttggtccttatgatatccttgctggaaaacataaaacgaagaaaaaatcaacaggcctgaattttaaccttcactggaggttttactatgatcctcctgagttccagaccattattattggagataataaaactcagtaccacatggggtatttcagggattctcctgatgaatttcctgtatatgttggtataaatgaagcaaagaaaaattgtataattgttccaaatggagataatgtatttgctgcagtcaaattatttttgacgaaaaaacttaaagaaataacggataaaaagaaaatcaatctcttgaaaaacatagatgaaaaactcacagaagcagccagagaattggggtactcgcttgaacagagaaccgtgaagatgaaacagagagataagaaagttgtgacaaagacctttcatggtgcaggcttggttgttccagtagataaaaatgatgttgggtaccgagagctccctgaaacagatgctgacctcaagagaatttgcaagacaatagttgaggctgcaagtgatgaggagagactaaaagcttttgctcccattcaggaaatgatgacttttgtgcagtttgctaatgatgaatgtgattatggcatggggcttgaattgggaatggatctcttttgctatggctcacattattttcataaagttgctggccagcttttacctcttgcatataatctgttgaagaggaatctgtttgcagaaattattgaggagcatctggcaaacagaagtcaagagaacatagaccaacttgctgcatgagtaaggtggctttgattggtgtacagtatttcaaaggactagtattaaacttgtgatttttgttttgtttttaaggaatacaaaaaataaacatttactaaaaacgtttataag

SEQ ID NO: 426 - protein, 346 aa, Homo sapiens
MVGGGGKRRPGGEGPQCEKTTDVKKSKFCEADVSSDLRKEVENHYKLSLPEDFYHFWKFCEELDPEKPSDSLSASLGLQLVGPYDILAGKHKTKKKSTGLNFNLHWRFYYDPPEFQTIIIGDNKTQYHMGYFRDSPDEFPVYVGINEAKKNCIIVPNGDNVFAAVKLFLTKKLKEITDKKKINLLKNIDEKLTEAARELGYSLEQRTVKMKQRDKKVVTKTFHGAGLVVPVDKNDVGYRELPETDADLKRICKTIVEAASDEERLKAFAPIQEMMTFVQFANDECDYGMGLELGMDLFCYGSHYFHKVAGQLLPLAYNLLKRNLFAEIIEEHLANRSQENIDQLAA

SEQ ID NO: 427 - DNA, 25438 bp, Mus musculus
  misc_feature (1)...(25438): n = A,T,C or G
aaagtttattatctttaggggatggaaggcagtgtaaggaagcagaatttcactatgtagctcaggctggcctcaaatttacgattcagctgcctcagttttgaaagtgccgagctacagtctcgaaccagcacacctaaaattcatcatctggaaaacgctaccaaaaaaaaaaatgcatacgggagggaggctggaatgatggctcggtagggaagggtactcgttaccaagcctggcaacttctgctggatccttggaacccacatggcagaggagaatcaactcctgcaagctgccctctgactgctacatgtgttttcagcatgattaataatttttttaaaacccaacatgtacacagtgcaccctatgagaaacactgtatctatcggtgacttactatgacagttcaaaataaagctgagcggctgtagtgggggagaaacatgtttttcaacttgtttgcagtgtttttcaatgctggtttggtggctcatggacaaatgtgacaatgatttacagtcattcttggtttcgggctcctgccactggacaacaaccacctggagactcagtgtgtggaggcagcaccggatctgctttgtcctcactcctgagcatcccagcatgggctctgttttgcttgaacttgctcaaactgtgagtctttccagtgtaactccaggatggcctgacatgcatctaagagctggtacaggctccttgcgaggctacctgagctctcacacttcagaaggggagactggtgtcctcccgtcttatctcagggcttcctcaaagataacaaaaataaaagcttcgagggccactgggctgcaggcctgcccaacattcatgtggcttactttctccaagtcatgagaccaagtggcttcaaggacaggggaagtagacccctgtcccttgataggagcagctgcaaagggtgatggccacatccaaccaaccacaggattgcagcagaatcggcagctctgggttctcgttttatgagcaaaagacaaggggttaggggagggagctggggaagtagtgcctgctaggtggtgagagaaactgaaacctttatcttttccagtaagaattatgacctgcccttcagtaggctgcccaccgtccacggctgccgtgggaaagaatccatgcacaaaactattgggtcaatttacccagaaaactgtttccaagtcacagctctcaggcctgcctgcctactggagttgtgtgtagagttcaggccgcggtgtagccttggtggcagatcttgtctagcataggcaagatctgccaccctgacaccacaagaaatactgatgtcccgacccattgttataaattctgacttcgttcctgaaagactggtgttagtttgattgttttcccagtgcttctcaaacccagcgaggaagcttaagaagaaatggcgtctaaacccttggcaagagagagccaactaatgccctatctaccatgctgtctaatcacgtgcatgcaatatctgtagtaaaaacctaatgtgacacacacggtgtcctcgtggatgaaggaatcttgtctttcagtgtccagggatcatagagtgccatttatggagtgctaagtggtgagggaagggtagccacctgggacactcaggctcagaacacactgacacaattgcagttcatttggttttcctagcccagggaaagtgggagtgactcggcgatagcagaatgccatatttatttgaggttggaaaagagataaaattaatgacatctgtttaggtagacatttagcccatcttgggctctaagagtgcaagcagagtcacctagcaaatgtcctggtgattgttcttaaccaagaagcttgaagggcgcctttggaacaacccccgtgtatttatctgggaagacataacagggactcgggtccctgggtcagaatgagttcctccatcctgagggcctgcagtctaatttggaaagcagggaaatttggaaagtgtgaaactagcaactctgaatggggtgggggagtaacccagcaagggaactaattaactcccaaacactaacaaagcacaccagagtgtcagtggctccaataggtagctgcaggtgactctctgtgacgtgcacaccccaagcctgccaaaataagagctctaggatgaggccctgcatgtacggctcaggaggttgccatacacactccactctgaacagcactaaacaatatttgaaaaatggctgccctctgagacttgccagagcccacatacatgtcaaagcttagtgaaatgtcatatgtggggttgtggacctggagagatgatggttccatctatcaagtgcttgttcactccacacgtgtgagaactttgagtttggatctgtagcatccacatgaaaagctatgcaaagtagcatgcagctataatccaactgggggtgtagagatagaaggccccagggggtgggccttactgggaggccattgtagtatattgcggggggcagggggggcgagagaggtgagaggaagagggaaagggaaagggagaggaagaggaagaggaagaagaaagagagagggaggagaggcaggggagagcacatgtctcaaaacaataaagtggggagcaattgaagattgaagatagtcaatgttgacctctggcctacatgtgcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntggaccccgaaaatcacagctgggacctgttctctgccattccaggaggacccaggtgactcccacagacagtccccatgtgccctcaccctgggctcatccatcagctcccctctggggcctgtcatgtcaggtttattattaccaggctggcctcttgtgggagacactcaccagtcccaactccctgcacagtactgcttagtggctgcctatacccccaaccccctgcatctaccatcagagcccattgctaagagcttcccaagtaagactgagaacttgagagaagagccgtatgttcaaaataaaacattttaaaaaactttaagtcgggggctgggcacagtggtacacccgttagtcccagcactcgggaggcagaggcagttggatctctgtgagtttgagatcagcctggatcacacagtaagctccaggacagccaggactatgtagcaagaccctttcccccacaaaaatctaactaactaactaacaaacaaacaagcctttaaatagtaaaataaaacctctggtaaccccccctacacacacacacacacacacacacacacacacacacacacacagaagacaaaagaattcaatgctaagaagagaaaacaaaacaaacaaagccttaaactagactacagtaaacatcttcaaaagactagtcaaacttgtttccactgtttctacatttctcctttagactttaaagcataccatgccacgtaagttactaacaacaacaacaaaaaaagacttgtccattttgctggtgtttttgtttcatttttcttccaaacgttactcctttgcacagggaggactggcatcagggtgccctggtaacctttctaccattatggtttgtttgctcatttttttttcaggtcaaaatgggctcagaaattttaaaagtgggggagaagagggggagcctcttggattcttcgagtgatggatgctgtgacttgagaccctgccagtggcactggggacgtctgaaacatccaccgctcagattctaatcgccccgtttgcaggatgctttatttcttaattcttcatttggatcccaataannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaagagaagagagctgtgacccagattggtgctcctgtgtaggctcttactctgagcctcaggggctgttgaaaaccttccccctgttgttaactgccttcctattaactgtcctatgttgtaaaaatatttaatctcacctaggggcttctaccttgcctttgattattcaattcccaaataaaagacatgcgtgacctttaatttataataagcttttgtcagcactaaagctgggcagatatctaccctctgtgctattggaatctactttccttagctatcacctagctttccagagttatcatttactatgctccatctgggctgctcttgattccaattggccagctttcatggcccatgcttttaagatttttttttttttaccccacggctttttcttcctcttctggttgagattaaatatttctacaacagtcctcagttcttaggggacttgcaggtaagaagtcgccatattaaaaaacaaaacaaaaacaaaaacaaaaaaatccttgggaggccaggatattatgtcgcatactgaatccaagttatttctcacaagctccagggcccataaggctaaccagactgtggttgcttcccaacctcagaccttaatactaagtcgtgattcctaggacctcttatgtgtcatctaacaaggacatccccgggacagtggagaatctggactttccatggctttaccaactgagccatctgtccatccccgcagtttttaatcttgagaaattcaatgtaattgctatgtcctcatttcttcgaaggtctttgtagaaaaacagtggcatgctgtgtgactcccataaaagcctattctggaaatgtctaaggataaagtgtccactgtttcctgctctctagagactctgttcaaggggggaagatcctggcagagtctcttggtagaggaaacggaacttcagctagggtcagggccaaggtggggtttcccgcaggcagatgttgggatgaacctcctctcagtttatcagatgcagagaactggaggatggtttgagaggatggcagtaggctgaatgctcacatcaggaatcaggagaacttataggagaggctgccttcccctttacaatcatccataacttgaactttcaagaagattgaccaatatgtcaatctgtaggtggccaggcactggagtggtgtgatggtttgtatatgcttgacccagggactggcactacttggaggatgaccctgtttgagtagctgtggccttttggactaggtgtgtcactgtgggtgtgggctttaagacccttatcctagctgcctggaaaccagtactctgctagccaccttcagatgaagatgtagaatctcagctcctcctgcgccatgcctgcctggatgctgccctgctcccaccttgatgataatggactgaacctctgaacctgtaatccagccccaattaaatgttgtcctttataagacttgccttggtcatagtatctgttcacagcagtaaaaccctaagacaggtggtgctgaattcttgaaggaaaccatgaactctgggaaagcaggaatttgtgcagagagctgttgatgggaatgagaaagaggtgaagagatacaaggatctgccccttggccagtgtttctcaatctttccaatgctgcgatccttcactgtagtctcacatgtcgtggtgacccccaaccatatttttgttgctccttcataactgtaactttgctgctgttttgaattggaatgtaagtatctgttatgcaggaaatctggtgtgatcctgtggaagggtcatttgccaccaccacccaaggggtcatgacccacaggttgagaaccactgccctgggtggttgcttcccaggcagggagggcaaaccattcatggttaatgattcacaagctcttgtgcaccgcaggccggacagaagtggtaactgagactggaagttggagaaggaacaaaggcacttgcccacaactcacacacacacacacacacacaccacagcgtgtgaggcacaacccctacagcagagagtcctagaattggaagcgtggttacaagtgtggttctcggggaggtttcttcaacctgaccctgcaaaagccatctgggttccttcccatcaactgaagacaaaacgtcatgcaggcggatacaagcttgttcttcaaagaaatgggctagagaaagaaaatgtaaaacatacacaaacaaacgaatatatcatttcagctttgaaaaactgtgacaggggctggagagagagcttatcggttaagggccctggctgctctagtgaggacccggatttggtgcccagcatctacagggagccttacagtccaattcctccagttccagggactctgacaccctctttgcaggcaccacacacacacatacatagcatacatacatacatgcaggcaaaacgcccatacgcacaaaatagaaataagtcttatttttaatcttaaaaaaataaagacaagaatatttccgagtgtcacactgtctttacaaatgttcctactgctatgaaaactgccatcagtgctcttgtgagcttctcagaatcaggggcaggcctgtcttcctcagacagctctatttccagccctaccctactgcatagcgtttggaaagaactacaccaatggaagaactctccagtgccacagctggaccatctgccatctctaacatcatctaacagtcccacaaacttgtctgttaattaggtgtggactgttggactccccagggctgctgatactgctgaacgtctttccgatgggttctgttatcaacagtggggttctataaaagccaacattcttctgctttacaaatgtgaggtcccaggttacacttttctgttgccatggttactgctggatgggggggcaggggaaactagtaactcaacaactctgtcagttactaaaagctggacatggatggtctgtggagagttatagacacaaactctcaatgtcaatgtagggtctgaagaatggctccatggcctcacaagcgtgaggagctgcgttgggatccctgatacccacgggaaagccagcaaggcagtaggcgcctataaccctagccatgggcagggaatggacaggggcgtcactggataattaatctagacaaattggtagacactctaagtccagtaaagagaccctgtctcaaaagtaagataaaacacaggaagacatttaactgtggcctccataagcatgcctgcacagaaccctggcattgcataccatacacatacatgtcacacacacacacacagcacatatatacacacacaaatctgttgctgtagctgtttctgtgggtcaccacatcattgacggtacgaaatgcgttttatttattactaacaaaagtgataataattctgaagtttcaggactgtgccctaaatctgcgtctctgctagctaagtgtccctcatgcgggcccctgacctgacaaagcgggtatagacaaatgaaccacttgaagttaccctgagggaaagcatagactgctttggcgctcgggattagaaggcccagctgagtgacttgagcagctatggccagaggagctctagttgtctggcctgtgacacaggaaggcccacttcagctaagagtgctgataactatgtgcagtgaggctcttgaaatacaagtatgtggcatatataaaggtgttaggtatgacttagcgggctcacattttaacctcggtattcagagttcatggtaacgccaagaatgagggctggtgtccccaaggccagtgtttacaccgaggcacgggaaccttccatctcaagaaaagtttgagctgtttttttgggggatgctgcagatgctcaggctaagagttctataactcagaagacggctcagaattaagatgaaaaaccttgtaaagtgggctccattttcacatcatcgagagagccttctgtctggtgaggagagaaggctttctccaaagtagcagtgtccttgacattagagaagcccaacaccaatcctggattggggtgcagctcagaggcagagtgtgttctgaggggcaggttttaatctccagctccaaaaacataacgtcttagacaattctgtggaatactacagagccaaacatcaaattatccgtggaatgttcaaagccatagctctgaggtgggatgccaatacacacacacacacacgcacacgcacacgcacatgtacacacacacacacacacacacacacacacatgacctgatttgatctcgaaggaagaagaggaggtgacacaacagaagatgccagattggagggcagttttacatgcaatataatttgcagcatctgcatttcaaaccgttgtgttcttctagattttccaaagatgctaccatgttgacaaacatgtgacgctttttgttccctttacaaagttgttgatcctaaaatgaacacatctgtacccatctgactgactccgtacttcacaataaacttagggcagtggttctctacatgagaaataaatgaatttctcaatgggcaattcccctagttccaaagaaactggtgtagctttcgagggtaattttcaaagaggggaagtcatccctccatctccgtcctggttttatagcaacaccctgcacctagatgtgccaattgatatctagtcctggatggagaggatggtgggtgaccgggaacagcacccaaacaggacacccagagcagggaggggccagcaggaacaactagaaaggaaagtgatgtttacacacagaataataaaatttctcatcctgcacacaccacctttgacatcaaccagagccactgcctatgttcaatatgtcatggtttccactcctagtagtttgtagacatttttactttgaaatgggggggtgggaattaggggggttaggcttggaaagaaccggcgctgccctaaaaggaatgaggaagtgagagcagagcagtctctggctggctttggctgtgtaacaacccatgatgttccttccggccccagtaatattctgagtttccacctgcccgcccccgccacatataacactcagcacacgaggctgagggcccagtgccttgtctctgtgggtggactcctagggtcagagtgtcatgttgtgtctcccgttttccacagttcgccagaggtaaaaagagctctggctgaagaccgttgctggtaagtactgtagattaacaggacaaaacataaactgccttgtgggtcgagggtcttgggtccctgaagtgtcaggggccagtgccactaaaaacagctctattgagaaacatgtgtcagccttagaaggactctgaatggagaatgctaggggctgtgtgtcagctgccagcttgggggcttagggattctgtaaatgttatcttttgtttctgtacactgtatatattgtcctggaggtaaatttctgtcttacttgggtttcatgagagtgcagagcttttaatatagtatgtgcgagcactcagaaaagcaagtcttggttgttgtaatgtgtactcaggctctcctgatgggaacttagtaactcgtaacaaagtttgggagtagtaaaggcgtgtggcttaaagaatttaggattaagtttctcagaggctgttcttaatcataggtgacatttaggaagaaagactgatgttatcttgcttcatggagtcgtaggaatttttatttcatttggatagaataagacacaatgaaaacttggatgagattctcaacgatgcttcttagtgggagcccagttttaggtgaacacttttctatccagtagctttaagctctgggtccttttttgttttgttttgttttgttttttgttttttcaaactgactttgaaatttgaatttgactggactagttattctattttctaactcttttcatttatgatttgttgtacacaggatcaaagcctcgaggtagtggacccccctcttggactgtcagtctccattccaatgaagctgataagcagtctcgatggtgtacgtaagtcctttgcacctactcattcatcttgtccacagacaggggctgaaggaccttcgctgatgttctttttcctctcttttagtcaaaaacacttaatgctaacaacatggagacattaattgaatgtcagtcagaggtaagaaagtaatgttttaaactttttatttgcactgtaattagataaaagacattcttttgttactcatttgggttatttaattattggtgtgagatgaatatcagattataaactaaacacgtctattgagatcttccaaaataatgttgatctgagaagataaaatacagaatcaatgcatttgacttaattttcaagatgaataaaaggccgtatgtgcattttatggagaaagatgggatgtctttgggtgtcactattttaactgaaatgcatgttttcagggtgatatcaaagtgcctcccctgctgacatcatgtgagagtgaagacagcatttgccagctaactggtgagtttgaaaacatactgatctctcctgtgcgcctaactagtgctctgtttgccaaaccacagggcttttactttactgagatttggttttctaagtgttctgagagagcgcagaacattaacccttgactaagacagccagagctgtaggaggggagattctgtccgtggccagtgcccagggacacacggggtttccaagcgggctgccaagtcttagaacttgtaagctttgaggatggaagcgtgcacacattggagaaacacattgccctgcccaccgcttgcttccttctccagtggagaccaaacctaagcgcccgtgaggcaattgttgctgatctacaacatcaaagaatcaggcatcctttcttaccatctttcataacacatttcattacgatatgcatcagatctgaccacccctcccaaagtatcaggatgggcctctcattcttatctctcttcctcttgctggtacaaaataggtaaatggtcgggtacttggtaaagtgccaagccttcgtggcaacctgcttggagaaccaagcttctgaaataaggctgggtctgggtgatagcaggattccctgggtgacatagcgccctctagcggtagtatctacgggactggaggtgaacagccagccctacccagaatcttctaaaagatcttcgaaaggaagcaaaacacttcctctctgtaattttcacattcaaagaaataaattaaaatactatccatcaatcagaaatacattctttgtagtcgttacgaatacgttaaaatgggtggttttgaccagcaccattgaaatttcgctacttttctgtagttaaaagctgtgcgcataaaaacaggaaaggtggggcctttgaggaacactggtgttgatgtttagggactcgctaccctgacaacagtgtagtggtttggggttgatctttctagaccacggttcatgcccttggccttctcgaattttcaacagtaggttgaaaacagaaggttggttttgagggctcttgttttttgttttttggtttttacttttgtttttcaacgcggcaagctataagggagatgatgtagccaacatccatggtctcatttggatcttggcttgttaacatagatttttctctttatctccttgtttccttggctacagaaattaagaagagaaagaaagtgctgtcctggccatctctcatgagaaagctctctccttcatccgacttctctgggtcattggaaccagagctgaaagtgtcgctgtttgaccaacccttgtcgatcatctgtggggagaacgacacacttcccagacccatccaggtaggtgtgtgtggacccataaatctacttcccctttccagtgggacctgaaaagtctgtgagaattctgagcatgatgggcattggccttccaagaaaagcccccaccccacccccaccccactgtccaatgcaggagaggagccatctgccggctgtatccatcaatatactctaaatgatgggccctccctcagtcctctgtcttgtggattgtaacttctaaaaattcaccagagagggagcagtgggggtaaactagtgtttctacggaagcatgtgagaggaaagagggggctccaaataattttcaaatgtgcaaagttaatcccttcacaatttacctcctctgagaaaaatgagtaaaaaggcatcattggtagtgctggctttggctagcttcgaagtctctcctcctgtaacaggagcctacaggtagggttccgcgctttaacagcagtggcgggtgtctccaagtgactgttttctatgtcgtgtgtgctcccgcaggacatcctcaccatcctctgccttaaaggtccttcaacggaagggatattcaggaaagctgccagcgagaaagcccgcaaggagctgaaggaggggcttaactgtggggtctccgtgaatctgaagcagctccctgtgcacctcctagctgtggtcttcaaggtgagcctgaggcatttacactagatggcctattgagggcgcactgacaaactcaccaggagacccggacctgacacactgctccctgcaggcaaagccagctggtgggagtttagggtttttttctctgttcaactttcaattattcatacaagcacctctgtttcaatgatcccaggttccgatagacagggtggcatgaaattctctcaaaacattatttgattgccccttggccaaattcattcataaatcccatctccccagatttcacctacctagaaacagcgcatcttactatgctggttacggggggaggggggagaaaggggggcttcttaagtactgtgcgtgtttggaagaggctccttaaaggaagaaaatccagcgatgtgacttgggcgcacttttctctccctccaggacttcctccgagggatacccctgaagctactctcctgtgatctctttgaggactggatgggcgccctggagaagcccaccgaggaggacagaatcgaggccctgaagcagtaagtcctctggcactgcaggaggctagggccccatcttcgatctttcataaaactgtgcaagtacagccgggcatggtggtgcatgcctttaatcccagcactcgggaggcagaggcaggcagatttctgagttcgaggccagcctggtctacaaagagagttccaggacagccaggtctacacagagaaaccctgtctcgaaaaacaaacaaacaaacaaacaaaagatttctgtctcacggaaactgtgaggtccggggaatctgagtggaagtgcccatctgatcccatccagcatggaagccaggaaaggccctgagtatttaaaggaagcagttctacccaaacgagaggaagctcttcttaaagagcagaaagtaagcttcaggactcatagatcccaagacggagggaacctaagcacaggagtagttttaaaaggcaggagagcaactctgaatgccttaccaaaggctagccaacaagatcggagttaaccttaatgtcatcgcctgccaacaactgttctttcataaaacccttatggcaccacagagcaacttgggagaaattgttttattcatacatttccacagcaaactgcattcttatggttaataaaaattttttttgagagagaagatcaaattctaatagctagcaatgaaaaacgaagtgtgacctctgcatttctgagactcccagaggctttctgttaacataccagcaccctaagctcattgatacgcaagaggtgtccccatggccggcggagtatttgccatgaaatattttccagaaaggggatagtttctgccccccccccaacactatgattatcacgcttgcacacaaagtcttttctgaaaataacaccaagaaatgaaaaggacccatgtgttggaatcacttcattttttttcttgaaatatcaaaatgtaaagaatctaactcaagaataatttgttatcactagagcattgtctagttataaacaagcttctatagattagttctctctaaagatttctcagaataatgtgaaaatgggtggtgaccttcatctggaaattagccttgaaaaggtgtgaggaagctggtctcgtagggtctcggaaaggattctgatgcagttatttaatgatataacaaaattgttttcaaaatggaaggcagactgccagttaaacgggctctgattcacacccagcatccctgtgtgtgataaagacaggcgctgttggggccccactacaaccacagggagtccctgaatgagagtttcacaatgtttcttgtgacaatgcaccttccttgcttttaaggaggtctgggtgggtggagcctttcgagactacatgaaaatcatcatccctcaactttatttcagggttgctggtggcctcccccggcccaaccttctcctgctcaggcacttgctctacgtgctccacctcatcagcaagaacgctgaggtcaacaagatggactccagcaacctcgccatctgcatcgggcctaacatgctcactctgaagaacgaccagagcctgtccttccaggcccagaaggacctgaacaataaggtatgtcctgcctcagtaggagaaactcactggtcacaagcccactctctgcaaaagccaagcactgaaatgcttgtggtttgagtgtctcaaatgactcaggggccgcagtggaggtatgaactgcggcgtgtgttgtggttccacgctcatagaaacctgcatttgcagaggcaccaaatgtatgcatactctgttgtcctgggagacagagtaacagacacagcactacccctcccccacacacacacagagctggaaaaaacactttgttctttttcttctgtgtatcacattctgcctgttcagctaaaattctggacaagcacttccttaaatgaaatcacagttacttcaaagcttttttttttattctgaaaagcctcaaaaagtataataataaagtgtatttattattccaatgtgcttttcaggcacatgaaagtagctagtcttaattctgccacttcctgaatagttgaccccgatatgccctcattctttgcttccttttttatgaatgtacttaagctgacaaactgcttattttctttgttttacaggttaagatcttggtggaattcctcatcgacaactgctttgagatatttggggagaacattcggacgcgttcccgcatcacttctgacgactccctggaacacactgacagttcaggtacagaacactctcacttgagtgtggttctggggagaagttcctgccggccataggtgctccatgcagcaatgtgaagcatccctggtattaagagcaggattcaccttcacaagtcagaattctgtaaggaagtcaccaaccacagaggtcttgctattagatatacttacacacacacacacacacacacacaccagacaccagacacaatctggaattttttccttttcattctgagtcatgaatagctcttgattctattaagtaaactccagctatgggttggagtaaggaaatcccagctctgcaaaggaatgtgagtccatcaaaatggacattgagcctatataagagctacctgaaaaaccaatgttacaaattcagatcaatagaccatagagaatattatcattgtcagtttcttttcctcgaatctttcccttccttctccattttatttttcccactttcttaccacttaaagaccattttagacagaagcaaagtttcagtgtaatcagcttcttgttggatcaggccccagtacacttccaccaaagcatcgttggtataaatagggtattcgctaagagagcctggacagaatgctcagctcttccttaactttccccagacgtgtcaactctgcagaatgactcggcctatgacagcaatgacccagatgtggagcccacaagtggcgcagcctctcccaacaggcaactggagggtcccactcccacaatggctggtctggatacccggggccaccgggacacctgtgagtcaagctcagagtccagcgttagcatggtagtcaggctgaaaagctccattgtccaacaagacaggcggttctctgaacccaacatgtcaccctcacgagagtgcctcgtgggcccaacatccaagcaaaagctaacaaggagtgaggacagcttcactctgtcccaggacgcctcctgttctgaaggcgatgaagctgaagatccctttacagaggaagtcttcccagcagtggacagcaaacccaagagacctgtggatttgaaaataaagaattggacccaaggtttagcatctccacagggacacataaccaaagctttctccagatcctccccaggcgaatctttgggcagctcacctgtgccttctccatcctgccccaagagaaacttcttcaccagacaccagagtttcacaacaaagacagacaaaaccaaaccccagagagaaattagaaagcactccatgttgttttcctttgcgtctcacaagaaagtgctgccccgaacctccagcattgggtctgagaaatccaaagacttttctagagaccaactccagaaggacttgaggaaagagagccaactttctggcagaatcgtccaggaaaatgagtcagaaatccaaagccaaacatctctgggcttcagcttgtctggcacctgggccctctcagtcgacaacacgttccagttagtggatatgaggaaaccaggaagcccaccatcttacgaagaggccatttattaccagacatcaggactcacagcctacggtggccagacagttgggagtatgaggtcaagaatgttcaagccaagcacagcggtgccccctgtgccttctcaccatggaggtgacctcagtgaagggacacctggtggacacagattgtcttctgtgactgagcactggacacacagtcagactgtccatgtctctatagaaactcaggggagatctgagctacaccagttgaggacagtgtccgagtccatgcagaaggctaagctggactgtcttgggccacaacacagccacttagtctttgaggctgaccaactctgctgtgctagagaatcctacatttaagaaagccttgtaccatggctaacttgtgtgtgaagatgcgactgcagagaactgtctgttgagtcacagataagctcattcagaactcagtgtgcggctctcctctgtgaggatggctcacatggtgacaccaaattttgcctgtgtgtaaccgggtttgtgcaatatgtagtaaatgtataaaatgtattattatatgcaaggtattagatgcaaagggtgtctgcgtacatcccttcatgcatgcacttctgtatgttgtttttttgtcctcaggcacttgtttctattaagtagaaagagttttacttttcttaatgttacagcaaatgtcatgcctgtgttcacattagccgccagctgcatgtaggtggaaatgtctgagcctctgatgcatcttctcctaagcaggcttgagacgagtcagcatcatagaagggaacagactgaaagacactgtacttggtgtgtgacccatcagccgcactgggagaagatctttcagtcatctaatggaatgtgggtggcctggtggaaatgcattctgtcagtagtaactcacgcagagtactttgagcctctgcagctcagtcatgtcttgtgcagctgtgtagtggtaagcactgttgtatgcattggggagtcttgtataagacttcagtagagtttatttattagtcacaataaactgccctcctcctttagacagtttattacttgccgatgttatatcctttgcctcaaataaaaatccaccaagaacattatccacacactgttccattcagccagtgtctgttcactatacactcattgtgggccaacgcatacctcaggaaggtagtgtccaggagatgtagtctctgttctctggggatttgagccacttttttcagcaagcagtcattcaggggacagggaaaagtataggacacaagataacctggcacatgtaaagcttgcatctgagtgaaacagactttccagtgtctatacacatttcggttctgtgatgtcctttatcattagcaagcataaggagggatgtttgtatattagactcttactactcaatgaccaatatgtttatgtaaatgttttaaagcatagggctccaatcttcctaattatatccatttttataagatacagtgtacactcgtgatttggacatttttataagatatggtgtacactcatgatttgggtgatgtctcactaccaagttaaaaagttcctgattcctgcccagaggtgatttattgagcatttgcttagccaggttgtaaattgggtcgcccatgcatcatggtcaaaagtaacactaataacgctaataagctggtcagtggtggcacacgactttaatcgcagcatttacaaggcagaggcagggagatccctgagttagaggccaacctggtccatagcatgaactccaggtcagccagagctacacagagaaacccatctctagatagatagatagatagatagatagatagatagatagatagatagatagatagatagatagatagatagatagatagacagacagatagataagtgggggcggcagctaagagcacttgttgcttttgcaaaggacctgggctcagttcccagcacccacatggcagctcacaaccatgtgtaacttcagttccagggaatctgagggcctcttccaccctccaggcatgcctgtggtggacatacatacacactggcaaaacataatacataaagtaaaaggaaatcttgtttatgctctattaagcatcaacaacaaatcaatcttaaagggcaagccaccgccctctgaccggtcagtgagtaagagcaaccctttcttagagctgagttatgactttggtacctaccatgagccaggcatcacactgagtctttcagaattggggaaaaatgatctcccaccatgttcttagtgatacagacagacaaacagatgacagatggatggatacatagatagtgaatggataatagatgatggatagatagatagataatagatgacagagtttgtgcatatatatggatatatggacatatactatatatacatgtatatatatatgaaattatttgagacaggatttctctgttgccaagcagtcccagatgtaaacccttcttgccccagcctgctgagtactgggattagaggccacatcaccacaatggctcttagtgatttgctaatgaaaaccagagcatcacctgcagaggctaaccaagatgacaaactggaaagttttagatgtattcccactttactaatgagttgacctccatgcgacccttcctcaaacccttctcaaacgcctgtatgtttgtttgtttgtttgtttgtttgagacagggtttctccgtgtagttctgaactcactgtgtagggcagacggaccttgagctcagagatccccagcttcccaggtgctggggttaaagacatgcactatcatgcctggctagctgcctatattttaaaaagcaacagtgagagactggaagccccagtatagtttatgtcagatatccacagcttctcatggtaaagtctcgctgatgtctttctttgatcagtaaagagaagttgtggtgaccatttcaaatatcgcatggtgtgggactcacttgtttctatgtggcccactgatgcttccaatttggacttcttaactctgtttccatgtatgtctgtttgtgaggcagccacaaccatactgtagctggaagggagcactgaacagcagcaatgccttgtccatggctctggagacctggaagtcggacacccggggtgttagcaaggtcccgttggtggcacacgcctttaattcccagtacttgggaggcagaggcaggtgaatttctgagtacgaggccagcctggtnnnnnnnnnnnnnnnnnnnncaggtgaatttctgagttcgaggccgcctggtctacagagtgagttcctggacagccagagctatatagagaaaccctgtcttgaaaaaccaaaaaaaaagaaaaaaaatttttttttcctcctataaagaggggatgggcaggagggtgacacacaatgtactgtaattattttcaaaagcacacactgtccctgaccctaggacttaaataaattgaagctgacctagatatgttggcttagggaaatttaccaaaattgggaatgtttgctagaggcaagaacaattgcttaaagcttaagcccagtaagagcatggcacgatggcaagtcctgcagtagttggggtcagcagctaggtctggcaacattaatgtaccaagcaatggctgatggccacagtgcttggaaacgctgggcatgggaatgtctaatactgcttatattaatgcacacttcaaagaataactagggggctggagagatggctcagtggttaagagcactgactgctcttccagagatcctgagttcaaatcccagcaaccccgtggtggctcacaaccacctataaagagatatgataccctcttctggtgtgtctaaagacagctacagtgtacttatatataattacataattcttttaaaaatgtaaaaaaaaattagataaacgcctggttataatcttgttgggagagctgccagtgcgtgctttcctcctatccaccacgcatgaagccacattggataggatctcaggtagctgaaggttcttcattaattgaattctgtggttttaactcctcttctgcaaaaggagcaagagtgaggaggccagcgtgtacacagctcgctagagaagacagtgaatcactcagcaatatcttgagtataggctgagacactgtactttctctgctacagaatacaggcttgatatggggaccagagagatggctcagcgtgtagagatacttattgcacaagcatgagaacccaagatcagacctagcgctcccattaaaaggtgggtgtggctatgtgtgcctgtgaccccagatctatggaaagcactgagaggaggtctgctggggctttctagctactataagggattgcttgggtttgctttctgggtttgtgttactcactacaatgcaataaactcatgtaaagaccacatctcatatatctccaatctcaaatcaagaagaattgaagacagggaaaatgacaggaaagggccatgcttaaggaaacagggggatggaggcttagagagactccaacccacaggagggaacagaggcaaggctcagctcatagtgctgacagtcaaactgtgggaagcacagacactttgtagacagtctaagaggaatggctgtctgaggaaataaaacaccgcaacagtgtctcacagtgcatagaagatttaatgtagcatgtgaaatagaaaattcagagttctagaataaataggaataagcttcttccataacctcagaataaaacaggcctttacaacatgatttaaaaatctaaagacacaggacataagttaaaacctaaaaatcaacagtatcggtaaaacacagtaaaccaaataaaaatgaatgaagccctcttttagccatttaagatttctctcagtaattttctgtggttttccatgtccagaaatatttattatcaaattcattcacaaatttctttcatctccaggagtgacacgacattttagaagttttctctctcctgtgggtatgagtagtccgacatcaatccccataaatcacacttgaaaccattttagaaatgatctgtctaagattccaggtaatagaaggaatctctacacgcaagccatcgcctgtgatgatccttaggcaagaacagttggatttagttatagcagcacagacgtttgagaggggatctctctagagtaagatgcacaattttacaatttacaggggtgtttttgctactacagtctgctaaaatttttgttgactagacaaatgatcccaatctttaaaagtcccaaaggaacagatttcagctgtataaacctcagcgggctgaggcctgaggctgaggaagtttactgtctgttaaagatttaggcacccaagtcttaggaagaacacaattcgagtgccataccatattatttccaaccacaatgaaaatcccataacattgcgcttcagtactcagatcaaaccaacctgcatcagtgaaacgatcaggagccagcctatcccctaacagtacaggccctcctgtgcctgtttcccaagagaaggggcaatgtgctgggctggattctgattctatgctccttctgtagtaagtctgttctgttttacaaatctgaaatgtttttaaaaccacaaaataatccaatcaagaaagcagatattaagacaaagaaactcatggctttaaattaaaattttgcaaatctaaaagtacttttaattcctccagcccacacatcctgtgtttttaaaaccacggcgcatagtttaggggaagatgaaaactggtgaatgaaatcacagaatcagacgctttagcataacctaccaatttaaaaatatctatatatgcactcaggtctcagatcctttggcaaaaataactctcattttcaagaatagaaagtgttagggggttttatatcttcttacaagaaatttccatccactgaatgtgaattttacctttcactcaaatacacaacatgttttgatactgaaaacttcccaagaagacgggcgcgactctgcacactctgagtcatggttttactctgactggtgagcgcgtgctccccctggctcttactcaagagaatcaccacagcccttagatcaaaaggaaatgatcagagcatcctgtctggctctcagtcctgtaggaaattgaaaagcaggtctatcgttctgagtatcaccaccagattcaaggaacctctggcacaccacggtcagcctgagagccaggctcctgtgggccagaaccaagttcaaaggacccgatgtttacatgattctggagtttttctataggaaaaagaaacgcttgcaaatacaaattaaatcacaaacgcagatgcttatccaggatgaaaagcacattatgaattataaactgaagaagactagaaaaattcacaaaaatttccacttaaatagaatacatttttatcaacttcccaatacatttctctgtgtgttaactaaagactatttaagtactttcttcctaagaagaaatatataagatacaccttttaatatatatgtatatacatgtatatatcaatatatcatatattaaaatatatacatgtatctattatattctttaatgtttcctgtagaagaggacagaagttttctttgagtgtggttagtactgggatgcctttcaacatttcaagtttagagggatttactggctttagcttttgaagttgatagtagcatggagatgtttaagatcatcagtgtggaaaaatctgtcacatattttcatacacgagcttgaaaatgtaggaagctttccacagaccacattctcttgcttgtctgcctgtcatgtctttggccctctctaaacaccaactttctctctactccaatctttctgtggaactggtcattcacagctataacctaccaacatgacagtggccatcaatttcagaagtagcatatccagaacagaactctgggcatctcatccctctgacagcaagcatctcagtgaactgtgtgtacgtttttatttcgcttgagttggaagcatggcgaccttcctgtgtctgtctagtccttgcccccatatacaatgctttactaagtgttccagtttcattctgctgcagtgacaaatacaactcatgaccaaaagcaactcagggaaggaaaggatttatttcatcttataggttgatccattgttgagggaagtcagagcaggaaaacaagcaggaacgtaaagcagaaaccatagaggaatgctgcttgctggcttggttatagacccatgcttagagatacagcccaggaccccctgccgagggaatggtgcttccagcagtggactgggctctatacattaatgaatgcaaccgagacaatccatccccctacagacatgcccacaagtcaatgcaatctgggcaatcctttaactgatcccttcctgatgactctagatgtgtcctctcaagagttaaagctaaaacactatgttatcttaaatttccaaaatatcccaaatgcacctcttctattttctctgctactgttctagctccaggctagaagtatctgactgctcaccacctcagacactctcag

SEQ ID NO: 428 - DNA, 815 bp, Mus musculus
ggactcctagggtcagagtgtcatgttgtgtctcccgttttccacagttcgccagaggtaaaaagagctctggctgaagaccgttgctggatcaaagcctcgaggtagtggacccccctcttggactgtcagtctccattccaatgaagctgataagcagtctcgatggttcaaaaacacttaatgctaacaacatggagacattaattgaatgtcagtcagagggtgatatcaaagtgcctcccctgctgacatcatgtgagagtgaagacagcatttgccagctaactgaaattaagaagagaaagaaagtgctgtcctggccatctctcatgagaaagctctctccttcatccgacttctctgggtcattggaaccagagctgaaagtgtcgctgtttgaccaacccttgtcgatcatctgtggggagaacgacacacttcccagacccatccaggacatcctcaccatcctctgccttaaaggtccttcaacggaagggatattcaggaaagctgccagcgagaaagcccgcaaggagctgaaggaggggcttaactgtggggtctccgtgaatctgaagcagctccctgtgcacctcctagctgtggtcttcaaggacttcctccgagggatacccctgaagctactctcctgtgatctctttgaggactggatgggcgccctggagaagcccaccgaggaggacagaatcgaggccctgaagcaggttgctggtggcctcccccggcccaaccttctcctgctcaggcacttgctctacgtgctccacctcatcagcaagaacgctgag

SEQ ID NO: 429 - protein, 246 aa, Mus musculus
RPLLDQSLEVVDPPLGLSVSIPMKLISSLDGSKTLNANNMETLIECQSEGDIKVPPLLTSCESEDSICQLTEIKKRKKVLSWPSLMRKLSPSSDFSGSLEPELKVSLFDQPLSIICGENDTLPRPIQDILTILCLKGPSTEGIFRKAASEKARKELKEGLNCGVSVNLKQLPVHLLAVVFKDFLRGIPLKLLSCDLFEDWMGALEKPTEEDRIEALKQVAGGLPRPNLLLLRHLLYVLHLISKNAE

SEQ ID NO: 430 - DNA, 25937 bp, Homo sapiens
agaagaactaaatgtgaatcccaactgttaggattgagaaatgcctgttgacagcagctaataacttggaaaactgaaaggatgagataggaacgtgaaacacaccttgagtttgggagccatgtccattttccaactcaatacccagtaaagctccatgcaccttgtggggactcaaaaagtatttattgactgagtacaaataataatgaaattaagtttccagaagcatctcagttcaacttttcgagtacccaaagaatgtcagtctttctttggaatttctgaaagttctacccaaagttctggatactccaccctttagttttgcatcctgaaaattcccttgtatgtcatttgtatccataagcacagatttttttaacatccaccactgattgatttttattttacatctctctggtctatttaaactttattatcttaaacacactaaaaaatgcatcatgggctcactgtgagaaatactgtatcagtagctcactaagatgctttaaaataaagctggattgcttccaccgagaacgaggctaaatcagtgctttttaaagttgcatttgcaatgcattgcaatgttaccctgggggtgcatgtgcaaaagtcatggtaacaatttatggagtcactatttgtttcaggcacctattgctgaataataaccaccaaaaactcagtctcctaaaacagcatcaatttctgatttagcaggattctacgggttggctgggcagttctactgttggtttcacacggtctcacttagatgacattcaggatcgcccaagacggctttacacacacgtctgagagttggtgttggctgtgggctgggcaccttgtctctcctccacgtggtctctcatcctccaggaagcttgtatggcttcctcacatggctatctcagggctgcattcaagagggcaaaggtggaaactttgaggccattggagcacagtatccttttttctgcattctacaagtcatgagggcagcctcatataaagtggggaagtagactccgtgtcttgatagaagccgcctcaaagaattatggccacatttcattaaccacaagactgcagcagattctaagtcacctcagctctctcactttgtgggtgagaaggggtaagttagggaaatagtgctcctgagacgacgctgctcaatggagggacgctgaggctcagcttcccacccaggcggacaaggtacctgctgcttctaagattgcctggtgcctgtggttacagtggaaaaggatcccattataaaactgacagatcagttgaccccaaaaactgtggctgagatcactggttaagctgcatgttggaattctctggagaattttttttaatcctgaaatcccgtcttcagaaatttccattttattggtcaaagattaggtgtgggcattgattattcttaaaaatcttcccaggggattctcacgtgcagccaagtttgagaaggactgatatttaaactttaaactgccttttctcaattgtcagagagattcaactaacgccttatttactctgtcgacctggtcatttgtacatggtaaacatgcatcatgaaaggataatgttacacacacacacacacacacacacacacacaccccgagtgttcttgcaggtggtggtcaaggaagctcaccttcaagtgtttagggatcttccaaggggcatttgtggagagctgagctctctcacaaaaaacagacgccccgtggacatacagctggctcttaggttcaagacaagtttgtgcacctggtggtctgtttggcttccttaacccaggccattgaaagtgagtcgccaatagggaaataccacatttatttgaaaaaattaagtaaaattagcaaagcctctgttgagttagatctcggggctctaagtgagccaagcagtagatgccttctctcttctgtttagccacctggtgaaaggtctagggcttagtctcaacataaaagtgtaaacgattcctttggagtagccctcagcttttgtctgggaaaacatggttgagcatagcaatcagaagaagaaatgtgtccaaatatccaaaaaagcagaagtacagcttcaggctgggcacctgttttactcattcttaaaaatggatatttgtgtacttcatactgtgcaccccaggcttgtcttggggtgtaagaatgaattgcttcaatttaaggacctgcactctaatttcaaggggcaagatagaacgtgaaagctagcaaggaatcatggaataacctagtgattataaaaatgctgttaaataaactactccaaagccaggaagcaggaatatattaaatacattttactttttactttttcatgatacagcaggccctcaaataacatcattttgttcaatgtcatttcattatcacgtggatgaagaaaaacaatttcttcccggctacggccactctcagtgtggaatttccatgctcccccaacatccacatgggtctcctctgggtcctctggtttcctcccacatcccaaagctgtgccattcggtgaactggcgtgtctatgtggtcccaggttgagtgagcttaggtgtgtgtgtgagtgtgccctgcgatggggtggcagctgagccgccaggatggtctcttgtcaccccagaccctgaactggaatgagcaggtaaataatgaacctctttgtttttattcatctttcctaaatgtacgtatagctcacacttatttcaatgtttaatatttgaagtgttatgggtctttactgaaaagttcagtgatccttttgtgaccagaaatatgccacaggaacttgactcttgtttacatcatcagttagcctatgggaaaattgttttcattatacgttgatttgcttagagtcacagtttccaagaatctatggatgacattaaatgaggtcttactgtgcttccacagccatccttcagagtgtggccctcagaccagctgcatcagcgtcactgggtactcattacaaatgcacattttcaggcctctccccagacctgccgaatcagacgctccaaggtggaggccacagtctaggtttgaatgaacctccaggtgattctgatacgcgatcaacttggagcagcactgcactgcacatttgagaaatggttgctgtttgagatttatggaagatctcacaaaggctacaactcagagaaagggcttctgggctcagttttccagttaacatatgcaaacttaggaaagatatggaaatttttttaaatatgtatcatggctgggcgcggtggctcacgcccataatctcagcactttgggaggccgaagcaggtggatcacgaggtcaggagttcaagactagcctggccaagatggtgaaacctcgtctctactaaaaatacaaaaattagctgggtgtggtggcgggtgcctgtaatcccagctactcgggaggctaaggcagagaattgcttgaaccaggaggcagaggttgcagtgagccaagatcacaccactgcactccagcatgggcaacaaagtgagactccatctcaaaaaaaaaaatatatatatatatatatatatatatatatatatatatatatatatatatataatgctttctagtgtgttacataatgttttatgacccaaaaacagaaggagaaatcttatgattcttttttctgtaagaaaagcccaggaggcagcatcaggtttgcaaaaattacgtggctttcccttgtccctctgcccaaagtcttttcacacagaagatgacactagctttaaacccttcccccggactggtcctagagtctaaatcagaaccagtctggactagtccatcaggaaggctacaattgccaggaaaagaaagcactccacagacccagccacaaagggttaggacttgctaaatggttgctagctgaacctgggtgaaaaggtgaaaatcagatgtgaagccaccaatgagcacagtgccctgagcactggcaagcccgctccggccaggtgagagtttgtcttcaggttggagacccccttactgcttcccctggcaggagctgcgtgcctagtggccacgctccccaaccccgaggagcaggggccgcttgggagggcatcactgaaagattttcttaggagacaccaaataaggcacatatttgagaaggggaccacacacattcaaaataacaaatacttttcttttttaaaatttacacagggaggtaaaagccctggataatttttttcatatgacaaatgaaaaaaagtgctcagtaaaaaaaccaaagtcaactacagtaaatatatctttaaaaggcattttaaaagcatggggcaaactaaacatttttccaccatttctacttttttggttcagatttttacaaatgctgcacatgaattttgtagactgctaacaaagaacctcagctttcatagttttctctttgtttcttcaaaaaaataacctaccaaatcatattgtagttaactgatgttcagggctgctgacatgccttttttgacatcatgtttgccttgtgcaatttttcaggccaaaatatcaacagaaagaaaagattctttagtttttttgtttttattttttattttttttttggaaacggagtctcgctctgttgccaggctggagtgcagtggtgcgatctgggctcactgcaacctccgcctcccgggttcaagtgattcacctgcctcagcctcctgagtagctgggactacaggcgtgtgccaccatgcccagatcattttttgtatttttagtagggacagtgtttcaccatgttggccagaatggtcttgaactccagacctcgtgatctgcccacctcggcctcccaaagtgctgggattacaggcgtgagccaccgcgcccagccacattctttagttcttaaagtgataaacacagctaagctgaagccctacctgggtcctacagcactgataatgtagctaagatgaagccctgcctgggtcccatagcagtgataacgcagctaaggtgaggccctgcctgggtcccatagcagtgataagcgcggctaagctgaggccctgcctgggtcccatagcagtttgtgtcatcagccatacagcttctaatcacctaatctcaggatgtcttatttttaattcttcatcttgatcacaataagtggagaagccagtttaaaaagaacattttgtttgagcctttcttagttttcaagccagcttttgaaaacacagcgttcttcaaatattattttatgctgagcctattttgtattccaacacaaagataaattcataattgcaaatatctgagggggcaaatttgaaatgtctgcttccactactgcagaaatgcagccatttgtggagacagcaaattattttgcaagatgaaatgatgcttgacattatttcagggatgccagggtcccagcaaacctctgagaagatccctggaaggcagcccttctcctgccaggaaaaaaaacaaaaattaaaaaatgaccttaaaggactgaactgtatttaccgtagccgagactgagtccttgcctgtatctgtgagcccggggcctgcagagaggtgagaacgtctcttccaggcatatcttccccacccacagactttcctagaagtttcttagaggagaggcaggcaaggagttttattgctaattcgctataaccaaagtcaccgcataaaagattctgcaggttgggtactttgcagattagtgaatccaagaccgtcattcaaagtgagcaccaacttcccagcccccggagtcctttatgctaagtcctcctctgccaccagacagtgaggagcatggctctggggacgtccacacctcccagagcacacagaactagggagtctaaggtgagaacactggtaaggctttggtccttggagggtgggaggtgagaggctggacaggtgtggtcacgccctcctgacagattcactgacagaagctgacactcaagtccacctaaggcgaggcctccttcctcaccacagagctagagagtccatgtgtctaatcccacaacattggtatcgacataagcccgcggtgtgtgcaaggagaggctgtctccagctcaatcaaattctgcaacgatggtctctgttacagcgtgacaaagaggtagtctttctccatgaaacgaaacagtcaaaggctaagtgacaaaaagtctgagtaacaaattgcaataccagcaaacgtatggtgagatttaaatgttttattttatcactcaattttactagtaattaaagtatagcaaatgcctactgtgtgcaaaatatgaggccaggcacttgtaagaataaaagatgaaaaaagtagactcacagtctactgggtgcggccactatgcagggccagggaaggaaatttaattcaatctagaaaagtcccttcttagaggagataggacttgggctagattccgagggaagggcagaattccaaaaggcagatggcgtgaatggcatttcaggaggagggaacaatttatcaaaggcctggagactcagaagcacacttttaggggatgacaacagcctgtgtggctaaaacataggacaagtgggagatggggaggacggataatcagagaaaaggctggattgcccttttttaaaaaaaagaaattgtaatttgagttttctagaaaatcaacctgttaatcagtcattaggtagccagacactggggtgatggagaagtcctgaaggaaatcgtgaactctttgggaaaataatcttcaatgcaggaaactgttgacattaatctcattacagaatgcagggctctgaatcactgggtggtcccaggaagagaaagggaaagtgagttcaaactgaagagccggactctaatcctccagttggtgtttcccaggcaagctgggtaaacaatgtggggaaaatgacttccatattctcgttcacaacagtccagactgaagcggtaactgagcctgaaagtatgggaaggaacgatggtgcttccagtcaccctccaaagcacacatgtacacagcatagaactcacagtccccagaacggaactcactgtccttagagactcaccacaagaaaagcaaagccaattatttgcagaaaaattgattgtgaccaggacccaagcgataaaagtcccactgtgagaagcatctttacaggtgtgggtttcaccggggtttccttcagcccaacccagcaaaagccactgaagttcctttccacgttctgaagactcttactatgcaggacgatgagagcttgcttttcaaagagatgtgtgggagacaagaatatggaaaaagtgaatctgacatttccatctttttttctaacttttggcatgactgcttccaaattttacactttatttataaatgtttctcctagtgctcggaaaactgcgatcaaaattactgtgagattttcagagttgagggtgcagcacctgcccttcacaactctttctctttccacagtaggcgccatatgcaggcggggccagtcataaaggagaacgtctcctcagtcccccagcagcaccagccaacaatggtggctttccttcagtcacaaaatgtacctattcattagatgttgactgtcaaaatctcccagggaccccaaaggatggcacctccctctgggctttcccaccatcagttgtgtcaataagaagagccaaaacatatttctgtttcaaaaaatggaggggccctaattctgttgccgtatttgctactaacttttcatcctagatagttccctgggtgcttaactaggcatggtaggtcccagaagaaaaagaaaagtccgtcgatgtaaccatttctgcaggtcatcaaaccattcatgttatgtatttttaaaagatgctgaggctgggcacagtggctcacatctgtaatcccagcactttgggaggccaagatgggtggatcacctgaggtcaggatttccagaccagcctggccaacatggcgaaaccccatctctactaaaaatacaaaaattagccaggtatggtggcgcgtgcctgtaattccaactactcaggaggttgagacaggagaatcacttgaacccaggaggcagaggttgcagtgagccgagatcacgccattgcactccagcctgggtgacaagagcgaaactccatctcaaaaaaaaaaaaaaagaaagaacagtaagtacattaagtttcttacaaaaatttgaaaagtccgtttgtcgggaaaaaaaaaagtttagaaaatacatactagcaatgaatatacatcacatatatattctatgatatatagaacattatagtaatattctattttggctattttataaggaaatgtatatattcagaaattagttatttagtacctactatatgcctagcactaggctgggcacagcgtaaatgccctttttcaattaaaaaaatcagtgagttcactttggaggtttataaaggcaggagagggatgctgaaagagtggtggcctctacagctgccctgggaacactgggtgaactctggcactgtggtggctttcagagagggagcccccagctggaagcctgaaaaccaggatctgtccctaggtccccaccgagccgctaagttacagagcaaatttcgacctctctgtgcttcggtttcccaaagtctgccccataatcacctcctttcagtaaaatgacaaaagaactgacaatgcggaaaagtcttaaaattaaagatgctgatgataaatgaagccaagttattttaaaactttttattgaaaaattacataaatagggaagtgtgcacataagcctagcaccacccagatcaagaatggaccatcaccaagccccccgctggcccctggaagtcattaccatcccctctgggaaactgctactcttgcttccaacagcacagacgacttttgctaattttgtgctttgcattaatgggagccggcaggatatacactttcacgtctggcttcttttgctcagcgtcatattatgagatccaaccatattgttggctatagtcataggctgttcattatcagtgctatacaacattcattccctatgtgaatggatcacaatttatgcatccattctcgtgtcgaggcatttgagtggtttcatatatagcccttgatctacagaaaagatcagaaattctcttatgcagaagagtgatccacaaatgaaattcaccatctctttcctactttaagttggtctgatcaaaggaatttttttgtttgttttccttccgtgtcagaacgacagctgctctgactgtaaattaagtatcaatacttttgaccaggagttacagaaaggaggagggggttactatattgacaactgactcgagggagttttctttctacttccaaaggaaactaacctggctttggacggtgattgttcctcaaggaagggactgtcttgggtttctttctggttctgtaacagtgtcccacatccaggggtgctaatcaacgtgtggtgctggtggacagagcagatggcacgtgggaggggaaagagcacccaaacaggatgcaaaaagaggcacttgaaattaccactttagaaaataaagtgatgtttatgcacagaataacacaatttcttgttcacacatcccacctatgacattaatcagagccttcacctatgggctgaatgtcatgttttccactcctagtagtttacagattttttactttgaagtggaagacacaaaaaaaaaaaaaaaaaaaaaaaaaaaaaaagacatagctgccctaaaaggaatgaggaagcgagagctctccagtgtctggctggctccgtccgtgtgacagcccatgatgttctttccggtctctgtaatattctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaagggtaagtacactatatattaacatgcctagaaattacaagctgcctcgcaagtcacaggtcactcagatcacaggcaacagaaaacagctatcccgtggaatatgctctcactttataaagtctcaggacaaagctttgcttcaacgtgaaggctgcacctttttggtgtaggagttctgtaaatgttatctttgtttcatgtttactattttagcatcctagggatatgtttttttttttttcctttttggattagatgagaaaatccatgcaaagcacctactacgacagctggcatatagtcagcactccaccaaaaaagttaatgttcatgttaatttaaaatgttaacgtaattgatatccagattatctcttgatggaacggaataaattggtaacaacgtttagagtggtaaagatagttgacttaaataatttagaaataattgtgttcagatgctgctcttaacaacatacaacatctggtaacagaactgattttaaatgaaaacttgtctatgtaatagttttttccaaagtaaaggcaagtgaaaaaatagcaaaagagaaaaataaataaatagtttcaaactctgtgctttggcaaagtggcgctgaaagtggcctactgtgtgagtccctcctaactcctttccatgtgattcgttgtagacagaggcacagccacacgggagtgaaatccacccctggacagtcagccgcaatactgatgaagctgagaagcagccacaatgctgtgagtgcccctctcacattcattcattcacgtttcctacaggcaagggccaaaagatatttacctaattttattttttctcttttagtcaaaaacactaaacgccaataatatggagacactaatcgaatgtcaatcagaggtaagaaagcaatttttaagactttttatctgtactgtgagaaggtggaaaactttgttttaattgaatattatttgggttgaatagtaattataagagtagtaaactaacatcacacatgtagtaaattaagcacattaattaggatcttatatgatgacaatcaagaccttaatattgcttctagaagctagaaaaaacatcaatgcactctactgacttcatttttaatatgaataaaatgctgtatgtgtgttttgtggggaaagactcgataggtttcttcagtcactatatttaactgaaataaaaatgtttttagggtgatatcaaggaacatcccctgttggcatcatgtgagagtgaagacagtatttgccagctcattggtgagttttaaaaacataccgatcttttatgtaagtgctaacaaccagtgctcttggtttgcaaaaccacagcgcttttactctactaggaatttttttgtataagttgttctgttaaagaccgcagaacattaacccttaaatggcaggtatgctccaactcactagagcagggagtgctgggaaaggaaagagcctctccatagagaatccccagttctgccaagcgtttttaatgcggttcaatctcctggccatgtatgtttcgacaattagcatgcacacatttgaaaaacacacagtgtcttttccattttcttccttctcttatggagaatgcatccaagagcctatgaagcaactgttgctgatctcaaatcccaaaggacccaccattcactctcaacttttttcataatgcatttcattatagcgtaaccctgacccagttctcctgaaccataaagacaggccacttctttctcatcatgcttccacttgccaatctgaaatgtatagaaacagatgccaatgcatttagaaaatatagcctttataattagtaagaaaggagaaggaaggaaggaaggaaaagaaaagaaagaaggaaatgtttgagattgcaatatccattgcacacacatcttgtggatttcagaaggacagaatatcttgataacgttttgctgataattcccagttgccagatctaggttcaaggcttcccgcagcgattcgtatttgcctctgtcctaaagcagcaacctggaaaacccaaggtgaccagtcacctggaaggaaaaatggtgttagctccctctagtggctgtttagtgcctgcgtggctgcaaagggttggagccagccctgctatgtgccttcgaaaagatattcagcaagtcacttcctcaccttttaagtttcgttttcttcgccagttaaaggaggaaatcaaaataatctatttcatatcagaaatttcctctatagttattcaggccagtaggttaagatggttgtttatgatcagcacagttaggttttgctaattttctgtagcaaacagctggaaagagtgaaaacaggaaaggtggaggccttgaggaactctggtgttgctgtttagggaactggttgccctggtaacagtgtggttgtttatcggttggtttttctagattaagattcacgccctttgctttctcaagttttcaaaattatttttctcacatcgcatactattgaccacattatgcggccaacgatacccattttcttacctggatctttgcttcttaacactgtagtctaatttttctcgttgccttgttttcttggctgtagaagttaagaagagaaagaaggtgctgtcctggccctttctcatgagaaggctctcccctgcatcagatttttctggggctttggagacagacttgaaagcatcgctatttgatcagcccttgtcaattatctgcggtgacagtgacacactccccagacccatccaggtaggcgtgcattctctcataaacctacttcagttttcagttggacatgcaaaatactcgggaaatctgaatgtcattctcctattaagtttgtagggactgatcttccatattttccactcttcaacatggcactcccacatacgcgtgcagtcagaagaatatctgactgcttccattccagaaattgaaattagttgtatttgccaatgagctcagagctatggtcccgccattcctctgacttcacagagtggagaatgctgaagatttgtagcttctgaaaagtcaaaagggggaaacagaatatagactttgtgatctgaaatccaatgttcatatggaagtatttgaaaggagagagctccaaagtgattttagaaagtgcaaaattagagctttcacaatttgcctcctcttagaaaaatagcagggttgaggaaggccattgacagcaactggactgaaagcaaaatctgacatcaatattcctgttaagactatctcagtatactaaagaagaagggtaaccctttcctgttcctattgctgtttcctttaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggtgagttcaacacacttgcgccaaataacctgccaaggggccctgacacactcattctcaggatgcaagaaataggctcttctccccacacagcaaggtacactgatcttggagtttaatttttttcattaagccctttatttatttatttagtaagcacctctgtttctgtgacctcagattccaacagaaagtgatgcattctgctctcccaaaactttgccaagtacgggcaatttgattgttccgtggcagaatccatacgtcaaaatccagtggcccctcagaacacacccacctggggatggtgcctctgactctgcctgatgttagaaagttgcagagaggccaagggtgttggagagagggttccctggattcatcaaatgcaggaatgaagggccacaatctatgatgggctaagcatagagcaccctgcgatggaacgaaaaccgggtgaaaacaaggacatgggacatcatacagtaccaataggccaacagcccactctcatcccccaggacttcctcagaagtatcccccggaagctactttcaagcgacctctttgaggagtggatgggtgctctggagatgcaggacgaggaggacagaatcgaggccctgaaacagtaagtcatcaaagtcatcggtcattgccaggccacatcacctccgtcttttgattctttacacagctttctaaatgcttcatgatccctgttccatgagaattgtgatgtttagggaatccgagtggaattgctcgtccactcccagaacaaaaaccagagggtgccctggacttttgaattttaattttagccaaatgaaatatttcttcaaaaagtagaaagcgaacttcaatcctcacaaatcccaagaggtagggaagtctgaaaatgtaagatgttcaaaaaggtatgagataaaatcagacctgagaactttaacacaggctcaccagcaaagtgtagaaattcgggattatctttaagctacactgactggtgtcatgcaaggcaacagttctcccataaaacatccctcaggatgcagccagacagtgtggtggggggcagttgttttgttcataaaacttcacagcatatttcatcttcttataattaacccaaatgaaaactatataataacacattccagtgagagtaaaaataataacatatgcaatggaaagtgtgatctgttagtgactagagaattctaaaacccaagctttgaaatgtcagcatggttgtcacatcctatgaaagtttatctaaatgttataattgtcccacatggctaaatactttcaatgacatatgtatagaattgaagacattaaaatgtctgtcccaaaatgaaaattctaagattatcacaatgagtttctacctagacataaggcatttttataacaattccttcttctgagaaatgaaaataatcaccatttcgtttttgaaaaagtgagactttaagaagtctaatttcttatcattagaaacaatgttgcgatttaagtgccgccttatatgaacatgcccttagaaactgatttagtcttcataaagctttctcagaatgttgtaaaaatgtgtcatcttcgtttggtaattatagttttgtttccgtctttgttttaaggcaagaaaaccagtctagtcgtgttagaaacagaaagaaattctacatgactaaatgattactcaacaaaactattttctaaacataaaggcaaactatggtgtttaatgcagattggcttcataatttaagctctgtataaataataaagggctgtgttattggtgtcccaattacaaaggccagtttcttagctcctcaagaccttgtggttaaccagtctcactctgtgtcagttgccactggaagtgtctgaatgagcatttcacaatattacttgtgaaaatgcaccttcctcattttaaaggaagtctggtttcggcagaaactctcagcttgctacactgaagaccattagcctttttgaaaactaacatcccttcactttattccagggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggtttgttctgcttactgatgagaaatccccaacttatgatctcaccatctgtttgccaagtccaggcaataaaatgcttcagaatgtctccaactgactcagaatcacagtgaaaatataaaatgcaaaatgcttttgtcatagttccactctctcagatacatgtatctaatgaaactgaataaatccgtgtcttctgtcatctgtgagacagatgagtgctgcgagtatttacatcactctctcccgatataaaaaagcccttttgtttttgtgttttgtacaccacagtctatcagtctatcaatctgggacactacttacttaaatgaaaattttattaatactttaaatttttttaagttcttaaatttaaaatgcatgtctcaaaacaccaaggagtatctaactttaatgtatgtgattgttggcatggtggctcacgtctgaaatctcagcactttgggaggccgaggcaggcgaattgcctgagctcaggagtttgagaccagcctgggcaacatgacaaaaccccgtctccactaaaaatagaaaaaattagccaggcgtggtggcgggcgcccgtagtcccagctgctcggaaggctgaggcgggagaatcgcttgagcccgggaggcagaggttgcagtgagctgagatcaggctactgcactccagcctggtgacagagtgaaagcctgtctcaaaaaaaaaaaaaagtatctgattgttaccaaatttctgtatgctcttttcagacacataaagatctcagattctcattttggcacctgactccagtgtccccattcttcctcacctccaaaaaaaaaaaaaaaaaaaaaaagtcttcaagctgacaaattgcttacttttcctcacaggtgaagacactggtggaattcctcattgataactgctttgaaatatttggggagaacattccagtgcattccagtatcacttctgatgactccctggagcacactgacagttcaggtatggaatgtgctatcatttgattacgattgtagggaaaagttcatgccagtctgccagtcatgtaaagcatctctgatatttgaggcagaagttaccttcacaaatcaccgagtcagactagactccagtccattaggaagtcattaaacatgaaaaccctgctccgggcttttcctgcagcgcctcctcagaccacagatagtctttcccccttcccagtgtacatcgcaaatcactgctgatttcactaagctacctttagctctggagttggagtgagaaacttttgtttccacttcatgggatatgactccatcacaatgaaaatgggtccagtaaaaggagcagttttaaaaattaaggtcaatacattttcagtgaaatgctgttctctcttttcttattctctcctctctttctctccttcctccctcctttactcatttcctttccctatttttcttctgatctcaaaataaattcagaaagaaataaacttttcatgtggtacatttcttgtcatatcaagcccctaagtagttctgctaataaatcacctagtgccctgattggtatgagcagggcgaactgtagcaaagttcatttctaaaagaacctaaatggccgtgtgtggtggctcacgcctataatcccagcactttgggaggccaaggcaggcagattacctgagatcaggagttcaaaaacagcctagccaacatggtgaaaccccgtctctactaaaaatagaaaaaatagccaggcatggtggcgggcacctgtaatcccagctactgaggctgaggaaggagaatcacttgaacccgggaggtagaggttgcagtgagccgagatcacatcactgcactccagcctgggcaacaaaccgagactccatctcaaaaaatgaaaataaaaaatacaaataaaaataaataaataaataaacccaaacaaatgttcaactgctgcttgacttcccccagatgtgtcgaccctgcagaatgactcagcctacgacagcaacgaccctgatgtggaatccaacagcagcagtggcatcagctctcccagcaggcagccccaggtgcccatggccacagctgctggcttggatagcgcgggcccacaggatgcccgagaggtcagcccagagcccattgtgagcaccgtggccaggctgaaaagctccctcgcacagcccgataggagatactcagagcccagcatgccatcctcccaggagtgcctcgagagccgggtgacaaaccaaacactaacaaagagtgaaggggacttccccgtgccccgggtaggctctcgtttggaaagtgaggaggctgaagacccatttccagaggaggtcttccctgcagtgcaaggcaaaaccaagaggccggtggacctgaagatcaagaacttggccccgggttcggtgctcccgcgggcactggttctcaaagccttctccagcagctcgctggacgcgtcctctgacagctcgcccgtggcttctccttccagtcccaaaagaaatttcttcagcagacatcagtctttcaccacaaagacagagaaaggcaagcccagccgagaaattaaaaagcactccatgtctttcacctttgcccctcacaaaaaagtgctgaccaaaaacctcagcgcgggctctgggaaatcgcaagactttaccagggaccacgtcccgaggggtgtcagaaaggaaagccagcttgccggccgaatcgtgcaggaaaatgggtgtgaaacccacaaccaaacagcccgcggcttctgcctgagaccccacgccctctcggtggatgatgtgttccagggagctgactgggagaggcctggaagcccaccctcttatgaagaggccatgcagggcccggcagccagactagtggcctccgagagccagaccgtggggagcatgacggtggggagcatgagggcgaggatgctggaggcgcactgcctcctaccccctcttccacctgctcaccacgtagaggactcaagacacaggggcagcaaagagccactccctggccacggactctctcccctgcctgagcgatggaaacagagcagaactgtccatgcttctggggactctctggggcacgtgtctggcccagggagacctgagctcctcccgctgaggaccgtctccgagtccgtgcagaggaataagcgggactgtctcgtgcgacgatgtagccagccggtctttgaggctgaccaattccaatatgccaaagaatcgtatatttaggagggaggccatacgccatgccatagcttgtgctatctgtaaatatgagacttgtaaagaactgcctgtagattgtttttaaaaggtcttgaataagctccttgagaaagttgtggaaagccctcctcagtgaggatagctacaccatggccatggcgcatcagatagtctctgtgtacctggatttgtgcaatatgtaaaaatgtatcaaatgtattatagataaggtgttaggtgcaaaggatgtctaataatccctgcacacgttttgaacttgcagtgaagtacactgctgttccttgcttcctggggcacttttctcttggttagtgtttaaaaattatcttcgcttttttaatgtggcctcaaatgtcatgccaattttcacatcttccacaaactccatttagggagaaatgtttaaatctctggtataagtttactccataccagagtaaactatatattactctatataagcagtcttgcaataactaatcaccaccatagaagaaagaaacagactgcaaggaacagagttgagtgtctggagtcatcaaaggcattaaaaactccagtaaaagctggggccgtagcaaaaatcatgaaaaacacttcaacgtgtcctttcaatcatccaattaaatgtgggtagattaatgaaaatgtattacatcaatattaactcatctatagcactttgagtatctttgtagttcatgatatcctatcctataatgtggaggtaaatgattttatatgcattgggggtcatatataaaacttcaatgtaatttcactacaataaattgccttccttatttgaaagtaaaaatgttctttttttattgacatgttaactcctttccctcaattaatagaaatccactaagaaaatcattcacatattggttcactcaacaagcatttattaaatatatattcactattctagactaatagcaagaccggggatcttgtttaggaagaagcagtccctgttctccagaatttgcaaaaccattaaaaaagcacctactttaagccattttttttcagcaaggagtcattctgccagaaaaatgtagtacacaaatacaggataatataacaaatgtaaaatttctcatttctagtgaattaaactttccagtaattttacatctcacctcattcttatgatgctcagtttgcttaattattggcaaacataatggtaaaatgtttgtactgtattagagctttactgttcgattattaagatatttatccagtatcttagagatgctggacttcaattttccttattttatctttttaaaataaaatatcatgcatgcttctgatttgttatagaaatattttgtgttgagtcttttcggagatgatttatcaataatgggcaaagttaataatgttgtaaaatagactgctcaaggcagcatactcagacctaatattaaaaatactttattgatgggccaggtgtggtggctcacacctgtaatcccagcactttgggaggccgaggtgggcagatcatttgagattgggagtctgagaccagcctggccaacatggtgaaaccccatctctactaaaaatacaaaacatagctaggtgtggtgatgggtgcctgtagtcccagctacttgggaggctgaggcaggagaatcacttgaatctggaaggcagaggttgcagtgagctgagatcgtgccactgtactctagccagggtgacagagtgagactcagtctcaaaaaattaaaataataaataaataaaataaataataaaactttattaagccccaataatatataaatttcatggggcagagcttacctgactgctaacttaagaaaagcagtccttttccagagttggtcactaatagcaatagttacaattttagcatctaccacgtgccaggcactgtgctaagtatttcagtaccgaaaaaaaaaatcctctgcctctaataatagccacttcttattgagaatcagaggattcccatcaatagaccactaagactacaaaccaggaagttacaaatgtattcccactttaccattcacctgatctccgtgtgaccctactcaggtcacgaaaacccgactcaggtcacgaaaaccctacccaaatttccttattttaaaaaagtggaatgaaactggaagtcctctacacaaatgaatagcacattttgctgacgaacgtttaggagctccctgcccaagcaaatgtcattgttagtctttgaacagtgcagacagcaacagttgactatttcaaatattgcacagtgtggtagccccactcctatctatggagtccatctgcctttcaaacaggttttcccaacctggctcccaagtatattagtttttgagagctgctgtaaaaagtaccatagatcaggcggctcagaccacagaaatgtatgtttcacagttctgaaatccggaggtctaaggtcaaggtttcagcagggttggttccttctggggctgtgagggagaataggttccagggctctctccttagcacagatggcctcctccctgtgtctcttcacattatcttccctctacgtgagtctgtctccaaatttccccttcttctaaggacaccagttatactggattaggacacaacctaatgacctcattttacctctgtaaagaccctctctccaaatatagtcacattctgagatgttggggattaggacttcaacatatgaatttggatagggcaagacacaattcaacccataacaccaagtttttcaaaatactacttaatgataccttgaatatgccaataatttgaatatttcaccataaccagagagctagggcttctagtgagatttagatgacaataaaatgatgctttagtcaaggatccaggaacaccagagttctgtcctctattgacttcctaagggcccacactaatgacaaatgggacaatcacagatgtacctgatgcaaagtgtatagtaaaaccgggttggaagcctaattaggagcttaaacttaaattcaggtctgattccctgggagatgctctctcctccggtaaagagggggagaggtggatgacccatgatacacggattatctgtgctgacacactgtgcaccatgcccccaacccacacaccagcactactgaggactgaaagaaattaaaacttgtttcagaaatgttgacttgtgttaggtgcttttgcaggagcttagcaaaactaagattgcaccagaacttgaacgcaacaaatacaacacctgtgttacactggggtccctaggaagttgaagtcgcagctatggtttttagcgctaacaaaacaaatgacagttaatggccatagcacatcctatggccatagatagaatgtgcaaagagctacaaacactgtttatccttaggtttatcctaaattaaaagtatacattgatagataaattcttctgatcatgatctcactggaaaaatcgccaatacatgcttctctcttgaaaggtcagacagaaactcacatcggatgcgatcttacatgtttccagtttcttttttaattaaattatgtaatcttaactcttcctctgcaaaaagagaattactgaggaatcagaggtataaacgttttgctagaattggaagtgaatcactttttagcaatattttaaatgtggactgaacttctgcattatgttcactccagagtaaaaattaaatgtaaatgaggaaaaacaaatgggatgaagttcttcctcctactacaggctacaaagaggggggcattgtgaaacaagcaaacttgcagaatgcaaaatctggccagaaataggaaatgcagaatgttaacatctccgtggaaaaagaaagacaacgtgttgacacagaatgaatatacgacccaaattcacagaacctgagtctgtgaataccccgaaatctgctcccatgcacagggcactaaacctgtctgagctccggtttctccatctatcagatgagggtaatgataacttgcatcagttacggaacgcatgtaacagaaaacccagacaacagacgcttaaccaagaaggaggtttgtgcgctctatgaaaagaacagactggcagcccagggctgggatgaaggctcatggcctcctccggccccgggttccttcatactcagagccagttgcatggggctatgacctgtggacccaatgctagggtaattctctgctattggcatttttagagtattaataattgagaacaggagccttgcatttccactttgcactgggccctgcaaattatgtagccagtcttgtgcacaacttcaactttctagtctaccatcctttctgggaacatgatcctcttcccccaacctttccctccagatcccaagcaggaactttctgctcaataacctctacctccatcccagaggccagaacttagtacgtggcttctcttttttttttttttttttttttttgagacggagtctcactctgttgcccaagctggagtgcagtggcacgatctcggctcactgcaacctctgcctcctgggttcaagccattctcctgcctcagcctcccaagtagttggaagtacaggcgcatgccaccacacctagctaattttttgtattttagtagagacggggtttcaccgtgttgcccaggctggtcacgaactcctgagctcaggcaatctgcctgcctcggcctcccaaagagctgggattacaggcgtgagccaccgcactcggccagtacgtggctactcttaccagcagaggaacctaagaatacagtttttatagccaattgcctctcccagcaaaatcagtaagaaattaggagatggatactgcaaggccttgacacaaaagtcaaataaaagagatcgtaggtacaacgaaacaaatccaaatttagttgctcaatgattaaaaaggcaggataaagtagactatctacttaatatgagaccattgaaaatgttccatatgattaggaataataaaaagataaggtagataacagtctcaagagtatttcaattatttgtatgctcactgtgagaattttacaattatacaacagtagttttaagcaaaataaattagtaacaaatattggcctcctacaatataaaaatattgcatttgtataaggaatttacaatctagtagagaaataagacacctttgacagcaaaggtaagttccaagtgagtgataataacacaaaatacatagtagaaatgaatggctgcttcatggtctcattactttaggatatacttcacatttaaaggaaacttaaagatttcaaacaagtgcaagtacaacattcaaaacaattgtggaaggttccagctggatattcacttacaggatttggcaatatctttgagaagtaaatagttagatgttatttttccatctttgctgaaaagggcatttcttatccaaaatttgttttgaaaaacacaaagcagtagataaggtaactgctgatatacgggctgttcatctttccaaacaacacgtatcttgttagtttcctaaccaaggattttcaatgtcttcttaacactatttttattgagtctaaagtcctctgcctaccatctatcattcaaggcccttcttaatttaggcccatcctaagtaagcaaattcacttattttcttaactctctagtggctttctaccataaatcataattatgacaacagctaattatatatattaacaccaagaatctgagatatagctacagtggcgttcagatgaaaatttacatcctcatatgattatattaataaacaaaagtaaaaatgaatgaattcagcataccacttatggagctagaaaaggaaataataaaaataaagttgaaattaataatttagaaaacagaaaaagaataaaactgataaatacaaccaaagctggctctctgaaaaaataaataaaacaaacttctgcttaatctaagcaaggaaaagggagaaattaaaaacatacaacatgagaaatgctaatgggacaataactacagaaaattagaagaatcaaaagactactttgcaaatatatttgaatattctatgcaaatatatttgaagtactatatattataatacataatatacattatattaatatatattatattatatattgtattaatatatttgaatacgctatgcaactatatttgaaatatgaatgagattatcatttttctaggaagacataatttaccaacctgattacaaaaaacagaaaaatcttaagcagatttatttcatagatgaaacaaagaaactagccaaccactctccctaattccctaagtccagttggtttcacaggatttcttccaaatctttaaaaaacagatcattccagtgctatttaaactacctagactatgaaaaagaaaaaaaaaacttttaaattatcttgataaagcaactataactgctaccaaaacccagtaacaatttcacatacacaaaaaggaaaattacagatcagtcttacaaatattgatgtaaaaattataaaatattatctaatagaatatatgatgaccaagtgacatttattccaaaatgcaaatatgacttgatgtaggaattattaatatgatatatcatattaataagt

SEQ ID NO: 431 - DNA, 947 bp, Homo sapiens
ctgaatttccacctgcccgccccttcgcttataatgcagagcatgtgaagggagaccggctcggtctctctctctcccagtggactagaaggagcagagagttatgctgtttctcccattctttacagctcaccggatgtaaaagaactctggctagagaccctccaaggacagaggcacagccacacgggagtgaaatccacccctggacagtcagccgcaatactgatgaagctgagaagcagccacaatgcttcaaaaacactaaacgccaataatatggagacactaatcgaatgtcaatcagagggtgatatcaaggaacatcccctgttggcatcatgtgagagtgaagacagtatttgccagctcattgatttttctggggctttggagacagacttgaaagcatcgctatttgatcagcccttgtcaattatctgcggtgacagtgacacactccccagacccatccaggacattctcactattctatgccttaaaggcccttcaacggaagggatattcaggagagcagccaacgagaaagcccgtaaggagctgaaggaggagctcaactctggggatgcggtggatctggagaggctccccgtgcacctcctcgctgtggtctttaaggacttcctcagaagtatcccccggaagctactttcaagcgacctctttgaggagtggatgggtgctctggagatgcaggacgaggaggacagaatcgaggccctgaaacaggttgcagataagctcccccggcccaacctcctgctactcaagcacttggtctatgtgctgcacctcatcagcaagaactctgaggtgaacaggatggactccagcaatctggccatctgcattggacccaacatgctcaccctggagaatgaccagagcctgtcatttgaagcccagaaggacctgaacaacaaggt

SEQ ID NO: 432 - protein, 300 aa, Homo sapiens
  VARIANT (1)...(300): Xaa = Any Amino Acid
RETGSVSLSPSGLEGAESYAVSPILYSSPDVKELWLETLQGQRHSHTGVKSTPGQSAAILMKLRSSHNASKTLNANNMETLIECQSEGDIKEHPLLASCESEDSICQLIDFSGALETDLKASLFDQPLSIICGDSDTLPRPIQDILTILCLKGPSTEGIFRRAANEKARKELKEELNSGDAVDLERLPVHLLAVVFKDFLRSIPRKLLSSDLFEEWMGALEMQDEEDRIEALKQVADKLPRPNLLLLKHLVYVLHLISKNSEVNRMDSSNLAICIGPNMLTLENDQSLSFEAQKDLNNKX

SEQ ID NO: 433 - DNA, 24398 bp, Mus musculus
  misc_feature (1)...(24398): n = A,T,C or G
cctgcgctgaatgcaaacgatgcacagacatacatttaggcaaatgccaatacacataaaatgaaaataaacgtttttaaaattctaaaaaaacaaacaaaaaaaatttaaagggaagcaaccctgcctgagtggtcttattcctgtctggtgctgttcatgtcaggggatagttgaagtgttgggacaggttgcccaatactctgaattgggtaactaactacaccagagaagggttcagacaggggtttaagccaaaatagaaagtctttattagctggctggctactacactggggatatggaatcccagtgtagcactgagccttattcagggtgagcttttaagcacaagaattttttttaaaaaagatttacttattattatatctaagtacactgtatctgtcttcagacactccagaaaagggcatcagatctcattacggatgggttgtgagcctccatgtggttgctgggatttgaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaggaaaattaaaatttcatgacctgtcttggttatggaaagttccagacaagttgggcatctaagcaaaagcctgcctcaacagtaaaaagaatggggcccaggaatgcagctcagtggcggagggaggacttgactggcatcctcaggtccatccgacccaacacctcacaaacaagtactggaaataaaaagaagacgaaagactgggatgccacatcttttaaattcacattccattttggagaccctgaccctaagtttgaattcaggtaaactaacaggccagtacctagcattagtttccaagctacccctcaacaagacccgagcctagctccggtctctaggctaatcgccaacaagaccagcgtttccaggttacaccctcaataagaccagtgtctccaggttatttcctcaacaaacctgcacccctgggttacaagcccaccccctgcctaacgaccaccaatgcagaggacagcagaagttaagttatgatccgactcccagcaccagccagttatgttaaagaccacaggagcttgccaatcagatgcatgcacacgtactccatccctgctccctgctcgctgcttcctagagagccctgcctcctaggtgtagtggatgggagtgagtttacctccaattatttacaacaactggctgttgttttttgtttgtatttctccacaggaaaacgtgggttttgtcacatgtaagcttgtccttgtgattgaacactttagataggcattcggggatctcatcccatcccccaccaaaactgtcctgtgtgacagcggtgtgttgggtggcctgagctagcttgagtaaaggccctgctatgagttgcatcagattggctcctgtctgtgtttggggggatcactaacatttccctggcaccacaagactacagctcaagagcgaattacttcttagtatgtaggaggtcggaaagtcacacactgccttgaactctctttgtcatcctggcaggttttcaacttgtcatttcagtctgagtcagcttcctgcattgctgggatgataggcctgcactacggaatgcacccaggcctgctgctctcggaactttgcagcagggggtctgtggtcctggctgagtcaggaagattattggtgattccaggctgtcttacacacaggaacaccacctcatccttgctccgcgaagtaccagaagctttgccttgaattcttgagtgaagactgcggtgaaagtcaactcccatgggagctcagttgttcctattggaaggcctccagcagctgaccagcaggtggcgctaaacacccgtgcagccccttaggaatgaagggctctagctatacactaattctttctgtatgattttgactgccctgggctgggtctggagatggtccaataaggataaagagataataatctgtaatttcagtttagctggatgagcttagaactctggaggaagcacatagagggatctgagctcaataaagtgtctttaaaaaaaaaggttccaggctcaaagggaacctttcagggtggagaggtcaggccctagggctaccgttgtaatttacataaaggcagggatggtaaaatgtggaatagccctgaagtgtccttatgcaaagtacaaggtcgggacaaggacccagagtcatgtgagggctggggcagaaaattccaagaaaacaaaacaacaagaattcctatgacctcagtttctctaacccagggaattgttcttagaaggtgcttgtgtgccctccctggtgtagcgggtaagagtgagttcacctcagattatttacgaggcagttggtttttgtttgtatgtttctgtgggaaagaaatgtgggctttgccacgtgtagctgtccttgtgattgaacccctcactccggtgattcttccgaaccttcggatgtaaactgcccaaagctctgagactttagacctcctcatttcaggctccattcttccaggttccacctccgcaagaacagtagacgttaagaggtccgccctgccgtagaggctgcttaagggtgagaaaatggaactcgggaggaagaaagaggctggaacaaaccagaaagccaagcagcagccatcgcccttgtagactatccttcccctccctgaatcagtttctttgctcgacgtgcatttgcgtgtgtgtgtgtgtgtgtgtgtgtgtgtgtgtgtgtgtgtgtgtggtgctggaaactagtgcctcacatgcattaaacatgtcttttccagctgagcaaatctagcctttgtattcctgataaggttgccatgatcttcttatgactgagaaagctgccccagctgtcgggagctgggcactcctctgtggacagtgctgtcatggcctggtgacagacctgcagataatgtatgccatggggctggatataggaggggggtctccccagccagtgactgtgtgaactgggtcccagacagggaacaggagagaggagctggctaaaggggccctggggctgacagcctagatagaaagtaagggcatagtgtcctgcatgccctgagggttccccactccttaaaatggcagctgagaaaggcacgaatcagtccagcaaaagccagctaagtagggcctggcatggcacctgaaagcttgagttctatctaagtagctcctgagcatgggggaaagagtgttccaaggacaatctgaggcagccctcaggtgtggtagagggaggcctggagtcaggtgatcagcaggtttaagnnnnnnnnnnnnnnnnnnnntctctctctctctctctcctgctgtcctcttgcccctccccgttctcctcccccctctctcgccatgtgctcatggcctgcttctacttctctgctctctctctctctctctctctctctctctctcacacacacacacacacacacacacacacacacacacacacgacctttggtctgacaggactgagaccctgacaaagctcctcacacgggatgttcacctctttctggtttgtcccaccctctcagagctaagggtgctactccaggccagacaatgtgcttgtgtggggctcagactcccctgagtcctgtcccatccctgactccagattagcactagcagattacaaactggacttctgcaagggggtggtttgggagtgaaagagacaggttagtgttgtgctttataaagagagggaaggactatgtttagtggctgtgaggtcaggtattggggaagggggtgcctctgcgggcccatgccaaggcatcccttccccctgacggaccagacacaagaaggcaaagtatagaatagagtttatttaaggcatgggggaggggagttgagagaaagtcagagagagtagagtagtagaagccagccatgagcacatggagagaggggggaggggaatggagagaggagagcaagcaggcaagagagagcagaaagggccagcagccccttcatagtgaatcagccacacctgtttcttgccaggtaactgggacagagcccaaagtgctaacagttgggatggaagctcctacccattctctcttacacccacaccctagttttggaccccactcacatacactccagtctctctcatccttcttttccagggtcttccagttttactgaactgtgcctgcaccagccgcttatatcccaataatggtcagccacattgggacgtgagccggaaacagtttcatgccgttgcctgcggctgcctaagcagcttccttctagctaggtgaaaccgggctgctgctttgttgtttggttggtttggtttttcgagacagggtttctctgtgtcctggctgtcctggaactcactctgtagaccaggctggcctcgaactcagaatctacctgcctctgcctcccaagtgctgagagtaaaggtgtgtgccaccaccacctgacaaaaacagcattcttaactttactgttgaaaagatgtttgagacaagctagtgtcaagtagagctagaatttaagaggaaattttaacatatatttaagcaggaggatcaataactgctcaggaaaagcaagacacacacacgcacacatacaaactcaggagagttgtgctcaagtgtcaactcagtagctatatataggatcgcagtggcttctagagttatgtttcaaaggggtgctgaagaacttagatgagaccctagggtgggccctggggtgcactgaataagatgacaactaagagccataggccaccaaggggtcaaacagagttaagatgtttttaatcacaagccaaagttttaggctagtctgtgagattcccagaacattttgaactcacatctagaaagggcatgagggcagagatgcctagacattttaggtttctgccgtcgtaacgtgcaattagtgttttgcctgaatgtaggtctgtgtgagggtgtgaattccctaaaactgaagttacagacagctgtgagctgctacatgggtgctgagaatggaactctcctgcatgatgcttgagtcttttttattttttatttatgttttaagatttattatatgtaagtacactgtagctgtcttcagacacaccagacgagggcgtcagatcttattatggatggttgtgagccatcatgtggtttctgggaattgaactcaggaccttcagaagagcagtcagtgctcttaaccactgagccatctctccagtcccgatgcttgggtcttaagcatggttcattttaacttttttttttgtttcagtttatttttctgtctatgaagagctgtttgcctgaatgaatggctgtgtactgtgtacatgcagtatgcttggagtcagacccctgggacttccagctgtcatctagggtgctggacttgaacccgggttctctggaggagcagccagggttcttaactgctgagtcatctcttcagcctttcatttttagcattcttattttaaatctctatttacaaggtgttgtgttttataaaaagataaggagaggggggatatgtttggtgaaggtggagtcagatgtcaaggtgtcaggtatgggggaagtggtgcctctgccggcccctgctgaggcatcctttctcccctgagggaccaggggagttgagagggtagtaaagacagagaaaggcaaagagagagagagagagagagggagagagagagcgagcgagcgagagagcgagcagagaagtagaagtcggccatgagcacaggctagagaggggggaggagaaggggggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncctttaaacttgcttcctctactggtttcctttttagcattttagttgattggttggttgctggcctgattgataacaggagaccttaagccagcatcttggccttcagtcccagctacttggaaggctgagataggaagatggaaattcagtctgcctgtgctaaagttcccttaaagcaagtattggcaactgagagcctgttctggcccagtggagggcctagcttgcctagtgtatcacataggtagccttgggttcattcctggtgtggagaccacaaaaccaaaactaaaaagcaaaagtcccttctagggtagagatcctaacagcttggagcttgacttgtggtttttatgcaaacaattaaaaatcaacacctaatagtcctggcacccaacacaaaaggccagtcttagggaaaaggagtggccctggagagtacagctggggacgatgatacacacctcaacaggagcaggcagatctatgtgaattcagggccagcctgctctgcatagcaaggggttgcaaaatgtgatcctgtataaaaaaagctaatacctcaaaaaagaaaactgtttctacttaatgcccccactcagttcagagaggggggccagaggtctttcctcagctgctgggaaagggcctcgttccctggagggagggcgagatggagatgggtgactttcttcctctcccagaggaaattgcctgctgtgtttttgtccacagagcacattctttcttctttcttccccccaactcccccagacagggtttccctggttgtcctggaactcaccctgtagaccaggctgtcatcaaactcagaaatccacctgcctctgactccctcccgagtgcttggattaaaaaggcttatgccaccactgcctggcttcctctttcccggcttcttttctttctaagcttttatttattattttatgtgtattggtgttttgcctacatgtatgtttgtgtgaaggtgtcagatattggagttatggacagctgtgagctgccttgtgggtgttgggaattgaacctgggtcctctggaagaccagtccatgcttttaaccactgagctatctctccagcccttttctttctaatcttagtaatcgttttgtcagcaggaaaagatgcggaaataggaaatacagggtgggagtaacccaaaggaaaggtatggggagtgaaaccgaagcctatattaaagataaacaaacaaggaaactatcttttgggtcacgttaatcgcccaaagtaacttcgtatgtacaccatatgaaggtgcttcaaaaatcaggatagagtgttttatatgaccattttttgactgcgtgtgcctgtgcaccatgtgtgttcctggtgcccgtggaggccagagaggatagtttatttccaagaactgtagtaactggtggttgtgagctgccttaacgtgcgtgtttggcaccactaactgctcccagccatctctctagtcctttacacttattttcacactgtgcgagtgtgtgtgtgtatgggcacgtgggagacacagcgctgaaggctagctttttttcccacgctctgggtggcagatatcaaacccaagcacctttactggaagagccatctttccagccccaaaattacagtaaattaaggtagcacaaatttgatacaaaatccctcacaacgcccaatttgagggtcatagcttttggtcaaagagaaatccccaagcactctggacggatttgtaagacccaccgtgtaaggtctctcagtaagcccactgtaaggcttcagaacacactccagcggggtcagccctgaaattcagactacgcaaccagaaccccagtccgggaggcgccccacccatcaaggtggaagccagggggggggcgggactcgcctcctgcggggtccgcgttcccaaagggagcccgaagggggaccttttgcctgcaaggacctaaagcgccgcagaggaccgcgaggttcacacaacacgcgcgcgttcccatggggacgtcccttttacagagcgccggggaaaagaagccttagaccacagggctcacatggaggcttcaggcgcatgcgctggctggcccgtccgcgcgcgcgcgcgcggcccgggaaggcgcccggcccgccgagcgttccggactgcgcatgtgcagagcacctggctgtggaggaggggcttgctttcgttctccgcgcgggttcggcgcgctccaggtggaggggcggggcccgtctattgcgcaggcgcgggcgcgcggccgaggcgacggttggggagggttcttccggaaggttcgggaggcttctggaaagaagcgccgcgcgctgggcgggcccgcctctatataaggccggcgcagggggcggcgcgccagttgcttcagtgtcctggtgcggagcgtcacgtctcgtgcgtgttcattcagccacggtgagtgatggcgcaggcggacttagcgggggcttggggagcagggccgtaggttgctggcgccgcggcggcagcggggccgccatccgagttccctcagcccgcggaggtgggcggccacggcttccgaccctaggccccaggcgggcctcatatctacgccccaggccggggatgcggcaatggccgccgaggaggagcggtggcggcggcgaggcgggcgcggggcgagcgaagcgagggttgggctgtcgccggtgccgccgaggcgcgggcgggcgagggaggcgccatagcggcgggttgggggagggtggccgttaggaacggcgtgcgtggagccgcccgggtccgaacgtcctcccggaggcgcgcacatgcgcttcgtaattaccgcattctgaaatgaggtcatccctttgtcatccaccccccgccccgtcgcccttttctatttcgtccctttcttagtccaaaatagagtcggtaagagacctctatagaggaggggcggtcgttagcacgcctgcagccattctgtgaggctttagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatttcaccttggggtttgcgcttgacggttttttcatttttaatcttttcttaataggctctggataaaatccgttacgagagcctgacggaccccagtaaactggactcggggaaggagctgcacatcaatctcattcccagcaaacaggaccgaaccctgaccattgtggataccgggattggaatgaccaaggccgacttgatcaataaccttggcaccattgccaagtcgggcaccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatccttcacagtgaggactgacacaggtaggtagacagaggccaaaaggaatgtattcaattgtagggggtgtctggttaacttcagtaagtgcttgagagggttaacttggagagttgaagagttaaagagcagtctggcatacatagccttagtgctaagtcctgagcttttcaacaaaattgttaatctaaagggagcttcaggacctgggctaggaaataggaaaaatgtatggctgtttgctcagttgtacatcttgggcaaggaagttaaagctttggagacctttgcatttgtggggaaggttagctgctaggaaacctccagcaagcatggaggctttgaatagtaaccattgcccttttcttttccaggtgaaccaatgggtcgtggaacaaaggttatcttgcatctgaaagaagaccaaacagagtatttggaggaaaggagaataaaggagatcgtgaagaagcattctcagttcattggctatcccattactctctttgtaagttacctacagggtaaatttcatataattgagataactgaggctgtttagagttctgtgaacctggtgttgtactagacagattagcctgtttggaaaggtggtatctgaagaggattgtggagaaattagagaaactactgatgagaggcttcttggttgtacacatttctgagatctgtcctagttgtataaatttataatgaagtgatttgcctttcaaggtggagaaggaacgagataaggaagtcagtgatgatgaggctgaagaaaaggaagagaaagaggaagagaaagaaaaagaagaaaaggagtctgatgataaacctgaaatagaagatgttggctctgatgaagaagaggaggagaagaaggatggtgacaagaagaaaaagaagaagataaaggaaaagtacattgatcaagaagaactcaacaaaacaaagccgatttggacgagaaatcctgatgacatcactaatgaggaatatggagagttctacaagagcttaactaacgattgggaagaacacttggcagtaaaggtgagtgacttaaaagcaggttttcaggttgactttttaaacctctatactcacctatagaaaagcttcgaagtgtaacttagcccagtagagaaagccaattcattttgtccatggcattaaaaggttgtttcattttattgcagcatttttctgttgaaggacaattagaattccgggcccttctttttgtcccaagacgcgctccttttgatctgtttgaaaacagaaagaaaaagaacaacatcaagttgtatgttcgcagagtttttatcatggataactgtgaggaattaatccctgagtatctgagtaagtagggatgggaagaatcggcactgttgacagacagaaaatcccattccttgggtctgtgttggtgggggactgaggatgtaacctagtggagacggggtttgcctaacttgtttgaggctctgggctcagtccccttggaaaaaagccaaaaagattccttaggtttcagaatgattaaataggtgtctttgtttttccccagatttcattagaggggtagtggattctgaggatctccctctaaatatttcccgtgaaatgctgcaacaaagtaaaattctgaaagttatcagaaagaatttggtcaagaaatgcttagaactatttactgaactagcagaagataaagagaactacaaaaagttttatgagcagttctcaaaaaatataaaggttggtggtacattttcttgttactggcagttttccaaactaacttgattgggggaggggtcctcacacacttgcttctgcctcccaagtgtggggattaaaggctaatgcttcataaatggctttcctgtgcttgtgcttcagcttggaattcacgaggactctcagaatcggaagaagctttcagagctgttgcggtactacacatctgcttctggggacgagatggtttctctgaaggactactgtaccagaatgaaggaaaaccagaagcacatctattttatcacaggtaatggtcaagtaaacaggtgttttctctacctgttggacagcacttaaggaggcaagaatgtccagcctctacctaagggaaagctgaatatatgaaaccatttctaaaagtaacttaacaatataaatatatatattgtctcaggtgagaccaaggaccaggttgctaactccgcctttgtggaacgtctccgaaagcatggcttagaagtaatttatatgattgagcccattgatgagtattgtgtgcaacagctgaaggaatttgagggcaagaccttggtgtctgttaccaaagaaggactggaacttccagaagatgaagaggaaaagaagaaacaggaagagaaaaagacaaaatttgagaacctctgcaaaattatgaaagatattttggagaagaaggttgaaaaggtatgtgaatggttacacatcactcgtagtcagtttggtccttttatctgagttttgactaaatcactgctaatgcctacagtttcaaataatcatttctttctggtaagttcttctatggcctaagccatcacttagtttttgttttaattttaggtggttgtgtcaaaccgactggtgacatccccgtgctgtattgtcacaagcacatatgggtggacagcaaacatggagagaatcatgaaagctcaagccctcagagacaactcaacaatgggttacatggcagcaaagaaacacctggagataaatcctgatcactccattattgaaaccttaaggcaaaaggcagaggctgacaagaatgacaaatctgtgaaggatctggtcatcttgctgtatgaaactgcactcctatcttctggcttcagtctggaagatccccagacccatgctaacaggatctacaggatgatcaagcttggtctaggtaaattacaggctacctgtaactaacataagggaaagaaacctgttgcaactcccctttaatcctagtgctggggtcagggtgtaaagggacagataggccagtctctttgagttttaggccagtgtggcctacagagttccaggaaaaccaaagctatatatactaaccctggctttaaaaacaaaaaaacgaagttgacttttgtagctattgaaacaattggattattgctgttatgggagcctcagctaaagggtttgaatgaaatgaacagtgacctttgtgtttgaggatggctttgggctggttctgcctctgtcccagtgctggggtttataggcacatacttggcttgccccctatgaataaagtttcctttcaggggattggatggggtgttaatgtctaaagcaagtctccgcctcccttagcggacattaactgtaacatttatttccaaaacaaggtattgatgaggatgatcctactgtggatgacaccagtgctgctgtaactgaagaaatgcctcccctggaaggagatgacgacacatcacgcatggaagaagtagactaagtcaccagaactatgtgtttgcttaccttcattccttctgataatatattttccatgatttttgtttatttttgttaacatttaaaacatctgtgtggcatgaaaactaaggggaagataaaatttctacatgtgatactgtgatactataggtttaactcaagaggttgatagagcgtttgttataagacgtaacgtaacctactgttcatgtttgctctggtctgaagtgtttagctgttgagctggattccttaggagaccaaattaagatggcttaaattacatcttaaaattttcatttcctgtagttaattctgcatgtattagtcttagaagtaaacacaagttaaaacaacctgacaggaattccccaagtggcttgttttccaaagtcccgagaacaaccctaagtttcctaggtcttgtaactcagcaaggcttgtgagtggaaataacagtgcccaatcacattctgctttaaaagataaatacagaggagataaaaagaagtgtggaatgtgtctttctttgcacactccccccccacacacacacacatttgatccataaaaattacactggtccagagacttaatcttgtgtgtcctatatgtggacatcctctcttccccagcacactcagatcttcttgctagagtgggaatataaaacagctggtctgtggggttctgggattttgtcctagcacctcttagataaaggcatgtttgaagacttggctgggtagtttgaggccagcctgagttccatgaaatcctgtcttggaggctataaggaaaaatagtgggtatttactatagggggcaggtaaagagcactaaccaaagccgggcggtggtggcgcacgcctttaatcccggcaggtggatttctgagttctaggccagccagggctataaggagaaacaaaaccaaaaaaaaaagattgggttgtaggcggccctataagacattaataagttggggctggtgagatggctcagtgggtaagagcacccgactgctcttccgaaggcccggagttcaaatcccagcaaccacatggtggctcacaaccatccgtaacgagatctgacgccctcttctggagtgtctgaagacagctacagtgtacttacatataataaatcttaaaaaaaaaaaaaaagacattaataagttgatgagctcattgtaggtggtgccatccaggattctataaggctgagcaagccagtaagcagcaccttctatggcttctccctccattcctgaccctcttatgtcctgtggagatgtccagcaaataaactccccttttctcccccaagctgctctggtcatggtatttcattgtggcgatagaaaccctaagacaatcccttaagaacttttttacagttttaattactgttgtgaatatattcgttctgtataatcatcttccaacttgacttcccatctggcaaccaccatacaactttcccattgcttttgagttcttacatagcctaggctggccttgaattcatgcctccgcttatgtgacaagatggaacctagggcttaatgtatgctgaacaagtacttaagttacgtagcccaggttgactcctgcctctccccgtgctggaacctagctctaaagaggcaaggaagtgggaccctacaggatttggcttgtgtctctgtaatatcatttacttgtgtatctgacaccaaaccctctttgctggtctcactttgcagaaagcaactttaatgatttagaacactaggacttcctacttctttagccaattgtgaccaagcaatggttctcaggctttcaaatgatgaccctttaatagttcatattgggatggcccccaaccactgcttattttctgatttttcttatctacttaggcaacctaggtttcacaaccactgtcttagcatcttagcacctttgaaggatgtaatgtgataagcacttaccaattccttagtactgtttacaggagaacaagactcacttgctacctccatttccccctccccaccacctatcattcacatcagaatcctaacttaatgtactgccttcactttgctcttctactacatccaggactgcgggcacacacacatcatgtactagactagcacactattcacaaacttatcacttagatgggcagaatctccctacaaagtgcatcctggctttaaccctctgcctcctgagtgctgggattaaaggcatgcaccaccaccgcccagcaacccaatctttaaaaaaaaatttttttatatgagtacactgtagctgtactgatggttgtgagctatcatgtggttgctgggaattgaactcaggatctcttctccagcccgaagattatataagtacactgtagctgtcttcagacacaccagaagagggtgtccgatcccattacagttgtgagccaccatgtggttgctgggacttaaactcaggacctctggaagagcagtcagtgctcttaactgctgagccatctctccagcccctacaagccaatcttcaggaggcattttcttgagattccctcctctcattttagctggtataaagctgacacaaaactgtccagtctagggactcaattcaatttgacagagtcaaaagttagccttaacttcccagagctaagtgtcctcaagctcttgtcctcccaagtgtggcgttggactcaggacctttggaagagcggtcagtgctcttaaccactgagccatctctccagccccatgtcctactcttgatgtgtgttcagtcctggagattgaatgtagagcttcatgtatgttaggtgggtactgtcactgagttaagataatatatcctaggcttattttttttcttgtgagaccttcatgtagctcaggctgattcagaacttgctattacagtactgggattacagacataagccaacatgcccaattcatgcaactgttttctattcttttttttttttttttttttttttggtttttcgagacagggtttctctgtgtagccctggctgtcctggaactcactttgtagaccaggttggccttgtactcagaaatccgcctgcctctgcctcccaagtgctggggtcaaaggcgtgcgccaccacctcctgggtgcaactgttttcaaaacattttcttattcccaaacagcagccctgactgggggagcagtgacttggctggaacaatctctctgcccttgtgtatcagatgaacactttacatcttctgcttctgtttagatgtcactcttcggaaccttttcgtgacagacgcccctaacaccctccttgcaccctctactttccttccctccctttggtgctggaggtgaagccagtacctctcacaacacactgtcggtgtgagggtacccccagcctgcactgaacctcccctaggagcattcattgcacactaactaatggaacagaacgcaggctggtcacagccggcctgcctcctgccagctggaaaggagggtgtggatagaaactgttaactgctggcttggagcccaaggcacgtgcctgattcatgtttgtgcaatgactaactggcaagtacaattgatactttacctaggaaggcaattcatttacatttgtaccatttaggaagctttgttgtgtgtcttgtcccatcctgccctccaccccaccctgcccgagtgttctgggtgtgttcagacctttaaagaatgatttgcagagaagtcttccatgggaaggaacatcacctccctaggaagaacattccagaaagctgcacttctggtgagtcactgtatattaatagcaccgccaaaatccaaacaaagattagtacgttactgcagaaccaaagactggcagtatcaaagcacttgtttagggtttctttctttttttttttctttgaggtttgttttgttttaattgtgaatacgtgtgccttgtgtgagggtttgagcataatgaagcacaattggaagtaggaagacattgggtcctgaagcggcagttacaggcacctgtaggttgcctgatgcgggtgctaggaagcaaagccaagtcctgcactagagtgccctgtgctttttttctttaatatttattttatttatatgagtacactgtccctgtcttcagacccatcagaagagggcatcagatcccattacagatggttgtgagccaccatgtggttgctgggaattgaattcaggacccctggaagagcagtcagtgctttataaccactgagccatctctccagcccctgtaacatgtgctcttaatgctgagccatctctccagccccaagcactttctgtagattccagattaaaaacaaccccagcagggtatggtggcacactctggaggtagaagtgggtgggtctgtgagttcgaggccagcctggtctacagagtgagctccaagacagccagggctacacagagaaaccttgtcacgaaaaaacaaaaaaaagaaagtgaaaaaaatatttttttttctttgtgtgtgtgtgcacatgccacatgttcccaggtacccaaggaggccagaagaggatgctgtacctcttgggactggagttacctacagatggttgtaagccaccgtgtggctgcagagaatgaaggcaggtcctctgcaagagccactgagccagtctccagcccttatttatattttctgttttttgtttagttgttttgttggtttcacacaggatcttaactaagtaactggagatgactgggaacccctgcccttcctgtttctacttccccagtactgggaccacaggcatgtgccattttggtggtttgttttaagacagcatctactatgtagcacaagttaacctaaaactcatgatgatacatgctcctgcctcagcctcccagttgctgggattgcaggcctgctaccacaccgtgcagaataacacaccgtgcagaaacgcattctatttatttttaatttatgttaccgtgtgtgtttgtgtgcatgtgcacacgtgtggttagaggacagcttctaggggactgttcacttcttccaaaatgtgggtccaggctgtcagactcagcagcaagtgcctttacctgttgagccaattcaccagcctcaggaattggattttcaattgaagtctgatgggggtgtgttattaatcccagcactcaggaaccatagtcaggaatagctctctgagttcaagaccagcctagtctacataatgagttccccctgccctaccgcctgaattacgggcaggaccctttctcaaatacaaagaaaccaccaaacaagatcaaaccatccaggtctgacaatacaatctactctctgacctttaccttgaacacaagtttggcatagctgagaagtttcaatgcttcccctcactgagaactggcttcaactggagacattttgcctgctaatcttagaagaaatgtatatgaacgtcctgtgtgggccacatggaaaattcaagaaagcctagctgtcctggaactagacacgcctggtaattctagtcgattgcaattaaacacgctgagcaatacagaagcatccagacaaaactaagggacccacagagtatttggttttcgctgttctacataaaccctccggagacggaggcaagtgtcagaacactggccaagaatggagtcacatgatggcaattctgagcgcttgtgagaaagcaagagtcttgtgatctcggcttcttcaaaaccatagcgttggtcttgggctgcgctagctgcccctcccaggtgtagagaacgggagtgagtttacttcagattattcactaagatggccggggctattggtgtatatgcctccatgggagacctttgggccacgtggggcttgtctgtgtgattatatacaacttgaatttgtgagaataatgacactcaggcatccactctggctcagtagttaagaacactggctgctctttcagaggactgggttcaattcccaacacccacttgatgcctcataactgtaactccagttctatgggatccgatgtccttggctggccgccgcaagccattggtggcttacccagcacagtaagccagcatggtggctggtcccttttgtgctccaataaccaacttcaggcaacaagtgtcctctggtgcaacagttgtgtgaaggttccaggggcaaccaatccttctctgattggatctgaggtgtgctccccacgagaaaagtcatccctgggactgtaaccctgtcagaatcctgtggcttaggaggtcacaggacccggggagagcctactgctgtcccgctagatggacttgctgaactttatgcctctatcacaggttactgctgctttcagccttagccagactctttctgctgtgggcagcaatacagacaggctcgcaactgtcaaagcactgggaataggtgactgttgagagcctggccctaagtaggacgtctgtatcagcagccaaggtcaggaaatagggaagagggaccaaaaagaacacaagatctgcagaatgggagtcctgggaaatactgtcttctgcatagtacagagaatcgcatgtatggacagctcccgtgactgcacaaagcctagacaaccaagccaagaaggccagctaatgttccagccagcaatactaggtaaactcggtgggttgccaaagacgaagtcacaagagcgggagggggacatgttgagggacatcaggagggaagagtcgaagtggataagatcaaaatgtgttgtatacacagacgcagttgccaaagaataaatgaaagatgcagaaaaaagagaagggatgtgtaaggcagccaggtgtgccactcaacggtagagcttgtgtgtggcctttgtaaggtgctaattggatctctgccgtcccgtcccatatctgcttctcccactctgggatagtcaggcccctcactcacccgcctggactggagggagagattagctggggcgagtgagtgcaggtagaatttttgggtcagtggtgagttcaagggcaagggacacacacacaacacaggaacagctttgggtttattggtgtggggagaggggtatttatgccccccggaggtgccagggttactgggacaaggttggtgtggctgccaattatcattggctagggaaggagtgttggaagactcaggggaggagggagccttatagggtcaaacaaaagtactaaattcctactagggttaatggtgggacagctggcttcatggtgtcaggttggaagcgtgtgtgtgtgtgtgtgtgtgtgtgtgtgtgtgtgtgtgtaactaactcctgctatcctcatctgaggtatccagggttgaagcactcttccgcctttcctctgcagtcctgggccatagatttctagcataaaaagaataaaagacagggctggagagatggctgagcagttaggaccacgtgctgttcttgcagaagacacaggttcagtacccagcatccatctggtggcttataaccatcttaccccacttgcagagaatctgacaccctcttctggcatccagtggcaggcacatgggcaagacactcataacacttaaaataacttttgaaagactagtctttaaaaaaataaaaggataaaggaaaaacagaaagaatacccaataccagtaggttgtgccctctgagtatgttggaatgtggcctgaggggtgtctgcccactgcagctggtctgcagctggtcttggctctcagattgggtatgactggctgcaggtgtcccagcttctcgcttagagatacagtttctcaagggatcttttatgtcccttaataatccattcttacttccttaggtgtttgttgtggagatggggtctcatgtagcccaggctggccttgaacttagcaagtagccaaggatggccttgactcttcctgcctctacctcctgggtcctgcctgggatggccaccacacatggcttccttccttgagtcttgcactgggctccacatgtgcccgatttctctgtgtggctttccatttgtgtatttcggaggtaccaaagggtcagtgagacaagaaactcccccaggctcccaacccattgcctgttactgaattattccctcatcttgttcccttttccttaatgcctctctgtcctcatgcatacgcagggactgggaaccacctttaaaggcacaggtgaccaagggacgctctttctcatccatagcttgagtgtcctgggagttcaagttggctcagaaattgggattcaaagtccccagggcagctagggaatagcagaagaggaaccagatggcagaggggacggcttggctcctttaacccgagtgtcccacagaaggaagagctgtgggcaactggaaggggagatggcctagtgacctgactataagaggaactaggtggcagggtgggacaaaaccggctgtgtggccagaatgagaatttagaagctatcctaaggcacaggacagtcctcgaagtcttggtggcctctctggtcttaagtgcaccccagcagagtgccttgcacccaaggaaggaaaggctttgaggagccctgtggctgttgaggatcaggcctgtatgcacagggtagagacaactacccatgctgtgtgaagcaggcaggcagcagaactcggggcgcagggaactgagggggggaactgggaactgtggtttagggcctatggtccggagtgcacacgtggatctcttcccagtcacagccccaggagcattcacactgggttgccatggagatacctgtgacatcatgcaggcctaaagcacaggatacctgcctcctcccttcttgtctcacaggtgattccctggggaccaaaatgaacatgctacccaggaggtaagtctagaatggcagtaccttgtcctccaaaccagaagcctggagccaatgagctttaaataaccattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 434 - DNA, 2550 bp, Mus musculus
gctctggataaaatccgttacgagagcctgacggaccccagtaaactggactcggggaaggagctgcacatcaatctcattcccagcaaacaggaccgaaccctgaccattgtggataccgggattggaatgaccaaggccgacttgatcaataaccttggcaccattgccaagtcgggcaccaaagccttcatggaggctttgcaggctggtgcagatatctctatgattggccagtttggtgttggtttttactctgcctatttggttgctgagaaagtgactgtcatcacgaagcataacgacgatgagcagtatgcctgggagtcctcagctgggggatccttcacagtgaggactgacacaggtgaaccaatgggtcgtggaacaaaggttatcttgcatctgaaagaagaccaaacagagtatttggaggaaaggagaataaaggagatcgtgaagaagcattctcagttcattggctatcccattactctctttgtggagaaggaacgagataaggaagtcagtgatgatgaggctgaagaaaaggaagagaaagaggaagagaaagaaaaagaagaaaaggagtctgatgataaacctgaaatagaagatgttggctctgatgaagaagaggaggagaagaaggatggtgacaagaagaaaaagaagaagataaaggaaaagtacattgatcaagaagaactcaacaaaacaaagccgatttggacgagaaatcctgatgacatcactaatgaggaatatggagagttctacaagagcttaactaacgattgggaagaacacttggcagtaaagcatttttctgttgaaggacaattagaattccgggcccttctttttgtcccaagacgcgctccttttgatctgtttgaaaacagaaagaaaaagaacaacatcaagttgtatgttcgcagagtttttatcatggataactgtgaggaattaatccctgagtatctgaatttcattagaggggtagtggattctgaggatctccctctaaatatttcccgtgaaatgctgcaacaaagtaaaattctgaaagttatcagaaagaatttggtcaagaaatgcttagaactatttactgaactagcagaagataaagagaactacaaaaagttttatgagcagttctcaaaaaatataaagcttggaattcacgaggactctcagaatcggaagaagctttcagagctgttgcggtactacacatctgcttctggggacgagatggtttctctgaaggactactgtaccagaatgaaggaaaaccagaagcacatctattttatcacaggtgagaccaaggaccaggttgctaactccgcctttgtggaacgtctccgaaagcatggcttagaagtaatttatatgattgagcccattgatgagtattgtgtgcaacagctgaaggaatttgagggcaagaccttggtgtctgttaccaaagaaggactggaacttccagaagatgaagaggaaaagaagaaacaggaagagaaaaagacaaaatttgagaacctctgcaaaattatgaaagatattttggagaagaaggttgaaaaggtggttgtgtcaaaccgactggtgacatccccgtgctgtattgtcacaagcacatatgggtggacagcaaacatggagagaatcatgaaagctcaagccctcagagacaactcaacaatgggttacatggcagcaaagaaacacctggagataaatcctgatcactccattattgaaaccttaaggcaaaaggcagaggctgacaagaatgacaaatctgtgaaggatctggtcatcttgctgtatgaaactgcactcctatcttctggcttcagtctggaagatccccagacccatgctaacaggatctacaggatgatcaagcttggtctaggtattgatgaggatgatcctactgtggatgacaccagtgctgctgtaactgaagaaatgcctcccctggaaggagatgacgacacatcacgcatggaagaagtagactaagtcaccagaactatgtgtttgcttaccttcattccttctgataatatattttccatgatttttgtttatttttgttaacatttaaaacatctgtgtggcatgaaaactaaggggaagataaaatttctacatgtgatactgtgatactataggtttaactcaagaggttgatagagcgtttgttataagacgtaacgtaacctactgttcatgtttgctctggtctgaagtgtttagctgttgagctggattccttaggagaccaaattaagatggcttaaattacatcttaaaattttcatttcctgtagttaattctgcatgtattagtcttagaagtaaacacaagttaaaacaacctgacaggaattccccaagtggcttgttttccaaagtcccgagaacaaccctaagtttcctaggtcttgtaactcagcaaggcttgtgagtggaaataacagtgcccaatcacattctgctttaaaagataaatacagaggagataaaaag

SEQ ID NO: 435 - protein, 679 aa, Mus musculus
ALDKIRYESLTDPSKLDSGKELHINLIPSKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEEKEEEKEKEEKESDDKPEIEDVGSDEEEEEKKDGDKKKKKKIKEKYIDQEELNKTKPIWTRNPDDITNEEYGEFYKSLTNDWEEHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYFITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTVDDTSAAVTEEMPPLEGDDDTSRMEEVD

SEQ ID NO: 436 - DNA, 26418 bp, Homo sapiens
agcaaggtgtggtagtgggcgcctataatcccagctattcgggaggctgaggcagagaatcacttgaacccaggaggtggaggttgcagtgagctgagatcactccactgcactccagcctgggcgacagagcgagactgtgtctcaagaaaaaaaaaaattgctttcttctcttacacagtttcattcccactccatgaaaggctagaagctttgccatgaacttttcagggtgaaacattaatgatggtgatctatactggaggtcacataattctcattttcctgattctcccatacacagggaataacgaaaaaatgaaattcctaaacttcaaagacatttccaactggaggccccatatacaaccaattagctggccagtgggtggcgccaaaggtttatcacggcctttgggcgaagggttcccatttggtcccgctggaaagcaattcagttatccattcagcacacatagatggctgtgtgccatgtgctgcgtcttgagacgagaaagacagagtctaatttcaattcacaccagggactaagagctgtggaggaggcatccagagtgaatttggccagagcaggtgatttccaagccaagcttggcagacacgtatttgcctggagaagggcatcgcaagaggttccaggtgcatttggagaacaacccagcatgaagagatgatcgggggcagaccgtagacccttgggctgctgcagtaatcagagtgaatgaaaaggaatgctgtaatgttgaatctgaggggccctgagtgcacttagcaggatctgctgcccctggaggctggagggaggggcgagagaatggagctgctgtgagctcggaggaggtgaggctggaacaaaaccagaaaacaatgcagccacatattcttggtgcacaccccacccctacctcccttttctccgtatctatttctctgccatgttcttaaattaccaggtcccctggtcaggtctgaccatggtgccccattaggctgccttggggaactcaggtgggttgtgggcagggctggaggtgccttggtgacatgtgggtgcccagcattccaggtctgagagcaccaagatcaggcatggagatgggcacaggagggggcctcccaaggaaggtgtgtgttgcaggcagaggtggggtcagccaggccctgggatttgaataccaagagagggactacaggctcagtgtcctgggagcccaggggttttctgcactgggaagtgggcagatgaaaacgggaatgtagaatagataaacccagcaagacccagctggaagtggaaatggtgtggggccctgagggcctggatcagggcaggaccctaagcacagagagaaagaacgttttaaaggaaaaatccaccagacttgtcagctgtcagaatgtgggggctgaaggcaagagatgagtcaaagatgactcagaagatttgaaggtgagttcaagggaaaatggcagtactttggggaaggagttcaaattcgtgtccaggacccctggttctgctaggagacaggagcatgcccaaaggcatcccacttgtttgtatgtttctggcctgtccctccccgactagaacagaagttcctgagggagctgcctctgctctgtcagttctttgtgctttactcagaggggctcacgcacatctgtcccctgcctgactcagagcagatgccaggggatgcagactgaggcttccgcaggagggaggctagggaggcctgcaggtgaggggtgatagggaagaaagagtcccgccacccctctcccacaggtgctcccacacccaagcacccccaggactggaccctctcacaggcacagcctcctgtcccccaggcctctcttcctctgagatcccaggctttctggccctactgagactgccatcctgggaaccgtctttgtgcccatccatgcctgtcccattgccttccttctcaatacatcccttctaccacattcctgctcatgttcccagcatcctgttcattggaggcccatccacgtggatgcgcagcagacactgtggtccaacaaaggtgacactgaaccattggcaagggtcacctgccatcatctgcctgagccctatgttcccctggtgaacacagcctcacccacccgggagcctctggggctcctgtgcttcaccctgttaactcgctcccctgacctctcccaagtttgcccctgctacacccaccaactcttcagggacaggctctcctcaggtctcattggaagcgtgcttcctacacaccacggtcagagtggatgcgggtcagactgcagctcctgggaagatgccacaatgcctcctatgatctccaggccacgtttccagtcccttggcccctgcctacctctgacttcagctccagtggccaacccctgccccaagaggggctccgtgtccccctacccactgcactgaaggaattttccagcctccattttctttttaattcttgccttctcactgttccctggctaactcctagtattccttctatatttcaccgcagaccctcagggctcttgcaaactctgttccctccctctcctgcatgcccttccccacactccctccccacagccagcacctgccctcctcagtgcatggggtgcccctcaccatcctagcactcttcaagagtttctaagtccacatatttaggtggtgggggctttatgcctgcctcgaccacaatggtcaggacccaattttgctcccactttgacccagggcctggacatgggcttttggtaaacagatatgaacagaatggtgaacagacaaataatgaacagtaaggctccatttctggcttatcaatgtggccagacattttttttcagccgcactcagtgctgccaacagtgggaggggaggggaacgagtttgccggcttcccggcggcagcatgtggtgaattcaagaagtgaccaaccccaagccggcctttgaaggatgggttgaaacttgcttggtgaagttttggtactgaagcatcccgattttatagttactcaatggaaaaactgggttgctccgtggaaatccactttagggtcgactctgaaacatcaatggccagcacccgctcccgggtcctcccaccttccttcttttttcttttttgaaaaaagaaaaaagactcaggctggagtgccgtggcacaatcttggctcactgcaacctcctcccctcaggttcaagtgattctcctgcctcagcctcctgagtagctgggattacaggtgcatgccaccatgcctggctaattctttgtatttttagtagagctggggtttcaccacgttggccaggctggtctctaactcctgacctcaggtgatccactcgcctcggcctcccaaaatgctgggagtaaaggcatcagctacctcgcctggccctttcacatcccttctatggtcacacctattgtagagagatttagaccaaagcacagagaggctgagaagcttgctcacagtcacacagccagcgagtggcaggaccagaattcacaatctggctccagacccgtgctttaactgatgccatctttctcggaaactgtgtctccaagaaatgacagaatttttttttttttttttttgagacggagtcttgctctgtcaccaggctggagtgcagtggcgtgctctcgggtttaagcggttctcttgcctcagcctcccgagtagctgggattacaggcatatgccaccacgcccagctaatttttgtatttttagtagagacagcgtttcaccatgttggccaggatggtctcaatctcttgaccttgtgatccgcccgccttggcctccgaaagtgctgggattacaggcgtgagccactgcacccggcctttttttttttaaatatatatatatatattttttaatttacttttcccacactacactgatttacaatttttctttcctaagtatgaaccacttaattttcctatataactataggttgatcctgaacatttcttcaactttctacaaggtttgctaaacattgattatttaaaaacagctgttggctgggcgcggtggttcacgcccgtaaccccagcattttgggaggccgaggcaggcggatcacgtgaggccaggagttcaagaccagcttgggcaacttggtgaaaccatgtctctattaaaaagcaaaaattagctgggcatggtggcgcacgtgtcccagctacttaggtggctgaagcatgagagttacttgaactgaggaggcagaggctgcagtgagccgagattttgccactgcactccagcctgagtgacagaccctgtctcaaaaaaataaaaacaacaataaactgcacatgtttaaagtacaatttgatgtatttcaacatatgtatatacctaggaaaccatcactacaatcaaaataatgaagattcatcatccaaaagtttcctcaggtccctgtgatccttccctcctgcccctgtctgccccacctcctacaggcaaccagtgatctgctttttgtcactatagattagtttgcattttctaaaattttatataaatgactgactggcatctttctcagcataattatttttcaaaaagaacatttaaacaaaatagaccatattctgggccattaaacaaggcccaataaatttaaaaggatttaaatcatgcaaagtatgttctctgaccacaatggaattaaatattagaaatcaataatagcatggtggctcactcctgtaatcccaggattttgcgacaccgaggcaggcacatcacttgaggccaggagtttgagaccagcctggtgaacatggtgaaagcccatctctactaaaaatacaaaaaagtcagccaggtgtggtgacgcatgcatgtaatcccagctacttgggagacagaggcatgagaattgcttgaacccaggaggcggaggttgcagtgagccaagagcacgcgacactgcactccagcctgggcgacagagcgggactgtctcaaaaaaaaaaaaatcagtaacaaaaaaaatctgaaaaacctccaactatttgaaaagtaaaacatgtaaaaataacccatgagtcaagaaataaaaggaaattttaaaaatattttgagctgaatgaaaatgagaaaatgtatcaaaatgaatgagccaagggcagttgtggtggctcacacctgtaatcccagcactttgggaggccacagtgggaggactccttaagtccaggagttcaagaccagcctgggtaatatggcaagacctcatctctacaaaaaaaataaaatttagctgggtgtggtggcacatgcctgtggtcccagctcctcaggaggctgaggcagaaggatcacttgcgcccaggaggctgatggtgtagtgaaccatgtttgtgccactgtgctccagcctgggcaagagagtgagactgtctctttttttgtttgtttgtttttttgagacagtctcactctgttgcccaggttggagtgcagtggtgcaatctcggctcactgcagcctctgcctcctgagttcaagcaattgtcctgcctcagcctcccgagtagctgggactacaggtgtgtgctgccacacccagctaaatttttttgtattttttgtagagatggggtttcaccatgttgtccaggctggtcacaaacttctgacctcaattgattggtctgcctcagcctcccaaagtgctgggattacaggtgtgagccattgcacccagctgagactgtttatcaggataaaacaaaaatcatgagccagacctgggtgtaactgccctggaggcccttgctctgggtgaccctgagtaaaggacttacctctcctaagcctcagtgttctcaactgtacagtgggaccaaagacacctacttcagagtcgagaggactaagaaactgcatgcaaagtagctagcctgctgcctggcaagcaagtgagggggcataaattgctatggggtaggctatcacctgagccatctccaaaaccagaagtggctcatttaagcttcataaccactctatgaagaagacatgttcatgtctatgctacagatactgaactggatgcatagaaagggtaagtgacttgccctgggtcacacaggcagtggctgagctaagatctgaatccaggccacctggatccagaatccatgctccagctttactgagggacactgaaagctttcaaatagaggaggaaaatggtcagattgccctaacagcaacatcactgtgggacgaggtcaacaaatatttaggatgctaaatctgcaaggcttggtgatctattagaaatacgttgttgaggccaggcactgtggctcacgcctctaatcccagcactttgggaggccaaggcgggcggatcacaaggtcaagagatcaagaccatcctggctaacacggtgaaaccccctctctacttaaagaatacaaaaaattagccaggtgtggtggcgggcgcctgtagtcccagctactagggaggctgaagtaggagaatggcgtgaacccgggaggcggagcttgtaacaagccaagatcgcaccactgcactccagcctgggcgacagagcaagactcgtctcaaaaaaaaaaaaagaaatatgttgttgaggaaggaagaggaggaggctggacagaaaaggctgtgaagcaggagtggaagaacttggggttggagggctagaggaagcagaggagcacatgtggtctgtactctgaaggagagggcaccacattctgagaacctctccatgacaggacacctggcctggtgggaggcaggtggggttcctaagaaaatgtgtgagcagaagatccattaaaaattaattagagaagaacagagggaatggtgttccaggcagagggaacagcatttgcacagcctcgtgggggcgagtcatggggagtgcgccagacacagaaataggagcacagtgggaactggcgctgtatggggaggcagcagcgacctgcagggcctcacaggcctaaagagctctgtcttcctcctagaaggatgggaagtcagctagaatttgcagagggtggggaggagggaatagatagggccaggtctgtgttctcaaagctcaccctggctacagtttggagacagaccagaccatatgcagggagcagttaggtggttatggaggccttccaggtgagctgacggttgtgtggaagcgggggatgaaggtggagggaagtggctgggttcaagaggtacttaggaggcagaagtggcaggactcagtgccagatccgttgtggggatgcttggggttctttaaggtgggatagtcagtgacctggctaacgagccctcaaagagggctggagacaggggggaagctcatgaggctcagcatccaggtctggagctgagtcctggccgggctcttccgtgagtcatctgcacacaagttctattagtgagagtgctggacaagatttcctgggggcaaagacccacctccaagagctccgtgatgtgccagggagaggggcatgagtctgagaagagagaaggaacagccaggggctggcgtgttgatggtagaaaccattacagagttcgcacctggtgggtaactgtggaatgtcacctggagacaggacaaaaatgtcctgtttattaaccgaggggggagagctggaaagacaagaagttgtggaaggaagaagggacattaaagatggggcctgacgggaaacagtggttcccagtgatgcccagacccagggaggggctttggagcaggttcactggagaaatgggggtaaatgaaggtccccaaaacaaaggacaaagaatgtcagagctggccgggcgccgtggctcacgcctgtaatcccagcactttgggaggccgaggcgggcggatcacctgaggtcacgggttcgagaccagcctggccaacatggtgaaaccccgtctctactaaaaatacaaaaattagccgggcgtagtggtgggtgcctgtaatcccagctactcgggaggctaaggcaggagaatcgcttgaacccaggaggtagaggttgcagtgagcaggttgcagtgagcagagattgtgccattgccctcgagcctgggggaccaagagtgagactttgtctaaaaaaaaaaaaaaaagaaaagaaaaaaaagaacgtcagagttagggccctggatggctcctctatatctcaaaccccctgggcaatggcagaaactgcggtaggaaaagttcctacaagtgaggagagcggggacagtggctggtggtgacaggaaggaaacaggcaaaggcggcagtcgccagggaagaccttgcgccccttcagcgacccgctcaccgctcttcctgcttccggattcctccccgccagtccaggctgcagctgtaggaaagcctgggccgggggcgcgcccccaggctgcgcaacagctaccacaggaccaggcacacacccggtcaccaccgctggggcccgcgccacgtggctgctagtttccttccacttcccccgctttgtaatgccaggcaagacgctttatgttgatttcacacgctcttaagggggtcccaggccgcagtctgaaaacccctgctcctgagcaagttgcgtttccctaaagaccaggaagcggaggtagttccatcgtttctttacacggcaaggagctttcagattattccgagggcctggctatgagtctaggcaggaggcggcccaatcatgggaggcgccagagacaaagaggaagaggacatggactaggcagggaagccaggtcgaaggaaccccaatgcctccaaggttcccacagctggccttggccaaaatatccgaaaattcccatgtagaaactggcttttccagcctgggcaacatggtgaaaccccgactctacaaataaatacaaaaactagacaggtgtggtgtccgcgcctgtggtcctctgcccacgctcgtcccagctactgggaaagctgaggcgggaggatcacctgagcccgggagggtcgaggctgcagtgagccgagattccgccgcggcaccccagcctgggcgacaaagcgagagcctgtccaaaaaaaaaaaaaaaaagaaaaaaaaaaaaaaaaaccttttagggcaagttaatcaccaaagtgttagatacttaatttggagaccgcaaatcggtcggcaaaacgatgggcttttcaaaatcatgccgggtgtagctgggtaagcatgaatttgttcaccaagtccccgattcccaagctaagggacccttaagtatgaagcacatggctttcggggaacccaaaagtagggagcgctcccgagccagcggtgggtctggagaatccccgagcgcgcaggccgcgggacagcctccccagtgcgcagcagcctgaggctaacagcccccagagggcagagccccgcgatcccggcgccgcttgcggctggattctttggcagcgggcgcggcgccagtcaggacgacggctccggaagtctcccgggcgcgtgagacccgggccgctctccgtccacgcacgaccctccctccaggcgcgcctcccaccccggccccgcgttccgctcagcccgggtgaccaactacacctcacttcaaaggcccccacgcccgggcgtgccctccgcccgcccgcggcaggtgggggtgcagggcggagggcgcgggcggccccagaaggcgcccggaccttcccgagaattccgggccgcgcaggcgcattgaggccggcgcgggggcgtgcgagaggcgcgcggcggcgattgagggaaggttgcccgggccgggccacgagcagggcctgcgcgcgcccgcaggaaggcgcgggggcggggtgccgcggcaacggcgcatgcgtaggcgcgcggccgcggcggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaaggtgacgggtggttgtgggggcctgtggaggtggactggggaccgggactgggggcggctggcgcggggcggaggctgtgggggccggaccagatccctgaagcagccagggccgcgctcccgggcggccgcgctttctattccggaggcctcgggaccgctgcggtttccgcaccccgcttcaggaatgggccgggcggccgcgggctccccgaggctctgcagcagcgccagagctggcgccgcacgcgaacagagcggccccgccgcgggggtcccccgcccggccccgctgggggcgcaggcggaggaggccgccgtggcggagccgcagcccgcgcgggagggcacccggggtgttcgttggggaccgcggcgggggactgggcccgggcctgcggcggcctcccggaagcgcgcacacgctcgtggtagttgccgcgctccgaaatgaggtcatcctttgtcagccgcccttctattttcggtttacttaaacttcgcaaatctccaattcggctttaaaaatatttggagaacgcgatggaatttcgtgttgcctctgtagacgtcctgcaaggttttaaaccggcgcggtgtcgttccagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgtaagtcacttattaacccagaatcggattttggtttcagtgtgaacttcttgggggtgctgtatgcttaaattaatattttttgttaacaggcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtaggcacctgaacattcactggttaagtgagcggtggaagggtggggtgctgcaacccttggacccctggggatgcggtgaagcttacagaatttgtgtttgcccaacgatcaggaacaagctagagcacttaattagtgtaatggcatgacttggtgggcggttcttttgggcgaggcaccttgcccaaaaggttctgctgtggtggcctttgcatctgtagtaacggcaaaccttgctttatagacacgttataagggtgttaggcatggcgttgagcactaaattgaatgtattattaagtcaatttttctttcttctcttgcaggtgaacctatgggtcgtggaacaaaagttatcctacacctgaaagaagaccaaactgagtacttggaggaacgaagaataaaggagattgtgaagaaacattctcagtttattggatatcccattactctttttgtaagtttttatgtaattgcagagtgaatttctgtctgtaggtgattggggtgactgtactacatccttagtccctagatctgttcaactagtctgaagcctggggaacctaagctctactacctaactctgtaaaagttcctcgggctattaagtggatgtatcaaatattgatgaaaagctgggtgcttctcaagttggctaatttagacttgggccttaggttgaaaatagtggtgcagcgctgtcgcttagttctggagtgcagcagtgatgtgatttcgtgttttcttttgaaggtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaaggtgagtgactgatgggtgcttcaagcttgtccttagattatcatctttctccaccaccccaaatatcttctataatgcattgttcattggtacttagtgtatctgttttattacagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgagtaagtatagataggaaaaataatcactgtcactgattaaagaagtactttctgggtgggcatggtggctcacacctataatcctagcactttgggaggccggggtgggcagatcacttgaggtcaggagttcaagaccagcctgggcaacatggtgaaaccccatctctactaaattacaaaaattagccccatgtagtggcaggctgaggcatgaaaacagcttgaacccccccgggaggcagaggttgcagtgagtggagattgcgccactgccctccagcctgggcaacagagtgagactgtctcaaaaatacgtcccatcatcttcaggttatctttgattttgggagtttacatagtaccagttttgtccttggaatgactcagtgcatttggtttatatttttttcagacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaaggttggtgtaaataaccattagttttccaattggcctctttagttttttttttttttttttaattcagaaagtctttgtaaagaacatactttgtttcagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtaagagaacactatgttacagtcatacacgtcgttcttacaaccttgtaggctctgtgggtgtgttttctactcaggtagcactgttacaactggtattgatctaggcaagataattaacatgaactaggtcattttctgtcttaggttctgcctaggtatctggctagcaagaaaagtcagagctagatgaaaccattcttaactgttaaaaggtctaaaagtaactttgtaatacctcaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtatgtgaatacagcatttcctgatcattgatacttctaaggtgctttcaagcttagtcatacatagcccattttcgcatgttttcaacttaaaacagaaaactatgtcgtgtgtggctgggcgcggtggctcacgcctgcaatcccagcactttgggaggctgaggcagcggatcacaaggtcaggagatcgagaccatcctggctaacacggtgaaactcagtctctactaaaaatagaaaaaaataaaccaggcgtggtggcacggcctgtaatcctagccacttgggaggctgaggcaggagaatcgcctgaacccaggaggcggaggttgcagtgagccaagatcgcaccactgcactccagcctgggtgatggagcgagactctatctcaaaaaaaaaattgtgcatgtaaaacatgaaattataacctgtgctctttggatacctaatgcgacatttaagttgtatttgacagtagatagtattttggatctattgaaatttgggttctacagatttcatttcacaatgaaagtttaggaattaatctttctaggttcctagtcatcactttttgattacaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtaagccttatactatgtaatgttaaaaagaaaataaacacacgtgacattgaagaaaatggtaaactttcagttatccaaacttggagcaccttgtcctgcttgctgcttggaggtattaaagtatgttttttttagggataagtaaggtcttacaagagcaaagaaatgaaattgagactcatatgtcctgtaatactgtcttgaaagcagatagaaaccaagagtattaccctaatagctggctttaagaaatctttgtaatatgaggattttattttggaaacaggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggccttacagtgtctcaaagttctttacaaatctacttaaagccatcctggctgaggcaggagaatcgcttgaacctgggaggcggaggttgcggtgggctgggattgcaccattgcactgcagcctgagcagcaagagcgaaactccatctcaaaaaaaagatgaaaaaatcagcccaataggtaagagtccctctggggactgggggtggtaatggctaaataaaagtcttcacttctgaaatttggtggttctagagacaaaacttggttagatagcatataggatttgcattctgagcctaacgccatatataaaaatgataggaaatgcctgggacttggatatgtgacagtgtctaagggggcagtgcacaggcagggagagaccttgtctcagtctcgtgctaagcaggtattgaatgcttggtaaatggcaatcacgtttagtcctttaaattctctgaaaagttcttaatccccttcgataatatacaggaggaattacgtaaattgaggtcttagtagtggctgaatttaaatttaactccaaagccccattttattctgctaagttttgttgcgtactgaaaggtgttagaagaaaggtttacggtgttaaactaggaagtgaatggcaaaaagggtaaaaagtcaattttgttttttcccaggtctagcaagagaatattaaatcttaagatttctttcaattaaaaacataaggcacttgagggaatcaagtcaatatagaacctctataaatgatctcccaaatgaactcatcctcctggagttactgggaaagcatttatggcaaataggtccagatgcacaggtaagtacccatctcccagcaacccccatgctggagactgtaccaccaagaagatggatccccagcccagtgagtgagaagatgagctagatgacacatgaatgtcatgctgaaaatgcccttgcactgctccaggaccacaattcttaccctattgcttcaaaattcactgttgtttcaaaccttccataatcaagttccatcctgccagggagggtggtgagtgctgaaaagacatgcaaactggacaagagaattatagatgacatggtcgtctaggtaggaaactcataaggaatctaccaaaattatgctagaaatgattttagcataggatagttgagccaggcatggtgagtcacgcctgtaatcccaacactttgggaggcaaaggtagaattgcttgagcccaggagttcaagactgtctaggcaacaaagtgagaccctgtccctctgaaaaaattaaggccaggtgtggctcatgcttgtaatcccggcactttgggaggccaaggtgggtggatcacctgagggtcaggagttccagaccagcctggccaacatagcaaaaccccatctcaactaaaaatacaaaaattagctgggcgtggcggcagggacctgtaatctctgctattcggaaggttgaggcaggagaatcacttgaacccgggaggcgtaggttgcagtgagctgattgcgccactgcacttcagactgggcaacagaaggatacaccgtcccaaaaaaaaatttaaaatagctgatcatggtggcacatgcctgtagtccagctacttgggaggctgaggtgggaggattgcatgagctcaggtgtttaaggctgcagtgagccatgatcattccactgcaccccaacctgggacacagagcaagaccctgtctctataaagataaaaaaatgaaagaaaagcagtagttgcctggggccaggagtcagagcagggagtgactgcagagaggcaagaaggaacttttgagggcaatggaagtgctggaaaatgatcaggtggtgccagctgtgtgtgtgtgtatatatatgttttttcttttttttttttgagacgaagtctcactttattgcccaggctggagtgcaatggcgtgatctaggctcactgcaaactccacctcccgggttcaagcgattctcctgcttcagcctcccgagtagctgagattacaggcacccgccaccatgcccggccaattttgtatttttagtagacagggtttcaccatgttggccagcctggtctcgaactcctgacctcaggtgatctgcccgccttggccagctttaagtgctggaattacaggcatgagccacgcacctggccaggactctttcatctgcttaaggctaaccctctcctcctgtcctgagagctcactttacccaggccacttccaccacatgcatggctcttctggagcagaatccctgcctgcctcgtcgcctcaggaagtggcctacaccacccctgtcctcaccatctctcagtcctctcaacttttagtgattcctaccaggcatagattcatcaagatcaatatttgcttttttttttttcctttcttttgagacagagtcttgctctgtcgccaggctggagtgcagtggcgcgatcttggctcactgcaacctccacctcctgggttcaagcaattctcctgcctcagcctccccagtagctgggattacaggcacacgccaccacgcccggctaattttgtatttttagtagaaacagagtttcaccatgttggccaggatggtctagatctcttgacttcatgatatgcctgcctcggcctcccaaagcactgggattacaggtgtgagccactgcgtcctgctgattcaagtttttattgaatacctactaaaggccggtggctcatgcctgtaatctcagcactttgggaggccgaggggggtggggtggggcggatcacaaggtcaggagatcgagaccatcctggctaacactgaaaccccatctctactaaaaaaaaatacacaaaaaattagccaggcgtggtggtgggcgcctgtagtcccagctacttgggaggctgaagcaggagaatggcgcgaacccaggaggcagagcttgcagtgtgctgagatagcaccactgcactccagcctgagcgacagaacgagactccaactcaaaaaaaaaaaaaaagaatacctactaaaagccagcccaatacagtgcagtgggccacacgagtgatgatggcaccacttggggaggccagcagggcagaactaagctacagcagctaccaggaataccccaaccaagggctaggcacggagcagggtggggtttgctctgctggtggggcagagttcggagaagctctgggaaggagatatccagactgatagaaaggggactgcagtggagcacgcctgtagttccagccacttgggaggctgagtaggaggatctcttgagccccggagttctgggctgtagtgttgtactgcagtcgagagtccatgttaagttcagcatcaatatagtgacctactgggagtgggggaccaccaggttgcctaagaggggtgaacagacccaggtcagaaatggaacagctcaaaactccaaggttgatcagaagtgggatcatgcctgtgactagccactgcactccagcctgggcaacatagtgagaccctgtttctattttttattaaataaaataataatattaaataaatacgcctgctcagatggtctaaagaaagaaatatataaataaataaagctgacctcattcaaaaagagggaagtggaggtggatttcctggctgaaggaagggcacactcccaggcttgagaagtgggcatgcttgctcttgggaagggacatgtgagccgtctgaggggggatacaaattattgtgtgttcctggaacattagccatgggcctggtagcctgtggtttgccatgagaagcctcttcaaaacggtggggcctgtacccaccccttgaaaaatgtccttaataccggtaatactgaggcagctggctaagtccgcttttccttctcctttcacgaaattgtctcatctttttttttttttttttttttttttttgagacggagtctcgctctgtcgcccaggctggagtgcagtggcgcaatctcagctcactgcaagctccacctcctgggttcacaccattctcctgcctcagcctcctgagtagctgggactacgggttcccgccaccacacccggctaattttttgtatttttagtagagacagggtttcaccgtgttagccaggatggtcttgatctcctgacctcatgatctgcctgcctcggcctcccaaagtgctgggattacaggtgtaagccatcatgcctggccgaaattgtctcatcttcataccaggtgggcccatattccagctttcattttatttattatattttatttatttatttatttatttatttatttatttatttatttgagacagagtctcactctgtcgcccaggctggagtgcagtggtgcgatctcggctcactgcaagttccgtctcctgggttcatgccattctcctgcctcaacctcctgagtagctgggactacaagcgcccaccaccacacccggctaattttttgtatttttagtagagacggggtttcaccgtgttagccaggatggtctcgatctcctgaccttgtgatccacccgccttggcttcccaaagtgctgggattacaggcatgagccaccgcgcccggctttgttttgtttttgagacagagtctcgttctgttgcctaggctggagtgcagtggcacaatcttggctcactgcaacctctgactctcagatgcaagcagtcgtcgcgcctcagcctcccaagaagctgggattacaagcatgtgccaccacacccagctaatttttgtatttttagtagagacagggtttcaccatattggccaggctggtcttgaactcttgacttcaagggatctgcctacctccacctcccaaagtgctgggattacaggtgtgagccaccatacctgccttattttattttatattttattatttgagacagggtctggctctgttgcctgggctggagtgcagtggtacaagctcagctcaccgcagccttgaccttccaggctcaagcgatcctcccaaatcagcctcccaagcagctgagactacaggcacgtgccaccatgcccggctaattactaatttttgtattttttgtagagatggggtggggggtgggggtggggtctcatcgtattacccaggctggtcttgaacacctggactcaagcaatcctcctgcctcagcctcccaaagttctgggattacaggtatgaggcattgcacccggccccactttattttatagataagaaaaacaagctctggaagtggagaacacgcagggctctctgggctaagggaggccagggctgcggtgcaggcatcagacttctactcctgcaccccgacacctcccaaatgcccaagagctgggcagggcctggggagtgggatggatgtcctaggctcagctctgcttccagggaaggggttctggaggagcagataggcccagtcttgagtttaagactacagatgtgtgtgtgttttgcttatgtttgtatcccaaatactcataacagtgtctggcacatgacaggcacacaaatctatgctaacaaataacaaattaacctaagcacttcatagtttacactttcacttacagtttctaatttttttttttttttttttttttttttttttttgagactgagtctcgttctgtcacccaggctggagtgcagtggcaccatcttggctcaccacaacctccaccttccaggttcaagcaactcttgtgcctcagcctcctgagtagctaggaccacaggcgtacttcaccacgcctggctaattttctcttttttataaactatttatttgggagatttccaaaacatacaaaatagaagcagatagataataacaaatgttggcaaggatgtggaaaattggaaccctcataggtacactgctggtaggaatgtaaaatgatactgttttggaaaacagtctggctgttcctcaaaatgttaaacatagcattgccacatgatccagggattccactccttgggatttactcaagatgaacggataaacaaaatgtggtctatgcatacaatggaatattattcaggcttaaaaaggaagaaaattctgacacatgctacgacatggatgaaccttaaagacattgtactaagtgaaataagccagtcacagaaggacacacactgtatgattccacttacctcaggtacctagagtaggcaaattcagagagacaggaagtagaatgctggttgcccaagcttggggaggagggaagggagagttagcatttaatgggaacagttttcatttgggaagatgaaaaagttctgaagatggatggtgatgatgtttgtacaataatgtggatatctccaccactgaactgcagacttaaaaatggttaaaatgggcagggtgcggtggctcacacctgtaatcccagcactttgggaggccgaggcgggcggatcacgaggtcaggagatcgagaccatcctggctaacaaggtgaaaccccgtctctactaaaagtacaaaaaaattagctgagtgtggtggcaggcgcctgtagtcccagctacgcaggaggctgaggcaggagagtggtgtgaacctgggaggcggagcttgcaatgagctgagatcacgccactgcactccagcctgggcaacagagccagacactgtctcaaaaaaaaaaaaaggttaaaatggtaaacttcatgttatgtatattttgttttgtttatttatttatttatttatttttggagacagagtctcactctgtcgccctggctagagtgcagtggcgtgaccttggctcactacaacctctgcctctgggattcaagttattctcctgcctcaaactcccaagtagctgggattacaagcactgccaccacacctggctaattttttgtgtttttagtagagatggggtttttccatgttgcccaggctggtcttgaactcctgaccagcatggcaggtgatccacccacctcggcctcccaaagtgctgggattacaggcatgagccactgcacctggtcaggaattgttttatgaaccgacaggtgcccaccagtcagctgcaacaattacattaatgaggtctcatttgagtctagaatcttacgaagaaggtatcgtttatcaattccttttgatagatgaggaaactgaagatcagagtggtcacacagcaagtaagaggtagacagactatatcttcccctacccgcttccaaaatagattgtccctggaccctggcttttccccacaccagctgccccatttaaacaccccattcaaaatgtgattggctgagcctagcctgtgtcctagctgcaagagaggctgggaaaaccggtgtctggtcttttcatggccttttcctcccatctggcctcgtgaggttggggagtccccagaatgtaggagggggattcagcgctgggcaactcaaaactgacagaccgctgcagtggctcatgcctgtaatcccagcactttgggaggccgaggtgggtggatcacctgaggtcaggagttcaagaccagcctgaccaacatggtgaaaccccatctctactaaaatacaaaagttagctgggcatggtggcaggtgcctgtaatcccagctactcaggaggctgaggcaggagcatcacttgaacctgggaggtggaggttgcagtgagccgagatcacaccactgcactccagcctgggcatagagcaagactttgtcttttaaaaaagaaaaatgaaaaagaaaataaaaactgacgtctctttctaagacctcacacaccagacaacagagctcctctgcctggaaagaaattctctttctcctttttttttttttttttttttttttgagacagagttttgctcttgttgcgtaggctggagtgcaatggcgtgatctcagctcactgcaacctctgcctcccaggttcaagtgattctcctggctcagcctcccaagtagctgggattacaggcgccagccaccctgctcggctaatttttgtatttttagtagacagggtttcaccatgttggccagggtggtctcaaactcctgacctcgtgatccacccacttcagcctcctaaagtgctgggattacaggtgtgagccaccgcgcccagcttttttgtattttttttattgtggtaaaatatatgtaactttttttttttttgatacagagtcttgctttgtcgcccaggctggagtgcagtggtgcgatcctcggctcactgtaacctccgcctcccaggttcaagtgattctccttcttcagcctcccaagtagctgggattatgggcacctgccaccacgcccggctaatttttgtacttttagtggagacagggttttgctatattggccaggctggtctcgaacttctgacctcgtgtcctgcccaccttggcctcccaaagtgctggggttatgggcgtgagccaccacacccggcctgtaacataaaactgaccattgtaaaccatttttaagtgtacagtccagtgcattaactaccttcacaacattatgcaactatcattactatttccaaaactttttcattcccccaacaacaactctgtacccggtaagccaccaattgcctgagatggtctccatgtccccccacaccaggctaaatccttccactcttccactatctggccccaggtaatccttccattatctggtctcagaaaatattttcctgacataacataagccccgcatacactctccttgcgtcttctacctttctttgtagcattatgcaactataaggaaatgaccattcgtttcaggtcagtcttcctgtctctctgctgcctgtcagcccaggagggaaggcgtgagtgttcactgctaaattggtgcatgtggcaaacacctgatacgtatttgtggcctgagtgaagaagtggtatgttcaaatgatgttttcccccttcctgtggggatgacaatttgtttaaataattctgtataatttaggaagcttttgttccctttgctaagccttcaagatctgctcaagactttgaaagtgtgattatagattcttcctccataggagggaatgtcacatcacctccctgagaagaacattccaggaagtggggcttttaatgagtcacggtgtattaatagcaccaccaaaatctgaacaaagatgccattatgttagtgcagagcaagtgagctgaacacgctatctgccaagtgtacgtttttgcttggaacatcaatcatcttcttatgaaagcgttttaggcctcaacacttgatcaatgaaagttccagaactcgaaatgcagtccaaaaagaagcactcttgtttttttaatgccaggttaaaattcaaaaaacaggttgggcgcggtggctcacgcctgtaatcccagcactctgggagaccaaggcgggtggatcacaaggtcaggagatcgagaccatcctggctaacacggtgaaaccccatctctactaaaaatacaaaaaattggccaggcatggtggtgggcgcctgtagttccagctacttgggaggctgaggcaggagaatggtgtgaacccgggaggtggaggttgcagtgatccaagatcgcaccactgcactccagcctgggtgacagagtgagactctatctcaaaaaaaaaaaaaattcaaaaaacaagaaacaggccgcgcgcagtggttcacacctgtaatctcagcattttgggaggctgaggtgggtggatcatttgaggttaggagtttaagaccagccccgagcaatgtggtaaaaccccatctctactaaaaaataaaaataacagaaaacacattagaatgaaaatcaataaaacatttaacatctgaatgcatttgtggtggatatagaaaagtatgctattttgccctccac

SEQ ID NO: 437 - DNA, 3340 bp, Homo sapiens
cggcggctggggagggttcttccggaaggttcgggaggcttctggaaaaagcgccgcgcgctgggcgggcccgtcgctatataaggcaggcgcgggggtggcgcgtcagttgcttcagcgtcccggtgtggctgtgccgttggtcctgtgcggtcacttagccaagatgcctgaggaaacccagacccaagaccaaccgatggaggaggaggaggttgagacgttcgcctttcaggcagaaattgcccagttgatgtcattgatcatcaatactttctactcgaacaaagagatctttctgagagagctcatttcaaattcatcagatgcattggacaaaatccggtatgaaagcttgacagatcccagtaaattagactctgggaaagagctgcatattaaccttataccgaacaaacaagatcgaactctcactattgtggatactggaattggaatgaccaaggctgacttgatcaataaccttggtactatcgccaagtctgggaccaaagcgttcatggaagctttgcaggctggtgcagatatctctatgattggccagttcggtgttggtttttattctgcttatttggttgctgagaaagtaactgtgatcaccaaacataacgatgatgagcagtacgcttgggagtcctcagcagggggatcattcacagtgaggacagacacaggtgaacctatgggtcgtggaacaaaagttatcctacacctgaaagaagaccaaactgagtacttggaggaacgaagaataaaggagattgtgaagaaacattctcagtttattggatatcccattactctttttgtggagaaggaacgtgataaagaagtaagcgatgatgaggctgaagaaaaggaagacaaagaagaagaaaaagaaaaagaagagaaagagtcggaagacaaacctgaaattgaagatgttggttctgatgaggaagaagaaaagaaggatggtgacaagaagaagaagaagaagattaaggaaaagtacatcgatcaagaagagctcaacaaaacaaagcccatctggaccagaaatcccgacgatattactaatgaggagtacggagaattctataagagcttgaccaatgactgggaagatcacttggcagtgaagcatttttcagttgaaggacagttggaattcagagcccttctatttgtcccacgacgtgctccttttgatctgtttgaaaacagaaagaaaaagaacaacatcaaattgtatgtacgcagagttttcatcatggataactgtgaggagctaatccctgaatatctgaacttcattagaggggtggtagactcggaggatctccctctaaacatatcccgtgagatgttgcaacaaagcaaaattttgaaagttatcaggaagaatttggtcaaaaaatgcttagaactctttactgaactggcggaagataaagagaactacaagaaattctatgagcagttctctaaaaacataaagcttggaatacacgaagactctcaaaatcggaagaagctttcagagctgttaaggtactacacatctgcctctggtgatgagatggtttctctcaaggactactgcaccagaatgaaggagaaccagaaacatatctattatatcacaggtgagaccaaggaccaggtagctaactcagcctttgtggaacgtcttcggaaacatggcttagaagtgatctatatgattgagcccattgatgagtactgtgtccaacagctgaaggaatttgaggggaagactttagtgtcagtcaccaaagaaggcctggaacttccagaggatgaagaagagaaaaagaagcaggaagagaaaaaaacaaagtttgagaacctctgcaaaatcatgaaagacatattggagaaaaaagttgaaaaggtggttgtgtcaaaccgattggtgacatctccatgctgtattgtcacaagcacatatggctggacagcaaacatggagagaatcatgaaagctcaagccctaagagacaactcaacaatgggttacatggcagcaaagaaacacctggagataaaccctgaccattccattattgagaccttaaggcaaaaggcagaggctgataagaacgacaagtctgtgaaggatctggtcatcttgctttatgaaactgcgctcctgtcttctggcttcagtctggaagatccccagacacatgctaacaggatctacaggatgatcaaacttggtctgggtattgatgaagatgaccctactgctgatgataccagtgctgctgtaactgaagaaatgccaccccttgaaggagatgacgacacatcacgcatggaagaagtagactaatctctggctgagggatgacttacctgttcagtactctacaattcctctgataatatattttcaaggatgtttttctttatttttgttaatattaaaaagtctgtatggcatgacaactactttaaggggaagataagatttctgtctactaagtgatgctgtgataccttaggcactaaagcagagctagtaatgctttttgagtttcatgttggtttattttcacagattggggtaacgtgcactgtaagacgtatgtaacatgatgttaactttgtgtggtctaaagtgtttagctgtcaagccggatgcctaagtagaccaaatcttgttattgaagtgttctgagctgtatcttgatgtttagaaaagtattcgttacatcttgtaggatctactttttgaacttttcattccctgtagttgacaattctgcatgtactagtcctctagaaataggttaaactgaagcaacttgatggaaggatctctccacagggcttgttttccaaagaaaagtattgtttggaggagcaaagttaaaagcctacctaagcatatcgtaaagctgttcaaaaataactcagacccagtcttgtggatggaaatgtagtgctcgagtcacattctgcttaaagttgtaacaaatacagatgagttaaaagatattgtgtgacagtgtcttatttagggggaaaggggagtatctggatgacagttagtgccaaaatgtaaaacatgaggcgctagcaggagatggttaaacactagctgctccaagggttgacatggtcttcccagcatgtactcagcaggtgtggggtggagcacatgtaggcacagaaaacaggaatgcagacaacatgcatcccctgcgtccatgagttacatgtgttctcttagtgtccacgttgttttgatgttattcatggaataccttctgtgctaaatacagtcacttaattccttggcctt

SEQ ID NO: 438 - protein, 732 aa, Homo sapiens
MPEETQTQDQPMEEEEVETFAFQAEIAQLMSLIINTFYSNKEIFLRELISNSSDALDKIRYESLTDPSKLDSGKELHINLIPNKQDRTLTIVDTGIGMTKADLINNLGTIAKSGTKAFMEALQAGADISMIGQFGVGFYSAYLVAEKVTVITKHNDDEQYAWESSAGGSFTVRTDTGEPMGRGTKVILHLKEDQTEYLEERRIKEIVKKHSQFIGYPITLFVEKERDKEVSDDEAEEKEDKEEEKEKEEKESEDKPEIEDVGSDEEEEKKDGDKKKKKKIKEKYIDQEELNKTKPIWTRNPDDITNEEYGEFYKSLTNDWEDHLAVKHFSVEGQLEFRALLFVPRRAPFDLFENRKKKNNIKLYVRRVFIMDNCEELIPEYLNFIRGVVDSEDLPLNISREMLQQSKILKVIRKNLVKKCLELFTELAEDKENYKKFYEQFSKNIKLGIHEDSQNRKKLSELLRYYTSASGDEMVSLKDYCTRMKENQKHIYYITGETKDQVANSAFVERLRKHGLEVIYMIEPIDEYCVQQLKEFEGKTLVSVTKEGLELPEDEEEKKKQEEKKTKFENLCKIMKDILEKKVEKVVVSNRLVTSPCCIVTSTYGWTANMERIMKAQALRDNSTMGYMAAKKHLEINPDHSIIETLRQKAEADKNDKSVKDLVILLYETALLSSGFSLEDPQTHANRIYRMIKLGLGIDEDDPTADDTSAAVTEEMPPLEGDDDTSRMEEVD

SEQ ID NO: 439 - DNA, 26307 bp, Mus musculus
  misc_feature (1)...(26307): n = A,T,C or G
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncccagcacttgggaggcagaggcaggcggatttctgagttcgagtccagcctggtctacaaagtgagttccaggacagccagggctacacagagaaaccctgtcttgaaaacccgaaagaaagaaagaaagaaagaaagaaagaaagaaagaaagaaagaaagaaagagagaaagagagaaagagagaaagagagagggagggagggaggaaggaaggaaggaaggaaggaaggaaggaaggaaggaaggaaggaaagggagattgttgaatacttacggggaaagttgaggggttaagggggcagggctccaggaggggcttgatgagaagaagcctcctgaatgccagctgtcacctttttccagtctctgctgtcacagttactagttattgtggtctctgaagaaagactgcacagcagggctggtgaattttagctatgtttgtcccttaaagaaatacttaacagagaggatgggggacaccagggaaacaaggccctctaaatccacaggagcaaagctcacgtgaactcacagagactgaggcagcacgcacggagcacacacagggcttgcacaggtctgcaccaggccatctgggcatgcagcgtggcttccagtctggtgtttttacaggattcctgagtgtgtggacaagcaggtctctggttcttgtgtcttctcttgggctctttctctcatgtcttgtcaagctccgatgtgttagctttgttttatctcgatatattttatcactcctcagaagcgtgtttgttttctaatgagagacagaaggggagtggatccagggaggcaggaaggacctgggaggagcggaggggaagggatcagtgtaatccggatacattacgtgagaaaacaaatggtcgttcaataaaaggaaaaaaacttctcagaggatatgaaaggaacacacagttcttgtgaaggactggaaaatatggtaaattataataaaaaaagagagtaaaatctagccttgtaatggaaagaaccacagtatttctttttttttctttttaaaaattattatatatatatatatatatatatatgagtacattgtagctgtcttcagacacaccagaagagggcatcagattgtattacagatggttctgagataccatgtggttgctaggatttgaactcaggacctctaaaagagcagtcagtgctcttacccgctgagccatctctccagcccatagtgtttctttccagcatttaaacatgtatatttaattgtataaatgatataaaactaaaccattgtacccttgccccacggtcaatactggcatccctcctgaaggtcaggattatcaagtgcctgtgtgctgttcccctgtctagacactgtcttagatgtagttaaacagtgacttttttttttccttcctctgggttatgaacacaagcatcattgtggctttctaatttctcgttcgtgatgtttcctagagacaatacaatgccccgacctagtaagagagcaatctgtctctcacttcccagttcatagggttctacagttcagaaaggtctttgtttaataattgtcaggtgaataagtttgcattgctttgacaacctgcccctcctttgttgttattataagcttcagggtgctaatcatcttcccacatgtccctgtgcacttgtgggaaaagttgtcaaggtgtagctagcgaggtgagctgttgggtctgaccgtgtttgttctgggatgtaggatattgacaccaaggctttgtctccgccgggcaagttggctacatgcagcacactgtactggtagccccgttttaaccaaaatacattcttccatcccatgaacacttgaagatgttaatacttttggtactgatcttcatcagatcaggacctactaagacaaagttctatttctgaactatctcacattactattatattcagggggcacatcacattttttttttagaaggaggaaaaaaacccaaagtaattatagcacttgctaaatgtcatgtgctttgtgactgaaagaaatcctagccactggggaccttctttttctaatgcaatttttattcagttggtggtcctgtacactaaggttgaaacctgtcctgagggcactctgtccctcgaggccttgtgatggaagtgcagctgtgatggtgaggatcagtgggacccttctgaatccctgaggaagttggcagggtgtgatcctgccctaagagctccccttcagcctctcctgctctctcttcctggagtgcttagccagcttgactgtgttgtgactgccaacaatagctgtcactgagtgtcccagagctttgtttggcatcttgtggactgccacacacaggtcatggcaatgcttgttgtccagttctgggttgtgtgatgactttcggggggtcatgattataccaagcaagagtggttggtggtagtccagtcatctctggctgtcattagtggttttactgaggagtcctctgaggcccaggggatattccatgaaattctcctctctgtgacctctctcacattccttaaaaaaaaaaaaaaagagtggtttttcatgtacatcttttgtaaagagcatagggcatggggaattcacagagctgggtatagctctatgtctattttagttgttcttactgatattgcaaaatgctggacaaaggcaactgagaaagttactggtacccacatggcagctctcaactatctacaactccagctgtagggaatccaatagcctctctggccttttcaggagtcaggcatacacaggcttccatgctggccaaacatacacatataaaaacaaacaaacaaacgaacaaaaacaaaagggaagctgggatgagttgcccaggccaggccggccttcctgcaaatgtctgccatcctgtttctccccttgcgaatttacatcccttttgtgacctgagaaagatttagatattgagaaaaatggcaaaatgaatcagtaggaaggaggggcccttttacagttaagtcatgtgatctcttagaggagaaacagagcagcccatcagcaccggatttggaagaacagtgagacttgctctgcagccattagcaagaaccttctaaacgaccccgttctgactctttttgttctgggcaggatttgcttcagacagcatttgagttaagtaggaggaaacttaaagatattattttaatgtgtgtgtgtgtgtgtgtgctcatgtgtgtgttcactgatggggagtgcccctgtgcacatgccatggttctcttccaaaggtcaaaggtcaacctgggatgcccgtcctcaccttccaccttgtgtgagacaggatctctttgttgtccattgctggcctgtaagcttctgggacttctgtctctgctcgtattcactgtatgactgctgggacagacagatttctgagttttatatgagtcccaaggaactcaagtcctcacaattgcacggcaagtgctttgtccacagagccatcttcccagcttggcaaaacctctaagctagcaaaactcaattgctagctcgctcgcttgcttgctcctttttctcttggttgttttgttttgtgccttttgagatagggtcttatgtagcccaggctggccatgaaattgctaggtggtccatgttgatcttgaactcctgatccttttgtttccaactcccaagtgctactgggcctggctatctactttcctcccttttcttttgctctttccttccttccttccttccttccttccttccttccttccttccttccttccttccttcctccatccctccctccctccctccctcccttccttccttcttccttcctttactttcttctatgggaggtctaacccagggtattactcatgtgcttttactactgagcctaggtaagccatcttatttttttcatataatattatgtgtaagtgtatgtgtatgagtgtatatgagtgtgtgagtgtatgtgtgtgtaagtgtgtgtgcatgtgtatgtgtgtgtgtatatatatgcgtgtatgagtatgtgtgagtatgtgagtgtgcannnnnnnnnnnnnnnnnnnnaactctatcagggaactgccagtcatcgcccagaagtccctgatacctgggaacagctgaaccactaccggaatgtgactgaaaatgttcaaagtgagcttgcagcaatgctggtcaaatttgaatgtgctcagtccgaggtgagacgctgttcacagtcaccactcagaagtgcatctctgtagctttttatagagtgaaacaggatgttgaaggttaaaaacaggaaataagaatgggatttcaatccattgacaacgtttatacttactctttgtatgcttagcccctccgactcttagaatctagagaaagtctgtataacccggggagacctgagaactttgtgttaaagtcatacgggccttgggggacgtcttcctttcatgtgcattgcttgtctcccagagctggtaagaaggatttctgaatcctttttgtgtgggagttctgatcaggcaggcgaattccaagctcgagtagtgtggtgtagtttctgagcccctctggattctttctgctctcagggcagaggctgtgaggggtctagcctggtctgcgaggtaactagcagttggcgaactggaaacatgtgcaactctgtgagcatgcacactcccagttccaaagaaccacacatgagcgaagatggtcccacagcggagacccagcattctcgaatgcaaacaccctccagcattttgatgctactgaagccacagaagtccagaccttccgcttgcataatttccctttgccaccatatttcccccaggaatctgaatatcatttttttctttaccaactataattatggtctagaaggccgatgggagagataccatgatatcctgaacatctggatttgctagagaaacagttgtggccatggaatcacaatcactgtggcttggagagtccccaagtcactgtaaatcagtactaaatgcagcaaggctgatagagtaaattggttcccattgtaaaatattttattgctttttgtaatacccaccagaaatgtttcccgagtggcatgaaatcaacttaagatgctgctcatttttattttattttttggtctgtgtactcgacattgaattcaaattctcacacacattatatacaataattactcttttcaatttgataatgcagatccaaatccaagaaagagaaaatgaaattggacgaggtcaggaataaaatggagaaattttaaattacagtattgactcttttgtaggcccttccaacagcatacacattgttaaatccctttgttctcgcccaccccaacctctctgcactttagcttcgagaactccgctccaagatgctttctaaagaagcttgctgtcaggagctgaaggcggaaatggagagctataaagaaagcagtgccagaaagtcatctctcctcacgtctctgaggggcaggatggaggagctccaggaggaatcagcagcggtttcagcttctaaaagcagagcagaggcctctgttcacgccatgatgaaggagaaccaggaactaatgaagaaagttctagaactggatgagaaattacagtaagaaatttggaaacattccccagtttgttagtggctatcctagcttcagagctcagcctacatcttgagtgatctttgaatgttttatatgactttccctttaaactcaagctgaaaaaacaattatagccctcaaatatctttgtagtcttacaaactttgctcaagttcaagtgttattaagtatttcatcaaacacagtgttgtcttttgcaagcgtagaaccttgacggtgggtgatgacacacgcctttaatcccagcacttgggaggcagaggcaggtggatttctgagttcgaggccagcctggtctacagagtgagtttcaggacagccagggctacacagagaaaccctgtctcaaaacaccaaaataaaaccaaccaaccaaccaaacaaacaaaaagaacaacaacaacaacaacaacaaaaaaaaaaaaccaaaagctttttgcaggtttaattgtgaacttttccctaaatagacatttaactctagagcaatagagaagcccacagaaagagtgtatttagaggctagctaaaaaattcaaggaagcaagactactttgaacagtcctccttaggctttcacggcattttctacagagaactcatggagattgttctgcctccacctcttgagtgttagaatgactctcatgctgttccatgaccagttttaaatatcactactagtgaagtagttcatattatttttatttattccatcttaaaagatgaaccaatacccccagctcctgtcctcttccatctatagaaaaactttttgtttgttcgcttgactttaagacaggctgtctgtcttagttagggttttactgctgtgaaaaggccccatgaccaagacgactcttttaaaggatagcatttagttgggtctggcttacaggttcagaggtttagtctgttatcatcaaggtgggagcatggcagtgtccagacagatgtaaggctggaggagctcagagttctacatctttatccaaaggcagacagcgagagagtgacttccaggcagctaggaggagggtctctcaaagcccattcccacagtcacacacttccgccatcaaggacacacctactccaacaaggccacacctcctagtagtgccactccctgggccaagcctattcaaaccaccacactctccctgtgtagccataggctgctcttgagcttttatcctcccttttcttcctgagagtttggattaccagggttcttagatatctttgtgaacctgtccttagttgttctgtaagatcatcagtgatgaagcagggctggtaggtctccatagcatcagctacaaccgatctgggaaccactttcttggcttccagaacattacagactagtttatctcctacttttttctttttgtgttttttcttctcttcttggcttccaagtattgaagtgtcttattcttatttccgtgctatttaatctcctgtcttttaagtaccatctaagtgctggtgatgactccgtatcatcttcacatagaagctcagcagacattttaaatcttatgttcccaccatatctctttgtactcatttgatctggtgataatttcattcttccagatgccaggtgaaatatcttggtatcatccagggttctccttttctttcatattcttctccactagcaaatgtaaccacagctattttcaaatagaactaaatattaaccatttctcatttgttaccccaataacactatcatctttaatctggatttattgtaataagtatgtactacttcaggaccccactcctggtaccagtttattcttcaaggtgctattaaagtataatagatcacctggcttagccaatataaacttattactaatagttctggacgctggggaattcaagattaaggtactactgattcatttcctagtaggatttacttccagttagaagatgaacttcttattgttttctcccatggtagagagagaaagagacagcctctctcttttttcttaatcttcttattcacattcatgacttaataattacctctgggaagcctcaagcacacacattatcttaatggaggctcctgattcaacatatggggacacagaaacacctagctcacaaatgattttctttcttcagtcaatgcacactccagccagagtgaccctgttaatgcacaaactagattgtgtcagtcctcagctctgagtccccagtgatttccttccttccttccttagggtaaagacctagtgtatttacagccgcaaaggcccatactaaccccactggtgttacttttctctccttcattcctgctgttccagttcactggattctttgctgatttttgaactggacagacatgattctacctcagggcctttgcaattgctcatctctttgtcttcaaggctctttcccagatagcatgactatgtcttatctaggcactcactcagaaggatctgcccattgagccctcccatgagtgccatgtctaaaaacttacccccttttctgtttatcattttcctccagtctttacataataatactgtatatcttacttagattaatatttggatcagtttgtctttccaactagaacatatgcttcacagagcaaggatttttctctcttgtttacttctgaggcttttatatccttgataggatccaatgcataattgtgttcattaattgtccactagataaatgcaagatacaaatgtcatacacttattgtaaaaacactttgtaatatagaaaaaattaaaaaatttgaagaaattaaaaattattcaaaaatctttatttatagaaaatcttagtaataagcatttcttgaataggctttcagacagttttgctcaaagagcactatgtaatatgctatgtttactagtacattgttgctgttttaaaagtcattcagtttatcaccttaatggccataggtattctgtttccaaaatagcttcattgggagctggagagatagattaacagttaggagcacttccaaactcttgcaggggagcaggtttggttcccagcacccaaatgcaagctcacaatggtctctttataactccagttccaggcgatctagtaccctctctggcatccatgggcaccaagcacacacatggtacacatacatacatgtaagcaaacactcatgcacataaaatataaataaataaacagataaatcaatcaatcaatcaatctttaggagcttaattatttactcaaaccagttcctggatgtttcctgtaaatacttttagtttcattatcatgtttaccataaagcaatctcaacagtgcatttacagacatttatatttttatagttatgtgattatttccttagggtagattcttgaaactttgttaagtcagttgggaagccagtagctgtgggcatagcttggggacctttgcaattgagctatgatgttgaaatcttgtggctaaagtatgaggccacataggcagatctgtcagagccatggtgtgcattgtgcttcttgtgtatgcagaaactacagatagatcgacactagccatttattaatgcactttcctaaatggaaatatgatacgcttttgagtacatgcaattacatgctttgttaattattaaatagagtcaaaaatttcacagtaaacacttatcatgggaaaaagaaagcaataatcatgattattgtactagaattactgaaaaaacgattccaaattacttagatgttctaacttgtcttaaaagtatgtctgtggtttttttgatgatatctttctaaacattcaaagcattggaaatgcactgtgctatttcaacaaacctattggagaccgcctatctgacagtcccttgacttgcccattttaacacatggctaatatgctaaagagtctctctgtgtggcttctcattgctttttgcttgtgcttgaaagtttttctctccacaatctctccctgatccagacattatgtatgtatgtatgtatgtatgtatgtatgtatgtatgtatgcatgtatgcatgtacgtatgcatgtgcatatgtatatgtgtctgtcacttatactaggccatgaattaggaccttataaatcaccacataatgtctaaaatgaaaatgaaacttggccctctagcatctgtagggtgccattctcctccccttggaggccccagcagaggccttggggcttgtgggttgtgactacaaatggcagaaggtctgtgtgtcaactctgtgcttgccttcatgtctgcagatcagttaaaaacataaggctcctcctcctctcttgttacgaggtccatacaccatgaagacttttatcttctgcagagtgtaggtgccctgaagttgctgacacgcctcatttgctgacaggtctgagcagccaatcatttgcactgggacacgatgatgtattgaaagtgaacattattccccatggagagctttagtcctgacttgttttgatgactgaggtctgctatggtgctaaatcttgatttgtttgttacctggctgatagaaactgttcaaaggaaaatgaggagtctaagaaacaaggctcagagcacctccggaggcacgaggaatttcgggctcagcttcatgattgcttgagtctagacaagaagcatgaagaggcatcggatgaagatttaattttaaaggtatttgcatgcaggttaaaggcactctaaacatggggtcatcctggcatgcgatacgaaaggaagtgctgtggttgggtctacaggtgacaggagtagcctaaaggttgtgtgttacagtttctattgctgcaccatgaccaaaaagcaggctgggggaggaaagggttaattcagtttacacttccagatcacagtccatcattggatgaagtcaggacaggaattcaagcagggctggaacttggaggccgaagctgatgcagaggccgtggagggatgctgcttactggcttgcttcctcatggcttgctcagcttgctttcttatagaatccaggaccaccagcccagggatggtaccacccactactggctgggctgggactgtcccctttgatcataattgagaaaatatcttaagagatctcatggaggcatttcctcagctgagaccccttcctctctgatgactctagcttgtgtcaagttgaaacaaacccagccagttcaggtaacattaattaatggtgtagatcagaataaaccacaacatgtctataagcttcaattctaggatcttttgctagcattatttgagattaattagtgtctaaaagggattatgtgatctaaaatacatttagatattcaaatacaattaattatcacatgatatgtttgtgcatgaatttttttcttttagctaaaaggcacacacaaaatcaggtacataaaacattagtgttttagttttcattaatatttttaaatgaacatgcatagcattagatttaattatgcattttcaaataaaatgatttgttgattatctttccgtccattttcccccatgttcctatcataccttgtgtccttcaaagtcaggatcaggggtagaggacacacctgttgtagaaattttaattcccaatccgtggcattctagctcccctttaaccatttagtgcccagataaaagacacacacaacctttacatttacaataagccttaatcagaaccggagctgggcaggtatctaccctctctgttattagaatctacttttctactgataaccctgaattattacttgctatgttttatctgggctgctctttgttttgtttttgttttttttttttttttttttttttttttttttttttctgtatagccctggctgtcctggaactcagtcttaaatcaggctggcctcaaactcaggattccacttgcctctgcctctcaagagctgggattaaaggcattcatcactgcctggcttctgggctgctcttaactccaactggccagcagccctaagggccatgttttcatgactcacctaacccatggcagcttctccgccattcctttcttctccacctggtctctccttctttctttctcttctccaccccaaccaggtaactcaaagcccacctacctctaatccctctagtaattagctgtaaaaaccttgttggaacaaggtttgtacaacaaaagcccgcaaatgtgaaaattcactcgtaggcctaaaccttcctttccagtacagaatttagcattatgacacaaacctccacacacatgggacgggcagtggaaagacaaaggctatgggctgtactttcgctaatgtccaggctgctgacctcttgtagtatacttagtaagaaactccctgcatccttagtgtgtcaaaaactagacttagttcttaaactacttttaaccttaacattagaactcataagatcttaattcatggctgattactattaagggtggacactgatgattctcaggtgacacttggcttggtaacagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttctctccatccctctcttgattgctaccttgtttttcttaaaggatccaccaatccagaataaatctatggatacatgagtgatcagctgctataactctattaaaatcagtttctttttcattcttactcatccattttcattgttttgctgtctaacaatccatttcttcttggtgctctaaattctttgagctttttgcatctgcagcttctttgagagggcctatgacctccctgctctgcaacactgtaatatttccttgatttcaggacagaggcactattccagactcagttgcagcttttcaggtgtcagttcaaatcactcaattccctagagagtttaggttctacttgtcaaggggtggtgcttagggaccatgctttagcctggagctgtgctcacttcttgtacccttaccattatacctgtgatggtgccaacttctcagtgaggttgtgggattgattctagcccatccagttatcatgttgcaaggccaggacctgaacccacatcaccacatggctgtgcctcttatcaatcctctcctgtgtatgaagctcacagcatcataggacggtgttggcaaggattatttatcagtggaagaacaattataaacagctgtgccatatccttagcgagtattaactttcgaaaagtatctttggacattagtaggatattactgagaaaccatgtcgtaatatgacatgaaacaggaaaaaaaaacaccaaatttcttttcttatgtaagtgtctttgcttgggagtgactctggaaacttatccactttggctccaggttcctgccaacaacaaaaaattgtaaaataaaaatttgggcaataaaagcctgaggtctttacaaaatgctcattcatagaactatttattactctgatgatttactatcaaaaaaatactgtcaagtgttttttctgacatgttgatggcctcagaaagaaccctcagactgcttgccaaagctctacttttgaggtaggaaactttatttttattaaagtccagatgtatgtaagaggcagaagtagtcacacagctgaggtgcctatgtctgcaaaatttggctttattgctttgcttaaatttaagggccaagtcaagaattctatctcagaattcaagaggcagagtcaggaggatctctgaattacagttcggcctggtctacacagtgaaatccagaccagccaggctccactgtaagaccctctctcagagaaaaatccaggtgttttattacatgtggtaaatttatttggaactctttagcagttgttttgcttgggtactgggaactgaagtgaagttcttctcaggggtgctctgggcatggtctggccactcagcccctgtggtactgggcagggtgaagtgaaggtcttaggcctgataagcacatgtacagctagagcacaaatatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntcccctgtactgaggcatataaagtttgtaagaccaaggggcctctcttcccactgatggctgactaggccatcctctgctacatatgcagctagagacacgagctctgggggcactggttagttcatattgttgttccacctatagggtacattctgcttttttaaaattaaattttattagatggtttatctttagggtcattctaaaaatttacaatcagaatagcatttaaagattacatgttgcattttttattgtttattataagtctaatcttagacgtgatagaatccatcacagtctgctgtaaaggtccagtgggaactgtctctggccctccaggcacagaacaaccagctcagggcagtgtttacagctccatagtgcagcccaggaacacagtggcttctggggcagaggaagccacggtcatccagtactgagtttgctaataatgcgactctttcaaacgccagctacatctgtcctttttaacatacacaatggcactgggacagctctgttgggggaaaggtcagctcttctgaagcaaaatgtcgccctgcagtttccccatcattgagcatctgttagagtagaacaaagcaactcctcctcgtctacacggcagcccttggagcaggaggctcttgcagggtgaaggctccagttaaagaaaatccccctaaaacacaaccccaaaacgtctaccattctttctatgcatgcaccctaggatgctatctaccgggctgtgggtgtagggtcatgactttttattgactttgagctaactcctgacctctataaatagaaaatgcctctataaatagaaaaaatataaattagtagaaaaattagctagcagtgcggaaagcacaaacccaaatttcaagtgttgaaaaccacagccatgaaatgaaaacttcctgtaaagagaacaggtgtgggaaaaagaattctccaagctgtatccatcctactttgaaagtttgtgcaaggagattaataaagaagatattgactatagccacaggctggttttacaatgccatctaaacaaaagttaaaattatacaccttgatattaaaaaataaaacaataaaaaaaaaccaacgtagctacaagaaccttgacaaggggcagtgcgtgtgtccacattgaagtttgattgtgatcacacactaacttcatgtttgcttgctgaggttgccttggctgtactgacgatgcttacaggagacgtgtactcagaccttaagacatttgcagagctgtttgtggtggcctgctcttctgtatctaatatcttctattatcctattgataaccctgagttatcacttactacgtttcatctgggctgctcttagctccattgaccagctctcaggggccacattttttttttttttttttcgagacaaggtttccctgtgtagtcctggctgtcctggaactcactttgtagaccaggctggccttgaactcagaaatctgcctacctctgcctccgaagtgctgggattaaaggtgtgcgccaccacggcctggcccagggccacatttttattgctcacctaacccatggcagcagcttcttctcctcctgccttcttcttccttgtggtccttctccaacctcaagcccacaaaacctaaaccccacctatgttttttctgcccagctattggctgttggcatttttatttaccaatcagaaattacttggggccaaggtggacatgtggactctctcatctctgggtcaaccatgtcttgagagcatctctactttataatttagcttatagttgtatttttttctttgtgattttcttttttgggggactagaattgtggttttaaaagatatttgcatgttacattttattaggtattatatcaaaaacgtatactcaaattgtccttatttgcctgagtgtgcccgcctggtgcagggaattgcagggtttatttattaatcttaactgcagtaggtggaattaaaagctgactttttaaatttataaagtgagtttagaattggaataggcttcagccagaagttttgaccttgacaggaactaactgttgcatttttacgaggtaatttgatcttgggcatatgtgaatccatattgtagttagcaagttcatgataggaattatgattcatgataggaatcaactatttgtgcatgtcatgtgtgactgtatgtgtatgtgtgtatgtgtgtgtgtgtatatgtgtgtgtgtgtgtggggtgtgtgtgtgtgtatgtgtggtgtgtgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 440 - DNA, 531 bp, Mus musculus
ggaactgccagtcatcgcccagaagtccctgatacctgggaacagctgaaccactaccggaatgtgactgaaaatgttcaaagtgagcttgcagcaatgctggtcaaatttgaatgtgctcagtccgagcttcgagaactccgctccaagatgctttctaaagaagcttgctgtcaggagctgaaggcggaaatggagagctataaagaaagcagtgccagaaagtcatctctcctcacgtctctgaggggcaggatggaggagctccaggaggaatcagcagcggtttcagcttctaaaagcagagcagaggcctctgttcacgccatgatgaaggagaaccaggaactaatgaagaaagttctagaactggatgagaaattacaaaactgttcaaaggaaaatgaggagtctaagaaacaaggctcagagcacctccggaggcacgaggaatttcgggctcagcttcatgattgcttgagtctagacaagaagcatgaagaggcatcggatgaagatttaattttaaag

SEQ ID NO: 441 - protein, 177 aa, Mus musculus
GTASHRPEVPDTWEQLNHYRNVTENVQSELAAMLVKFECAQSELRELRSKMLSKEACCQELKAEMESYKESSARKSSLLTSLRGRMEELQEESAAVSASKSRAEASVHAMMKENQELMKKVLELDEKLQNCSKENEESKKQGSEHLRRHEEFRAQLHDCLSLDKKHEEASDEDLILK

SEQ ID NO: 442 - DNA, 143973 bp, Homo sapiens
  misc_feature (1)...(143973): n = A,T,C or G
atacttattttgtactttgtcctaggttctgcagactaagcattttacatacattacataacttaatcttcaaagcaaccacatggattatgcactgctattacttctatgttacagatgagggataggccctaggaggttgagaagcttatccaagatcagggaattcagaaatggcaaagacaggatttgaacccagacacccttactccagggtgtgtctacttaaccactgttagagggccttcaagtccaggggtaaatccaaggactttcagttttttaatttttatttttagagatagtctccgtgtgtcacctaggctggagtgcagtggcacgatcttggctcactgtaacctcgaactactgggctcaagccaccctcccacctgagcctcttaaagcactgagattactggtgtgagcaaccacacctcgccagctttcagtatttttttaaaaggacattgtagttcttgagcaaaaaaaagaaaagagatctctcgtatactttctgtatttttggttttcgttttcatatatatgaaaccagatctcatttataatacattttaaattaagggttaatctactgtttggcaacttggttaaagcagggaaaatgttttacaccacaacaatttcactgggcaatctgttatttccagctaccaaaaaggaaggctagtttttgtgtaggaaaaagctgccaactccatggatcagctctaattgttttttttttttttctgaggcagagtttcagtcttgtcacccaggctggagttcagtggcacaatcttagctcgctgcaacctctgcctcttgggctcaagcaattctcctgcctcagcctcccacgtagctgggaatacaggtgcctgccaccacacctggctaatttttttgtatttttagtagagatggggtttcaccattttggccagactggttttgaactcctgacctcaggtgatctgcccgccttggcctcccaaagtgctgggattacaggcataagccaccgtgcccagcctctaatttttaagtactacatctattgaagacttttgctcttagctgtcttcctctgtcaacatccttggtgacatcagcatccagctatgcgacccatccaaaatcttggccattcagttcgttgatgacatgcctcagaatcaatgatttttttttgcaatatttcaactgagccacctattcccatggttacagcctaggccaggaactgcactatctctggttttaagcatcctactctgcccaccaccgactctcctttcaattcccttaactggaatagccccattgcaacaatgctctgacctcatcaggacctctcagtcattgatcctgttctattttttcaaactcctatattcctttattttcttcctctcttcattttcttgactatccagcttaaattctatgatccatcattataatgactcccttgtaaatacaatcaattaccttgttcctctctctatcttactttcctggcataaccctgaccttggctgaaggtaactatgttccattttctcaaacaatggaaacatataggagaaaaatcatacaattgagctgactggtttcattttaaaatcattaccataaacctcaagggctcactcagcactgctgggtaattccattgtttccctgtatggtgttctccaagtgttagtcattcctctatcatctgtatgacttttgctgtatctgaatactacctatgcaatcatttactaaataatttagcttaagttgattccaattgaaaaatgtacccatatcctaaactttgacctagaccaggggttggcaaactatggcccatagttacctgtttttatatggcccataagctaagagtcagttttaaatttttggttggtttttaaaaaaaagaataataatatcttgtgacacatgaagataagtgacataaaattcaaattttggggtctataggtagttttataggaacatagccacatttgtttatgttttgtctctggttactttcacactcaaacagcaggattgaggggctgcaaaagagactacatgtggtgctcttatcattttgccctgctcatccacaaatcacaaataataggggtacagttataactctaccgtgtttggtaaagtaccgtatgtattgtactatggtgacatttactttacttttaaaattaccagagcttactcatcatgttaatacaagaaacgtggattttggatgtcatgcttttaagacagtggatagtagattatatttgtagaattaaatgccaaagcattatgtttactataaacatgacactatagatgtgctaaaagaatacttagacattgacataactagactaagcacttgttataatatccttaactcacagaaaagtaacagttagaaaaattagaaaatttaaaatggaatatctgaccacagcagaactgtctcacaaaaataaaagataaaatgaggccgcaaccaaagtcagtttctgagtggttaatttattagccaggcaaagagagccatttaccaatgttgagttcattaaatcatgtttaattgctgcagccaaagaaacgtgctcttagagaagataaacttgcctttcagtgagactggttgttcagggttgaggatgttgggagcaacatgaacatatttttgccttaaaaacaaggcaaatgattttctttggctcttgacaagttcacaaatgttaacaatactgagcagttgttatttgaaatatcagtgctaagactgaagtaatcaaaaaaagcctgtgtggagagaatacaggtgagaatattttaatagaaacagaaaacacgaactcagtacaatctgaagtagaatctgataagatgtgttaaaactgatgacggtaaaaatatgtgttcaccagaaaagggtttaattgggtacatttacaaagcttttgaaaatgaaaagcctgtggtttttcatgatattattcatcagcaaacacatcacagaaaatatttgtatttatcaggcattattaagtcagtagtgtaaatgttgaacttcatcgctcttgtggacttaaccattgtcacttctacaagtttttgctggaaatagaaaccatatatcctgacttgctctgatgcacagaaatttgatggatcagtggtgacaatgtttcatttcaattttttgaactcagggctgagatggaaagtttttccaaataagaaacacagccttcagtcagtattattgaatactgaatggctttggaaattagcttttgctgtagagttggtaatatttattaatcaactcaaggtataattacaaggtaagacagtactatatgcaataactgctaatgttgttctaagtacaggctgtcaagctgtcctatatcctttctatgctgatgaaatttaaaacaagatgtgaaatcttcattctcacacaaatattcagccctcaatgcacatgcaaaggaaattcccatatttcaaaaatatattaatattcaactgtagttgaggagcttccatctaaccttcaactggaggcttttaatctgcagcgtaatgacatgctaaaagataaatatcaacataaaaatctaaggtaattttatagatgccttctgagtgattaatatgctcaatttaaatcacatgcttatgaaatgaaagcaatagttagcagtacccatctgtgtgaatgacatttttaaagatgaaacatgtaaattttcattccagataagcattaagaagtggaaatttggccaggtgtggtggctcatgcctgtaatcccagcactttgggaggccgaggcaggtggatcacctgaggttggaagttcgagaccagcctgaccaacgtggagaaaccccgtctctactaaaaatacaaaattagccaggcatggtggcgcatgcctgtaatcccagctactcgggaggctgagtcaggagaatcacttgaacccaggaggtggaggttgcggtgagctgagattgtgccactgcactccagcctgggcaacaacaacaacaaaaagtggaaattaggaataaattttgatgataggaaacactaactttgagccttagtgaagaaaaatgttattcatcccccaaactaattatgttcttattagtagtagacttcagctcttctagggaaacccccaaagggaaaaaaactttaggaataattggctgccaggtgattcagaggacagaggattcaaagaaggctcgtggagctcttgcttcaccccagactttccataatcctcccgattggttgacacttttcctataaaaaaaacatgtgatgtggtccttctggcagtcctttgctagaaagtgctttctcctcctagaacagaaaaatgttaacattgattgcccagtttatccctctaaatttttccaagaatattaaagtattttaaacttgcaatttcacaactgaaagatcacttcagtaagaccatgaatggtggtattatattatatacaacaaatctttttgactagttaagaaaataccaattaaaacagaattcaaatgtattgaatttacagtcaaataaacatcatataggaccagaaaaatatgtttattgtaggtgttttttagaaccttatatttacccaactaaaatgtcttgaaatgtactttacatttttgataagatgttttttaaaagaacaattgtgatttaccttaatagtgaaactgaaggtctttcagtttatttttcataaagtgagctctcagtggttctctaagcttagcgtataataaagttataagatggatcacatttattttaggtgtaaaaatatattggaaacagtcatatgtatggggaaagatagaaaatggaccttaaaataaatgaaatgaaatgtatgaaaatctttggaaatgacactgacaaattgtttgacaaccaactttatgtcacaatagaacaaataagggacggggatctgttttaggatgaattaaagtcattgctgaagagtgttcatttattagataaatcaggatcagcaaacaagtgaaacaagtctaggaaaggactgagaatggctttaaagacctttaagagctgccactcgcttggaatagcaggtttcagtggtctgtacttcaccaagtaatcttctggtagatgactgaaggagctgcttgcaggttttgagaacatttcgttcagctaggacttagtccattcaggctgctataacaaaaataccttagactggggaatttataaacaatagacatttatttctcacagttctggaggccagaaagcccaagatcaaggagccaacagattggtgcctggtgagctcctcctgttccttatggatggatggcaccttcttgcggtgtcctcttttttttttttgagacggagtctagctttgtcacttagctagagtgcagtggcgcaatcttggctcactacagcctctgcctcccgggttcaagtgattctcgtgtatcatccttcctgagtagctgggattataggcagccgccaccacgcctggctaattttttgtagagatggggtttcaggctggtcttgaactcccgacctcaggtgatctggccaccttggcctcccaaagtgctgaaattacaagcctgagccaccatgcccggcctgtcttgctatatcctcacatggaggaagaagcaagggagctcactcaagccacattttttaagtttcagaaatgttgctttatatatagatatagatagatatgtctttttaagaaagaattttgcttttgaaaattttttcttcatttaaaaattttaatttttttttttttttttttgagatggcgtctcactctgtcgcccaggctgcagtgcagtggtgcaatctcggctcactacaagctctacctcccaggatcacaccattctcctgcctcagcctcccaagcagctgggactacaggcgcctgccaccacacccggctaattttttgtatttttagtagagacggggtttcaccgtgttagccaggatggtcttgatctcctgacctcatgatccgcctgccttgtcctcccaaagtgctgggattacaggcgtgagccactgcgccggctaaaaattttaatgtgttttttaaattgacatatgattgtatatatttatgggattcatagtgaagttttgatacaaataatatatagtgaccaggataattagcagatccatcatctcaaacatttattatttctttgtattaggaacattcaatatcctccttctagctatgtgaaactatataatgtactatagtgaacagtagtcatcaaacagtggtatggaacactagaactgattccccttgtctagctgtcactttgtatcctttaacaaatccgagccacttttagaagggctaatgtcaatcatgagggtggtgcccccatgacttcatcatttcccaaaggccccacttcttagcactatcacaatgggtattaggttccaacaaatgaatttggggtggcgagcaccaacatttagatcacagcaagtgtttaggaaaatactaaaattaagcctactcttttaaacaacctttagacaattaaaatgtcataggagtgatttcagtgacaagttttcaatcggaagtcaaaagctccaaaagttatcatattacaaatgttcccgtgagaaacatgtacatctgtaaaacaaacaagcaaacaagcaaaaggaggaaaccagagttctaaacttacgacaccacaagaaaactccaaaacagaggtctgtacggaggtattgtgggccacacggtgctgcccacacacggggttttgtgagaggtctggactggaacttgtttgtacattttttcttccctcctttgcttaaactgttatcagacctagagaccgcccccctccaactcccagcctgaaatgttctaccaccatggtcccagctagcccaaatcgtcatctcctccaaggtccagacctcggggtccccccagctcaacttctttgacgtcatcacatcatcagatgctgcttgaagagtcacttggctcatgtcttgatatcccagaaatctcaaaggcatctggggagggctgagccaagtactttttctgcctccagttaccacaaaatcacattgttttatacagagaaaaatctgtttcatgctgatttttaaagactgcaaatttatatcttctattctcatgaataagagctacaaggttgaccaaactgagcagaattaggctttatgacatgggattcttaaacaattggattagagttaatggagaaggatttccatctggttctcttccaggtgtcttgagttttcatcaattttgtgtttcctctggcagtgttggttcattgaaaatttaacaagtttggccgggcgcagtggctcacgcctgtaatcccagcactttgagaggtggaggcaggtagatcacctgaggtcaggacttcgagaccagcttggccaacatggtgaaaccctgtctctactaaaaatacaaaattagcagggtgtggtggcacatgcctgtaatcccagctagtcgggaggctgaggcaggagaatcgcttgaatccagggggcggagtttgcagtgagcagagatcgctccattgaactccagcctaggtaacgagcgaaactctgtttgaaaaaaaaaaagaaaagaaaatttgacaagtttgtagtggttctactgcaaggaaaaactacaacttaaaaatgtgtttactccaaattgtactattaataggagatttctgaaagcctaagttttcattaagaactttttctttaacggtgcatcaagtgaaagccttgagatgattctggattagatatatggcaaagttaccgtgagctcaaaagccattgtccagatgaagaaatcctcagggtcaatatgaatgcacataggatgactgatggaatccaagaaaagctgccatagctctgattttgcctttttgtgttgtctttagagacatgctcttgctctgtcgcccaggctggagtgcagtggtgatcatagctcactgcagccttgacctcctgggctcaaagctatcctcctgctttagctttcttttttttttttttttttaagatggcgtcttgctctgtcacccaggctggagtacagtggtgctatctcagcttattgcaacctccgcctcccaggttcaagcgattctcctgcctcagcctcccaagtagctgggattacaggcatgtgccaccacacctagctaatttttgtatttttagtagagacagggtttcactatgttggccaggctggtctcgaactcctgacctcaggtgatccacctgcctcagcctcccaaagtactgggattataggtatgagccacctcacctggccccgtcttagccttctgagtagctaggactacaggtgtgcaccaccatgcctggctaatttaaaaaaaaaaaaaaaaaacttgtagagatagagtcttgctgtattgcccaggctggtctcaaactcctggcctcaagcaatcctcccacctgtttgatttcatgtgtctcaaacagcataggagtctactaaaggctttttttccttttttttttttttttttttgaggcagattcttgctctgtcacccaggctggagtgcagtggctcaatcttggctcactgcaacctctgcctcccaggttcaaatgattttccctgcctcagcctctcaaatagctgtattacaggtgtccgctaccacgcccggctaatttttgtatttttagtagagacagggtttcaccttcttggccaggctggtctcaaactcctgacctcaagtgatccacccatctcagcctcccaaaagtgttgggattacaggagtgagccaccgcgcctggcccaccaaaagctttaaagtgaggtgaatgcagattccattttcagattctgctacaaattgtgggaccttaaacaagttactcatcttctctgtgctttagtgttatgatctggagcctgatcttcattctaccacttaccctgtacatcttggaaattttattttatttccctgtgactgttgccttgtcttgcagatggattattctaacatccacttcataatcttgtttcatttaaggagattgatcatacgtgggaagcacttagaacagtgcatggacgagcacgagtatttcataatgagcagctgtggctgttactaacactggtattactagtacccgtacttccaggcagggttgttgagaaggtgaaatgaaagaacgcacaccagggcaggctacataatttgtggaccccggtacagaatgaaaatgcaggacaccttgttcaaaacttcctaaaaacgtcaagactgggacagctgagtattaaaccaagcgcaggacccggacctgcacaggttgcacgctcgcagacacatttgcacacagtgtgtgctaaataaatgctccgttcacccttgtgaagtttcctatgcctcactcgcgccagcaccgttcacagtgcccactggctgtatttatcgctgacataaggatgaggcctggaattgcattcactgcagagtcccaccgggaggaccgaccgttatccccgccgactccccccaggtcgccctggcagtttcggccgctcagttgcaggccctcgccacggaggccacgctcgggggttcggggtccaccccggcctcctgcggccgggccaccctactcgcgcgcagccgcgcgccgccgcgtccccgcggtgtttacccgttgcccgaggagacacccgcgccacccgccggctcccggcgccgccgcttcctcagggccggttccgggtccgagcgcgcccccgggctcgggtcgtcatgagcctggactgcaccagccatatcgcgctgggtgccgcttcgccagcgcccgaggtacggtcccagccgccggccgcgcgcgggggtggccctggggatagacgacccaggaggggccgaggcgcccctgatttgcacccttttcctcccggaggcgtgggcagaatcagagcagctctgtgcccgcgagggctgtggcctgggactgccagggcgctgatttcaggaggggatgggcaggaccggagtttgcggagcgcgtctgaattttaggttgtgccactctgcttctctgaccatttaaaccggtgacattcgaaagactgtggccgggcagttcctccccgccacccctgggagcaaagaattccttcatttaactttccctgcttagctactgaagtgtgcttcggagcaatttctggaaaatctgatgtggcaggaggagggccagcccggagtagagtcaccggccctttcgttgcgaagtaatccagaaacgttggtaattcagttgttcctgaatgcatctactcatttactcccaggagttacttaggtactggggactttcaggtattagatgtaccaatgcgcgcgcgcacacacacacgaacatgcgcgcatacacagacgctcgtgcacacacgcgaacaggcacatacgcgaacaaacacgggcgcgcacacacacgaacacgggcatatgcatacttgggcgcacaagaagatctggctggctcagtctgggttaagaatccccctttggccttggcatcggggcccaccgggtatcgtgtgtattgggagtagttgccagagatgggggaattgtgttcagctcaactgctaaccgcaagtaactcacccaattagtaaatgatggaggatttttctttctttccaaagttttggacttttcctaccacgctgtgtactgaccatagatatccctgggggatgtagtggattcaaaacatgagttggattctccaacgtgccatcggaattcttctaatattcagcagctttgattgttgttttacatctgacctgtatttagatttctctgattcctggaatatttgtggaaaataagtaccactgtgtgcaaataaaactattttttctttctttctaactcagaggccagttactagatgttttttctttcatctgacattttcatatttgactttattaatttttatcccaatgtggtgtcttaaccatacataagtatgtggtatttttatattattaatatatattttttttggtgagcccattgagagtaaattacagccatcatgattctttctttctctctcctttttttctcttgttctctccctccctccttttctttctttcttctttttttcagacagggtctcaccttgttacccaggctcgagtgcagtggcacgatctcggctcgccgccgccttgacacccctgggttcaaacgatcctctcacctcagcctccagagtagctgggactccaggcatgccatgatgcctggataatttttgtgttctttgcagaggcagagttttatcgtgttgctcaggctggtctcaaactcctgagctcaagcgatccacctgcctcagactcccaaagtgctgggattacagagatgcactaccatgcctggtcccctatgacctttcatctgtaaatactctggtgtgttatctcctatgaataagggcattctctaacgaacatacaatgatcaaaatcgggatgtttagcattgtgacaataatattatctaatatacacgacctactaaaactttgccacttgtcccaattatgccatttattgccaattttttttccatctcaggatcacacactgtatttagttatgtctccagtctcttcaaacctggaacagttcttcacattttttttgtttgtttttttgtttgtttgtttttgtctttgatgatactgacatttttgcagagtccaggtcattcgttttatagagtaagtttctctgattgtccttcgtgattagatttttgggtaggaataacataagagatgttatgtctcagagtatcacatcaggaggggcatatatcagcttatcccattattggtgatgtccccagctggtggcctctgccagatttttcccctttagcaataaataagaaatcatattagttgagtaataatattgattcggatagaaatttttagcataagtcactgcctacaaaaggaaaatgtccattaagcatgagattttaattggcttaaaataactaaattttattgagaacaaaagtagctgcagaaaaggcagcatttattacaattaaatgttcagtttgcaaaatactttatctgagatcatcttataatttagataggcggggcagaaatttctcactatataagatgaggaaatagcttactggattagaaatgatggagcagggacttgtatctttctttcaaaagctttgtacttttcctaccatgccagactgaaaacattaaattacaaagcagtgatagtctgcaactttctggaaaagtaaaatactgtagagactgagatactagttttagactcaaaactagattcaaacaatcctgattataccactcatctgtgacatcttggtcaaaacaattaatgtatcagcattttagttttttcttctaaaacatggaatcataaaacttatcgcataacgtagtttgaggatttcacggttaataaatgtaaggcactcaagagagtgtctgacagaataagtgcatatcaatattagctatcgttattctttgtaacttttggaatttgctttggtgtcaacaccactgcacctactcctaccatcatcaccaatgcttccatcagtacttcagccaccatctcaatagtcagtgttttgagaatctgtaggagggacagaggatacaaaaatgaattggagattgaccctgctcataatgaagaattgacagtttacaatccactttgggaggcagaggtgtgtggatcgcttgagcccaagagtttaagaccagactgggcaacatggcaaaaccccgtctctacaaaaaacacaaaaagtacccaggcatggcctgtagtcctagctacttgggaggctgaggtgggaggatcacttgagcccaggaagttgaggctgttgtgagccttgatcgcactactgcaccccagcctgggcaacagaacaagaccctggctcaaaaataaaataaaaattaaaaaagagtttacaatcaagaaaaacagacacataaaaagattactccttcatcaacactaaaatttaatgctgcactcttctcaagttggatttacctataatgcgatcaccagcacagccttactgggatggaaaatgtgacaaatactaacagcaatattatgagaattgaagtggagcagcccaaacatgaaggaaagagatatgctttgggggaagtttacaaacatagctttcagtaagactgcataactttgtcatgcatttgaaataacgctacccagtgaaaatgtgctgggtgcggtggctcatgcttgtaatcccagcactttgggaggctgaggcgggaggctcacttgaggtcaggagttcgagaccatcctggctaacatggtaaaaccccgtctgtactaaaaatacaaaaagtagccaggcttggtggcaggtgcctgtaatcccagttactggggaggctgaggcaggagaattgcctgaacctgggaggcagaggttgcagtgagccaagattgtgccactgaacacaccatctcaaaaaaaaaaaaaaaaaaaaaaagaaaagtgacctaattataaaataggatcaccagtcagcaaaaagctgtagcaatagttctgtggaaagtgcttggattccaaatcctctgacaccagtgagaagccacagacatatggtggcttgtaggctctcttgctgtggcagtgttttcacatacctggaaaacctagatcaaagttacagctccagtagataccattgttgggaatttgagcatctctttcctttctgtaaaacaagggttaattagaataactatcaacagaattgttatgagaagcaaatgtaaatagcaacacactctatcagcagctatagttcctcaaaacaaaggacttagagctggtcatagctaactataaaggagttaaagtctgttttcctttttcttcccatcatttctacttttaaaaacctcatataaaatacatataacataaaatttgccatcttaacttacaaatgtacagtttagtggcattaagtacattcacattgttgtgcaactgttgccacaagccatcttcaaacctttgttcatcttgcaaaactgaaactctgtactcattaagcaataacttcacatttcctcctccccacagctcctaacaaccaccattctactttctttctttatgaatttgactattctaggcatgctgtataagtggaatcagactgtatttaactattctaggcatgctgtataagtggaatcagactgtatttgactattctaggcacggtgtataagtggaatcagactgtatttcagtattctaggcacgctgtataagtacaatcagactgtattaaactattctaggcatgctgtataagtggaatcagactgtatttgactattctaggcacgctgtataagtggaatcatactgtatttgactattctaagcactctgtataagtggaatcagactgtatttgactcttctaggcacactgtataagtggaatcagactgtatttgactcttctaggcacactgtataagtggaatcagactgtatttgactattctaggcacgctgtataagtggaatcagactgtatttgactattctaggcactctgtataagtggaatcagactgtatttgactattctaggcatgctgtataagtggaatcatactgtatttgactattctaggcacgctgtataagtggaatcagaccgtatttgactattttaggcacgctgcataagtggaatcatgctgtatttgactattctacgcactctctctgtataagtggaatcagactgtatttgtccttcaatgactggcttatttcacttagcataatgtcctcaacgtttcttcatgatgtaacatgtatcagaatttccttcctttttaagcttgaaatatattccattgtatgcatatgtcatgttctgtttatccattcatctgtctctgcacacttgtgttgtttctatcttttggctgttgtaaataatgctgctatgaaaatgagtgaaccaatatctctgtgagaccctgctttcaattttgagggatatatacccgaagtgaaattgctggatcctatggtaatcctattattacttttttgaagaactgccactgtttccgtagtggctgcacacattttacattctcaccagcagtgcacaaaggttttcatttctccacatcctcacccccacttgttattttctgtgtgttttcttcctttattgtagcctttctaatgggtatgaggtagtatctatttccactttttaaagaaccatttcctccctcttctggtttgctctgttttttttttttttgttctactcctttttctcaaaatcaagtttaagaagagatctgactctagttgcatgtcttcatatgaacttaagtcagaagccttctctagatataaagaaaaccaatctccaccccaccacccccaaaaagagaatatagagaaaaagaaacagaaggaatagggaaaaaagaaaacataaattatagttgaaagaaatacaaacatatcagtaattatgataaatatatatggagaaaatgcttagttaactaagaaaagccatattgcattaaaaaaatctaaatatatactatttatgaaagacacatttaaacaaaaagatatgggaaggttgaaagtaaaagtgtataaaaatgtgtatcaggcacataacaaccaaaataaaattgattggctatattaatattatgcaaaatactttaacacaagaaaagcattagtagtggtaaagagagtcactaaataatgataaaaatttcattcatcaggtagttgtaataattctaaatgtatatgttcctaagaacacagcatcaaaatagaaaaacaaaaattggcagaagcaaaaatctataaggacaaatagacaaatccacaactaaagagaatattttaaacatatctcttagtattttgtagatcaaccagacaaaaatttggtaagagagctgctaaaagtgctaaaatgcaaatttggtgacgtcactgtgaagaatagaaatatgtaaaatatttgggatgtggctgtaaaaattaacaggattatttttccccaattacccaagggaataaatgccttttgtctatgaaataataagccagacaaaagcttagaaattgtactctattggtaggaagtgaattagatgagtaattaaatgtttccccttgttttaaattaaaatgctttatactattaaaaataatgactatctaattatgagcaaacgttagacaaacccaccttgaaggatattctacaatatgttgaccaggactcttcaaaagtgtcaaggtcaggatttggggagactaaggaaaaatgaaaactaaatggcttctggactagaaaaaggacattagtgaaaaaaaaactgattatattggaataaggcctattacttagttaatagtgttgtaacaatgtcaatgtcttggttttaatagattaccttagttgtataagtcgttattattaggggaagctggctagagggcatatagaaactctgttttgttttgtaacttttttggaattctaaaattatttcagaataaaaaagtctcaataaatgataaccagttaatccgtttacacatccaacttcattttagctttaacatttagtttctcttggtatctatctgctctttgaccacctggctttagagatgagataaaatcttcaaagaaaaggtaggggagagctttttgaatgccaaactttttctttgcatattttaaagagactgcttgtgtatttacttactgttaccaaatataatgtgtagtgtatttcaaacaatagtgaatactccttggtttgtacttgaattgagttgactaataattataaagacttacttttttccatgttcaaggacaacttgattttttttaattgaaaaagggagtaacatttgctgagccaggaattatttatgctatgctcttttacccaaggtttccttatttctttgttttgcttccaactttctttcctttgatattggtgctttggtggctttgatctaaggcagagaagttcaaaggcattgctgaggcagaccagtagcacctcattctttctcttactgataccagcacagctattgctgatagtttatatatctacatgttcagatattgctcataaaaataactgtctaaaccaggcatggtgacccatacctgtaatcccagcaactcaggatactgagactggaggatcgcttgagcccaagagtttagagactgcagtgaaccacgatcacgccactgcactccaggctgtgtgcagagcaagactttgactctaaaaataataatgacaataataattagtaaataataaatcaataaatatctgagttccctcattagtgccatagggagtgggtcagtctcataaaaataaatatctgaattatatttctgagtaactgaaatgacttccttttcattgactgaatttcccttatgcttttcttcttgaatcttccttattagcttcatataaaaatgcatttttcagcatattaaggccatcatagtctaacctcaatatctgtgcaagaaggaacaattttaagacttgactataattgtcccatttccctaagtcttttctacttcagactaaaagaaatggatagttgaacactgaaaaggaactcttattgttgaaatcttatgaatgtttggagtaagcaaaaatgaaaactcaggaggaaatgggaaccataaatattctgcttagtgaatcatacattgtattagtcacccacttgacaaacatttattgagtcttaggcactctgttaggcactgaagataaagaacttttttccttgaccaactctaaaatgagtgcccattttcaagcaggtgctcttttagatacggtccccctttcacaaaagttatatccgcggccaggtgcggtggctcacgcctgtaatcccagcactttgggaggctgaggtgggaggatcacgaggtcaagagatggagaccatcctggccaacatggtgaaaccccgtctctactaaaaatacaaaaaatcaaaaaattagctggacatggtggtgcgcacctgtagtcccagctgctcgggaagctgaggcaggagaattgcttgaaaccgggaggcagaggttgcagtgagccgagatcacgccgctgccctctggcctggcgacagggcgagactacatttaaaaaaaaaaagttatatcctggtgtgagaaatagatttttaaaaagtaaacaaatagacaaacaaggtaattttagagtgttaagtcctttgaaaagaaaataaagcagaataacaggatggagatggaatggggtgagggctaaagtctagtctgggtagggtgggtagggttggctccccaaggagataacatgctgaattggaatagtcttagaaacagcaagagcggtgccaggcccttgggtgggaatgagcttgatgtgtttatttttatttttatttttatttttttgaggtggaatcttgctcttgtcacccaggctggagtgcaatggtgcgatcacagctcactgcaacatccgcctcccaggctcaagcaattctcctgcctcagcctcccgagtagctggggttacaggcatgcaccaccacgcccagcaaatttttgtatttttagtagagatggggtttcaccatgtcgtccaggctggtcttgaactcctgagctcaggtgatccacctgccccagcctcccaaagtgctgggattacaagggtgagccaccgcgcccagcaatgtgtttagaaagagtgcagtttgtggaatgttcctcgatttgggtatatctaatgttttctcatgattagattcaagttaatcatttggggcacttttggcaattggataagaggtgtgtttttctcagtgcattgcagatggaaccttgtgccagaagacaaaaaaaggctgcaaaactgttccagattcaacagactaaatatacttggcagctacatgcaatgcatttattgtttctctaaggaacattattgagataattggtgaataatatagtgtcattgttaaatttcttgaatttgacagttgtatgaagaggaatgtccttgttcttagaaaatacaagctgaagtgtttagaggtaagggaccatagtgtgtgcaaattgctcacaaatgattcagcaatcatattgtaatatacgcatagagaaaggaatacatcaaatgtagcacaatgttctcacaattggttaatcaaagtgaaacatacttgagttccttggattattcttgcaacttttccgtaggattgaaataaaaatgaaaaaaaaattatgtgccaggcaacaaatggagttaaaaagtagaaggcattgtttcactccaactatggagcttacttacagttgagttaggtaaatagtaattggtaataaataaaatttttaccaattttaccaataaaaaataattggtaataaataaaatttttaccaattttaccaataaaaaataattggtaataaataaaattttaaaaaggaagaaggcaagcatcactagagtaaatatatggtctcagagaaggacctagagggacagacacaatgaacaaacagaattacacagtgtgctgtagcagaccagggagggacgagggatgggaagttttgctgaggttactggggcaatggtggtgatggtcagggggtaatgctgaccttgatgtgccatcaggacatgcaaatgatggtcactagacggttggaaatgtcagtctctagttagagatgcagatttgggagctactagatactggaagtggctgagatcgcaggagggcatgaagtaaaccggtgagaatgtcccagtgatgaggagagagcgtcgaggacagaacccagcaaatatcaagttgtgagtgggtgaaggaagtgagctgcagtagggactgagtggagggctagagaagtgggaaaaaggagagacgctcagtagagaatgggggcgtgagagtaaggaggattccccagcagtaagtgatttgtgtgtcaaggcccaaaaaggaggtcaagtcaggtagagagtaaaaagtgtcacctggacttggtggcccgcggagctgcccgctggcctcctgggcacttctcttagtctttgtcattcattctactcctaggagctgtgctgcccgcagaccttctctgagaggttcccttctcagtggcctgcatactaggaagccaggaaccagctggagtgtttatgcccaccaagcatccaggtcccaagagggcaggcggcatctcagcactggtcctgcctcccctttcccctgtgttggtggcacacattccctttcaggtgggaaaatgggtcccatacggattgttctccactctaggattaaaagcaaggattcttactgggcgtggtggctcatgcctgtaatcccagcactttgggaggccgaggtgggcaggtcacgaggtcaggagatcgagaccatcctggttaacacggtgaaaccctgtctgtactaaaaatacaaaaaaattagccgggcgtggtggctggtgcctgcagccccagctacccgggaggttgaggcaggagaatggcgtgaacccgggaggcggagcttgcagtgagccgagatggcaccactgcactagagcccaggcgacaaagcgagactccgtctcaaaaaaaaaaagcaaggattcttgtgctgtgactcctcaaggctttgctattgatatgcaaaaccatgcttttgaaattgtaattctacttctgttccagaaagcctacttcttaaaaatcaagaactctaggctggtcatggtggctcatgcttataatcctagcagtttgggaggccaaggcaggaggatctcttgaagccaggagtttaagaccagcctgagcaacatagtgagaccccatctctacaaaaaaattaaacaaacaaacagcgggcatggtggtgtgtgcctgtagttccagctactcaggaggttggggcaggagggtaccttgagcacaggagttcaaggctgcagtgagctatgatttgtaccacttcactccagcctgggtgatggagtgagaccctgtctctaaaaaataaatagagaaataaaagaattctatagctctggaaatcttccagtgttggcctgagttatatcctcatggacccatcagcaatatctacccacaaaatatacctccaagtaatggaatgaattgacttattacgtggatttatttagaattgacaattagaattttagagaataattgccaagaaatgattatagttttgaccatattggctgttaagtgtttctttctgatagtaattaaccaactatttaaagtcatgtctggttcacgattttaaaccatgccatttgagtagagatcaatgcctgtgcttctattcgtgaaggcaaatgggcagactgacatttacctaacagtgaaattaaaatattcagatttattcaagcttacaaagatagatttattcaagatgcaggcgatagagtttcatttcacatcattttgacctggagacagtttattccttctccaatcctggcagggatatttgcatgaagatttttgtaaccttgtgtaatggtctggtattaaccttaagaccacactcttttggaaacacaggatgtgatggttcattttatgtattgctgggaagtttttttggttttgtttgtttgtttgttcttagatgagattagcatttaaatcaatagactgaaagtaaagtagatggccctctgtaatgtgggtgggcctcatccaagccattgaaggcctaaagagaaaagactaagatttcccaaggaacagagaattctgcctccacaatccctttagacttgagctgcaatatcagttcttccctgggtctcggggctgctggcctgtcctgcagatttccgacttgccagtcaccacaatcttgtaaaccagttccttaaaatgaatctctctctatgtacatacacatcctattggttctgtttctctggagaatcctgactaatacacaggggaacttcactgtgagtccttccatgcttgaggggtttgttgaaatgaggggatctggagcccacacagagggcagggtatagctaggcccacaggtacttcacacacagacccaaagctgggaagagcctgttgtagcccctgcccaatttcgtagagagacagggctgaccaatccatcggtgctcacggtagcctaacatacttttaaggatccatgagaatgttctatattttttttaatcagtagagaaaaaaaaatgagctttgaagttgaaaaaattacagatgatccccaacttatgatggttcaacttagaatttttcaaatttaccatgggtttatgaggttgcaaccccattgtaagttcaggagcatctgtgttttgatacataatattttgatatattcatctttatactaatgcagtcacaaaaaattatttttaatatcttctatgaaagaagggacccatgaaggcaaaagtgtatagggcccacaaaagttataaggcagccctgtagggagatgaaactgtgtgtagaaacattatgtagaaaacattgataaatattggccaggcgcagtggctcatgcctgtaatcccagcactttgggaggccgaggtgggcagatcacgaggtcaagagatcgagaccatcctggccaacatggtgaaaccctgtatctactaaaaatacaaacattagctgggtgtggtggcatgtgcctgtaatcccagctactcgggaggctgaggcaggagaatcgcttgaaccagggagtcggaggttgcagtgagccgagatcgtgccactgtactccagcctgataacagagtgagctccatctcaaaaaaaaaaaagaaagaaagaaaagaaaacattgataaatattaataatagaagagttactactaggtgatagataatagaaaattcagtcttaaagttgtttgctcctcttcctataggttgatatgaaactgatgagtattgaaatgacatccaacagtcttcagtctccctagttccacagttttgtggcactagagcattgctcttttggaagatggcattaactatatttcaagtctatgtaagggaaatattcctgaggagctaatttaaatcaatagcttattaaggtttcaagcataccactcaacatatgagctaaaatattacatctgctgggcccagtgtctcacgcctataatcccagcactttgggaggccaaggcggatggatcacctgaggtcaggagtttgagtctagcctggccaacatggtgaaaccctgcctctcctaaaaatacaaaattagccaggcatagtgggggggcgcctgtagtcccagctactggggaggctgaggcagaaggattgcttgaacccaggaggcagaggttgcagtgagcaaagatcatgccattgcactccagcctggatgacaagaacgaaactccatctgaaaaaaaccaaaaaaaccccaaaaattagccgggagtggtagcgtgtgcctgtaatcccagctactcaggaggctgaagcacaagaattgcttgaacccaggaagtggaggttgcagtgagctgagatcacaccactgcactccagcctgggtgacagagtgagactctgtctcaaataaataaataaataaataggccgggcgtggtggctcacgcctgtaatcccagcactttgggagcctgaggcaggtggatcacctgaggtcaggagtttgagaccagcctgaccaacatggagcaatcccgtctctactgaaaatacaaaattagccgggcgtggtggcgaacgcctgtaatcccagctacttggagggctgaggcaagagaatcacttgaacccaggaggcggaggttgtggtggggcgagatcatgccattgcactccagcctgggcaacaagagcgaaactccttctcaaaaaaaaaaaaaaaatacaaaaataaatattacatcttagaaaaattttcattttaaactaaaatttatcaagtgtctaataataagtgaagtgaaaaaaatcccatttgggaagagttctaaaatctttaacatgtggaaagatctctttctctctctctctctcccccctttcgctctctctgtctcatctatctatctatgtatctatctatctatctatctatctatctatctatctatgaatgataatgatgaataaagtgtctcatctcgttgtcaacagggacttctcattccaccattcctttctcagtggctattccatatgtgacattgttcccaaatttgcattcattattcttgacagctatacccaatacctcccatggaggtagatcctgtacaaatgctaaaaaactgctagttgcttaaaataggacccgaagttaattaattttttgagtccagcctaagaaattatcttactaacttgaacagatatttttaagcttcatagaactttatattaaactaaattataagctcccaaatcaacaagatccaatctgtacatttatgaatgtgtacagttatgaacgtggaagaatccattttccaaaaagtggttagaaagagatttatgaattaattaaaattaaatcaattatttgagcttaacattacttatggaaatgcaagtgattgttacaatagtcttggagacagcaatatcaagcatcagaaaatcattcaatttagggaaaggtgatcatttcaacttttagccaggcatatatgggacaataacattgtgagtaagaggccaggcgttggtggctcacgcctgtaatcccagcactttgggaggccaagacagctggatcacaaggtcaggagttccagaccagcctggccaacatagtgaaactccgtctccactaaaaatacaaaaattagccaggcatggtggtgcgcgcctgtaatcccagctactcaggaggctgaggtatgagaatcgcttgaacctgggaggtggaggttgcggtgagaaaagattgcaccacagcctaggcaacagaaagagactccgtctcaaaaacaaacaagcccataaaacaaataaacaaacaacaacaacaaaaaaacattctgagtaagagcatgggctttggcgtcagaaagtcttggtttgaattcttactgtgtcattttgttcattcattcctcaaatatttactgatactcagtcactggggctacagtgatgaaccagaagccattcttctatctctgtggtagaaaaagagcttccgagaaaaatttcacacttatgctaattctagaaatgagttatttattacagtaaaaactgaagaaaaaggcaaaacaaagcattttaatgttttctgattaacaagtgaatttaaatgtcatatatcagtgaggttacagaataaagatactgaagtcagagagggtgtgttaatataatttcccataatgtacgtctgccatgcaaaaaaaacccttgagattaagattcgatattgcaaaggaggtgatgaggagcttttaaagatagaatgagttaaggaaataattgcaaacttattagtcaggacactcataacaagatacagaaaaatcgtaaattagatagaaagggactttcaccctaacaaatattaaggtttataattttataagtaagttttttttcttcttcttttttttttatagagtctcgctttgtcacccaggctggagtgcagtggcacaatctcagctcactgcaacctccacctcctgggtttaagcaattctcctgcctcagcctcctgagtagctgggattacaggtgcctgccaccatgcctggttaatttttgtatttttagtagagatggggtttcactatgttggccaggctggtctcgaactccagacctcaggtgatccacctgcttcggcctcccaaagtgctgggatttcaggtgtgagccactgcacccagcctcaaggtaagtattttatagatgttttatagttttgtccttacctaataagatgtggatgaacaattcatggctttgcctctccagtgtatcttggtcgactgtctactacgctttccagttcttctaaaactcactaactttgcttctaagtttttgtctagcgagggctaatttttaaaatagggggtttattatttcctggttttacaagacgtagtgaaattccatctatacttgttctagggggctattgtttgccccctagagtataacactagtaaagtgttataattaagttcagccaggtatttttatctttgacgtgctaaccctgtaaagtgaccagagggaagaagcctttctgtttgtctatttatcttcccatccatgtgctcattcatttatccatccattaatttattcaacaaacattaaatgtatattcattcaccagatatttatggggtgttcattatgtgctaggaaatgtgcttggtgctaaggataaaaatataattgatttctagcttctgccttcaaacacacaaccttgtagctgactcgttcatttattaatgcccaacatatatttcatgagtgcatactatctgccaggcactgttgcagacacagtactggaaaacagagggcctgctctcacggagcttacattctagtaggtagacataaaacacaagatgtttttgagaggtccaagaagataagatttgaatttttgtttatcttaatcttaatttacatttttgtatatgtttggtaccgtgcataatatgtacagtagtatatgtatatcttttttatttttgagacagggtctcagtctctgccacccagactggactgcggtggcacgatcagagctctttgcagcctcgatttcctgggcttgagccatctcccacctcagcctcctgagtagctgggaccatagggacactaccatgcctggctaattttttaatttttgtagagacaggggtctcaccatgttgcccaggctagtctcagactcctgagcataagcaatcctcttatctcaacctcccaatgtgctgggattacaggggtaagccactgcacccagcagtataccgtttttttttgtttttttttttttttgagatggagtctcgctctgttgcccaggctggagtgcagtggcataatctaggcccactgcagcctctgtctcctgggttcaagccattctcctgcctcagcctcccgagtatctgggactatagatgtgtaccaccacacctggctaatttttgtatttttagtagagaggaggtttcaccatgttggccagcctggtctcgaactcctgacctctagtgatccacgggccttggccttccaaactgctgggattacaggcataagccactgcacccggacccagtagtatatcattttaaaataaacacatatttaaatttgtttcataaactcataccaagagcttgcagacaaaaacatttacaaaccccagggtaaaagcatgggtgttaggatcagagacttgtgggtttgaatccaggttctgctttactcgttgcctgtgggtccttgggtaagcccgagttcctcctcctttctaagaactgttgtaagggttgagtgcaataatgttagtaaagtgtttaaccgagttcctcctcctttctaagaactgttgtaagggttgagtgcaataatgttagtaaagtgtttatgttgcgtctgtatataccaagtccttaaaaaaaggatgactaatgttactactatgattattcttcgtgtgataaatattataatacagacacctcttaaagggcatatagaaatattgagaaggaactgattaagcagtgacccttaaagtcatgaacctatggtacataattggtgggagtgtaagttggtgctattttctatgcaatgtgtatcaaaacaatttttatttcctttgactcagttgtttcttttccagagaaacaactttcctcatcctaaggaaacagtcagaattctaacagatttataatagtgatcaattagaaagagaacgaaatgtcgaatcgcgggagagtagtcaacttaaaatacagctttatgatggaatattgtgcagctgttaacattttaaaagaacacttggggaaatattaatattaaatgtagaaaacaggttgtaaagttgtagttacagtataaccccaattatatttttaaaaagcacatgatatatttgtattagaaaaacactataaagaaatgcatcagacagggatggtggctcacgcctgtaatcccagcactttgggatgccaaggcgggcagatcacttgaggtcaggagttcaagaacagcctggccaacatggtgaaaccctgtctttactgaaaatacaaaaattagctgggcatggtggtgcacacctgtagttacagctactggggagggtgaggcaagataattgcttcagcctgggaggcagaggttgcagtaagccgagatcccaccactgcactccagcctggatgatagagtgagagaggctccgtctcaaaaaaaaaaaaaaaaaaaaagccaggcaccatggctcatgcctgtaatcccagcactttgggaggctgaggtgggtgaatcatttgaggtcaggggttctagaccagcctggccaagatgatgaaaaccccgtctctactaaaaatacaaaaattagctaggcagtagtggcattcgcctgtaatcccacctactccggaggctgaggcaggagaatcgcttgagcctgggaggtggaggttgtgatgagccaagatcatgccactgcactccagtctggatgacagaatgagaccctgtctcaaaaaaaaaaaaaaaaaaaagaaaaaagaaatgcatcaaaatacaatagagttatctctgataagactgtgggtggcattcatttttttcatcgattagacaatcacagaaatattaaccaagataaataaagcaagatgagcatgtgggcaggagtggtaactgggataaaaagaaattttgaccagcctggacaacatggtgaaactccatctctaaaaaattacaaaaattagctgggcgtggtggcacgtgcttgtagtcccagctacctgggaggttgagataagacgataacttgagactgggaggtcaagtctgcagtgagccgtgatcatgccactgcactccagcctggatgacagagtgaaatcctggaaagaaagaaacgaaagaaaatgaaagaaaggaaggaaggagggagggagggagggagggagggagggagggagggaggaaggaaggaaggaaggaaggaagggagggaaattttgcctggggatcctaggaagccttcacaaaaatgccagttccaactcttgaatggggcccagacttttgcccagtggagaagcagcttgtgaagaaagaggaagaacccagaaggtgaaacagcgatgaaagctctgtggcatgccgagacacatttaattttttccatgtgactggaggtcaggctagatattgggcattgaggcagaaaccctgggaatgtgggttttggctgatagagaagagactcacataccttaaggagtttattccttaccttgtctatcgtgggcagctttgtaggtggggaaagatggatcaggtctgcatttcagagtggctactttgtggcagcacaaaggttaggtcggcacaaagtgagtcggaagggagagcagtgaggagcctcttgcttcagtctccattctttttggatgaagccttggcagaaccattcatttccatcctaatattgaaatgccttcacattattacatcagcttaggctatgtgacttttgaaagcttggtaggttggtgtcagataaatgaggccttcacactcactcacctggtctctgcaagaaactggatcaaggtgatgaggaatgcactcttaatacctgaacaagaggtcttggaaattgtgtttcttatattaactaaacaaatgtagtcaaatgctattataaaggattggctgaagaatatgcatttcattcattctatgctctacttcaaaattatccttgaaatgcaagagcctgggagagatgtctacttggactacattgtttggaccctgttttaggcattggcattacgccattagatttgtaaatcaaaaagtatctgagacaagtctccatcaatttatttacttatttattgagacggagtctcactctgtcacccagactgaagtgcaatggtgtgatcttggctcactgcaacctctgcctcccaggttcaagcgattctcctgcctcagcctcccaagtaactgggactacaggtgcacatcaccacacctggctaatttttgtatttttagtagagacagggtctcaccatattggccagtctggtctggaactcctgacctcaggtgatctgcctgccttggcctcccaaagtgctaggattgtaggcgtgagccactgtgcaggtgggaagcccaggttcttgttatatagatgatgcctccaggtagcaggcttcagagacaatagatggtaaatgtcttcttatcagaccaataaaaggtggtagactctcctgaaaagacctaataaaggagagagattctttacagaatatacatttccttcacaagagacagctttgcaggaccacttaaaaatatgacaaagaaagtgtggcgcagtggctcatgcctataatctcaactctttggaagtccgaagcgggtggatcacgaggtcaagagatcaagaccatcctggccaacatggtgaaaccctgtctctactaaaaatacaaaaattagctgggtgtggtggcacatgcctgtagtcccagctactcgggaggctgaggcaggagaatcacttgaaccctggaggcagaggttgcagtgagctgagatcgcgccactgcactccagcctggtgacagagcaagattctgtctcagaaaaaaaaaaaaaagaaaagacaaatatattttgaggtaaaatacttcgatttctttcagggctgttatctgtcatataatgctatactagagtcaggttggaatttggtatcttattgctacaggagtctgttctctcagtcttaagatctctgttttaatgttaatgctggtcagttgtgtctgaattccaaagggagaagggtataatgaagtatgttgggcctccattttccatcaaggcttgaactagtttcaggtttactttggaatgcccttggccaagaggaggtctccattcagtcagttggaaggcttagaatgttatttttagttgatagattgttttgtgggttttgaaatttgtcatgatttcttgtcatgaatgggtgtgttgtaactgagcaggttctttgctttaccatgaggtcctagtaaatcatgttgaagcggtgttgttgtctagggtaaatacccagggtttgtcatctcgcaccaagaagattaaggacacagacacacatgaggagtgagtttaggagcagaggtttgataggcaaaagaaagagaaagaagaacagctctctcccttgaaagagagaggagttcctgaaagggaaaaactggtcagctctagactgtaccagattttacaggcaggcttgaggagacagtgtctgatttacgtagggcccagagattggttcaaccaggtgcgatgtttacctagtgcgtggggaaggctggtggtcccaccctaatcttattatgcaaatggagtctttgcctggctggtgccatattgtcttttccttactgtgcacatgctttggcaaaaagagagaagatgaacatgcctagtcccaggaagccttttccttttggcacaactgccaacttccacccatgcaagcttccagcttacttgtctatgcctgcagcttgattttacaagctgctctttgttaggaaagaaaatgattttggggccgggcacaggtggctcacgcctataatcctagcactttgggaggcctaggtggatggatacctgaggtcaggagttggagaccagcctgaccaacatggagaaactgtctctactaaaaatacaaaattagccaagtgtggtggcacatgcctataatcccatctactcgggaggctgaggcaggagaattgcttgaatctgggaggtggaggttgcagtgagccaagatcaccccattgcactccatcctgggcaacaagagtgagactgtgtctcagtaaacaaaaaacaaaagaaaattattttggggctgcttttcatttaaaagaaaaccttactgaggactcccatacccttactaatgatttcttcttcttctttttttttttttttttgagatggagtcctgcactgtcacccaggctgcgtgcagtggcacaatctcggctcactgcagcctctgcctcctgggttcaagcaattctcctgcctcagtctcctgagtagctgagattactggtgcccaacaccatgcctggctaattttttttttctttttgtatttttagtagagacggggtttcaccatgttggtcaggctggtctcgaactcctgacctcgtgatccacccacctcggcctcccaaagtgctgggattacaggcgtgagccaccgtgcccggccactaataatttcttcttaactcctgtatcaatgtgactcatgtctgtcgacttggaagggccaagtcaagctgtggtctacctctaggaagtgtacaatactcacagcacatatataatactcctgtgcttcctcttattttttccctcctttaatttttctttacggccatttgcttcttttttttttttcattctttcttgttttcacactggataagaaatagcccttaagctttggatggaaattaaaggaattctcaaaaatccaggccttttgcaaacagtaaagattatacgaaacactagcaaggtggggccttgccttcagtttatggtcctgccatggtacaggagaagcatgtcccagaacagccacagagtccagaagaaggcaacctttctccttttgacttgtagttatggtatacatccatgttttttagtttgttaatgcttctgggtggaccaggctgagatggagtgttgcaagctatctttcttagtgtgggaaaatctgtgcactttctaagccagcccatctccagggggtgggatcttggagaaatcaggcagctccaggggctgaggggatttggtttagcagatgagaatgggacgagactgtcaagtcaatcaaatgtgaggactaagatgttagtaaaaaaagcatacatttgttaccaggaaggagtcccaatccagacccccaagagagggttcttggatcttgttcaagaaagaatttgggtgagttcacagagtaaagtgaaagcaagtttattaataaagtaaaggaataaaagggtgcctactccataggcagagcagcctcgagggctgctggctggctatttttatagttatttcttgattatgtgataaacaaggggtatatgtatcaggggaaccagcccccaatatttcaacgtaggttctttctattttccctaagggtcaggcggctgagaaataaagagaaagagtacagagaggaattttacagctgggcctccatgggtgacatcacatatcggtaggaccatgatgcccacctgagctgcaaagccagcaggtttttattaaggactttaaaaggggaaggggtgtacaaacagggagcaggtcacaaagatcacatgcttcagagggcaaaaaggagaatgaagatcacgtgcttctgaagccaataaagatcacaaggcaaagggcaaagcaaagatcacaaggcaaagggcgaaatcaaaaactcctgataagggtctatgttcagctgtgcatgtattgtcttaataagcatcttaaacaacagaaaacagggctcaagagcagagaatcggtctgacctcaaattcaccagggtgggatttttttccccaccctaataagcctgagggtactgcaagagaccagggtgtatttcagtccttatctcaactgcataagacagacactcccagagcggccatttatggacctcccccgaggaatgcattccttccccagggtattaattattaatattccttgctgggaaaagaatttagtgatatcttccctacttgcatgtccatttataggctctctgcaagaagaaaaatatggctctattctgcccgaccccgcaggcagtcagaccctatggttgtcttcccttggtccctgaaaatcgctgttattccgttctttttcaaggtgcactgatttcatattgttcaaacacatatgttttacaatcaatttgtacagataacacaatagtggtcctgaggtaatgtacactctcagcttacgaagttaagaggattaagagattaaagtaaagacaggcataagaaattataaaagtattaattttgggaactgatacatgtccatattaaaatgaaatcttcacaatttatgttcctctgccatggctccagccggtccctccgttcggggttcctgacttcccgcaacatatattattcatgagttttctaggaaagggatgaggaattcccagaccggagggtttgtcttctttttagaccatacagggtaataacctgaagttgccatgacatttgaaaatcgttatgctagtggtaggagtgtcttttagcataccaatgtattataattagcatataatgagcagtgaggatgaccagaggttactttcattgccatcttgattttggtgggttttggccagcttctttattgcatcctgttttatcagcagggtctttgtgactatactttatgatctcctatctcatcctgtgataaagaatgcctaacctctgggagatgcaggtctcagcctcattttacccagcccctattcaagatggagccactctggttccaatgcctctgacacattcattcacttaattctacaaataagtattgcatgtttacattgtgaggtcctgagtaggggagggaggaagacattgattacttattaaaaattaaacacacagcttattccttccccttgtgataagtgccaggagggagaaacaggggttgctgtgagaggagaactgaaagacagaaatatggtcagtgggaactgtgatcggcaaagatgtacagacacaggaccctgggcagacaaataatgaaaccgcctttgcgaaattatgactgagacagtgaaagagatctaatctaactgactccatcttgtttgtaacctttaagctgtccttgttccttcctaggtgtaggctgaaataactttgggaggaatttggtttagagtttaaaataaagataacaacactttcccaaaacaaacctccttcttgcctggggactagactgcctttgtagtactaagacattagccacaagattagaaattatggttaaggagtcattgcagctggaggctacaagactctgaccctccctaaactgctcctaagatccatgcttgagacattttgcagaccctgcacttgatggatcagctggcatgacccagattgataaactggcccatctgatcttgtggcccccagctaggaactgactcagcacaagaggacaatttcaacttcccatctcttacttaaccagtcaacattcctggttcactggcttccccccacccaccaagttatccttaaaaactctgattcctgaagctcagagagactgatttgagtaataagaaaactctggtctcctgcacaaccagctctgcatgaattaactctttctctattgcaattcccctgtcttgataaattggctctgtctaggcagcaggcaaggtgaacccattgggtggttacaaaaatggcttgggaagagtttaaattgtaaatattagaagaatgagaggattactatgaaggtgtgcatgctgttcatttgctgattttgttcattggcttctgattccttcttaccctccccagctgcctcctgttactctctttattaaattgagggtgagctctggttataaaggagacagtgggttccatcttttgaaaggatgggatcctaaactggagtctacctatgcctgtcccaaaaagagtgttgaggacactcttgttatccttctgataagtaatgagagttgctaagcactacagtataagatttgtaatctgctgttaatactatttgttctgaaaacaaaattgtgaaagaaaataataaaaatctaattgtggactttgtctcattgcaagtatcagaggcgttcaaatcagagtaactccatcttggatagggattgggtaaaatgaggctgagatctactgggtcacattcctaggaggttaggcattcttagttaacaggatatttacagttaagggaacaagttaataatgtttattgaacagacccaggacttaagtgacccaggaaatagaccaaggaaatgtcttgatgtcccactgtcttaagaacaaaagcattcttagtttaagcgtaagtttcgggccaggcgtggtggctcacgccagtaatcccagcactttgggaggccaaggagggtggatcacgaggtcaggagatagcgaccatcctggccaacattgtgaaatcccgtctctactaaaaaaatacaaaaaaattagctgggcgtggtggcaggcccctgtagtcccagctactcaggaggctgaggcaggaggacggtgtgaacccaggaggcggagcttgtagtgagtggagatcgagccactgcactccagcctgggtgactgagcgagactctgtctcaaaaaaaaaaaaaaaaaaaaaaaatttgttgggcatgttggcatgtgcctgtcatcccagctactcggaaggctgaggcaggagaatcgcctgaacctgggaggtggaggttgcagcgagctgagattgtgccattgcactccagcctgggtgacaagagtgaaattccatgtcaaaaaaaaaaaatttcactttaaagataatactatagattcttgcagaagacagtagttacacaaagattaacaatcctttattgcaaggccttgtagagaacatcttcctcatgttttttgctttgttatcttacatgtaaacaagcattgtatcttgttagatatgagttctcaatttcttttcaaagaattaatatgtagtatgttcaattctttgacttctacttttaaacttaacttccttgtaaaggaacctttttcaatgacctactccaccctgactcattccgatcacctgctcaaccccaactcattccaattacctgctacctgctctgccctgactggcgccaaagtactcaccccgtcattctctttaaattagccaatgggaattagtttagcctgtgcagtctaaccctagccaataggagaacaacacagcagcaggggccacgtgcatcagggaaaagaaccccttaccctcccttgtccaagtgtgcgctcaccattgctccgtctttaagggtgcacccttctacagaagtaacttgccttgctgagaattaaaaagaaaatgttatattcgagtgctattccttttgtggcactgaaactttataacaaccttgcatataaacaagcatcgtatcttacatagaaacaagcatcgcacctaaggtgtgcgcatttctcttcttgctttcgagaatgccctgctctatctgctgtctagagagtagccattcttttattcctttactttcttaataagcttgcttttaccttattctgtggacttgccctgaattctttcttgcacaagatccaagaaccctctcttggggtctggaatgggaccgctttccagttacagtagaattgttataggaaggttgatttctgctaaagtgagacatgggaagattacatactgctacaatttcccactttcttctcatgtgtttacaaaatgggccactgtggaggctctgttgctctcaggagtttgtgcagctggatgctatggattctgtctaacagaagaaatgggtcctagaaatgatgaagcagcattatttttattgagtcttcttcaggcagagctaaggacaccttggaaaataaagcaaggatttagtgcatcacagaagctatttaattttctctctggcatatcctttgctaattggagatgttttcccagttaataaaagtattaaaaaaaattgaattcttggcagccaggcatggtggctcacgcctgtaatcccagcatttgggaggctgaggtgggtggatcacttgaggccaggagtttgagaccagtctggccaatatggtgaaaccccgtctctactaaaaatacaaaaattagccaggcgtgatggtgcacgcctgtaatcccagctactcgggacgctgaggcaggaaaatctcttgaacccaggaggtggaggttgcagtgagctgagattgtgctgttgtactacagcctgggtgacagagtaagactctgtctcaaaaaaaaaaaaaaaatcattgaattcttgttttaatccttgaagacacttaatattttggccagaacactatttatattccgtttattttaacaatgaatttcctgtcccaaatgtagtcaaaatgtgtacttgcacaacaaaagcattgcaaacactgctgtgttacagactggccaatgcaccacaatgtattggtctctttgtgtgagttatcacctggagtactttgtctcaggaccaagagaattaaagggtgaggttggagcgaaagtttaataagcgaaaggagaaagctcactgcaggggagaggggatccagaagagggttgctggtttttgcagttgaatgcaaaggcttttgtaagaaaccgatgagggctgggcatctcatttgcataaggtgcaaatttctggtagctccaccctgacctcctagtgcacatgtgggcgcttagcttaagttactccatattgctttgttctccttactatgcatgtgttaggggatggaattttccattgcaggcatgtctgggcaagcccccctgtgcaagttcccttatctgtgcctgcaggctgttcttcagttcgaaagaattcatctgaggacccaccctaactgtctgcctgactagtttcttcctttctcctctctcagctggaactcagtgattctccttttgacttctactttgaccatgcaggggtccaagttcaggatttcctgtggcctctgaagccaataaagaattcacgaacatggaattcacaaacagttttcagattcttgaaggctgcaatatatgaatattaggatgtaaaactgaaaacctaataaattggacttttaaaacatgcttccagttgtcttttacttaattaagaaattgattttaatactaaaattatagtcactttttctttaaaaattagaacattacaaatgaagctacagtttccattgacaaccacctctaatcttgatcatcttctcccattgttcagaggttattatgatgtaagtttggtgagtgtccttcagaccattaaaaatacttttttcatttcatttcaatgtgcctatacacattgtgcctatacacaaaagtttggtatgtacttttaagacataaatggtgtcatactgttagttttgttctctaatttactttatttaaaaaacagtatgtttttgagatctatttatctccaaatagatccaaatggatttagtctgattcttttttttttttttttttttttttgagacggagtctcactctattgcccaggctggagtgcagtggtgcaatctcggctcactgcaaactccgcctcccaggttcacgccattctcctgcttcagcctccctagtggctgggactataggtgcccgccactgcacccagctaattttttgtatttttagtagagacagggtttcactgtgttagccaggatagtctcaatctcctgaccttgtgatccgcctgcctcggcctcccaaagtgctgggattacaggcgtgagccaccacacccagcctagtctgattcttttaactgctttggagatttccatttatgaatgtactatatgtcaggcctctgagcccaagctaagccatcatatcccctgtgacctgcacgtatacatccagatggcctgaagcaactgcagaaccacaaaagaagtgaaaatagccaggtcctgccttaactgatgacattccaccattgtgatttgttcctgccccaccctaactgatcaattgaccttatgacaatacaccctccccacccttgggataatgtactttgtgatatttccccacccttaagaaggtactttgtaatattctccccacccttgagaatgtactttgtaagatccaccccctgaccacaaaaattgctcctacctctaccacctatcccaaacctttaagaactaatgataatcccaccaccctttgctgactctctttttggactcagcccgcctgcacccaggtgattaaaaagctttattgctcacacaaagcctgttgggtggtctcttcatacagatgtgcatgacactatagttaactaattcatgtattgatggacacttacaaaacatgaacatgcatataaaattagaagtaggactgtgggtcacagggtatatgccaaagtgtcccctacagtggctgggacattttatatgtcccttcattaagaatactttaaatttgtttttatttattatacaggaaagaaaagtgtctcctgcagtagctgggacattttacatatccctccattaagcatactttaaatttgtttttatttgttatacagcaaagaaaagcaatcattgcttccagatctggtaccagtccttccttccttccttccttcctttcttccttccttccttccttcctttcttccttccttccttccctccctccctctctccctccttccctccttccttctctctctctctcctctctctctttctttctttcatctgtcttctacttgttttctttttctttttttttgagatggcgtctctctctgatgtccaggctggagtgcagtggcatgatcttggctcactgcacctccacctcctaggttcaagtcattctcctgcctcagccttcctagtagctggaactacaggcatgcgctaccacgcccagctaatttttgtattttttgtagagatggggtttcaccatgttggccaggatggtctcaatctcttgacctagtgatccgcttgccttggcctcccatagtactgggattacaggcatgagccaccccgcctggcctttttttttttttttgagatggagactcgctctgtcgccagactggagtgcagtggtgcgatcttgtctcactgcaaactccgcctcctgggtccaagcgattctcctgcctcagcctcctgagtagctgggattatggcgtgagtcacggcccctggccttctacttgttttctgtccagcaatataattcccattttaggccttaattgcctgatttttaggtgagggaataacaggactgttttgtgaagagtgaaagtttttctaagtgcagcccctgcccactcaatgaaaagaagactcaggggagcaagagtgttaagaatattttagaatgctgccttcacttcaacaaggatgttgaattagaagaattttttttgagacagggtctcactctgtcacccacgctggattgcagtggcaccatcattgtcactacaacctctgcctcccaggctcaagcaattcttgtgcctcagcctcctgagtagctgggactagaggtgtgcaccaccatgcttagctattttttttttttttttttttttttgcattttcaatagggttttgccatgttggtcaggctggctacgaactcctggcctcaagtgatccacctgcctcagcctcccaaagtgctgggattacaggtgtgagccatcgagcttagccatattagaaggatttttaactgaataagagtaacacccaagagaaaagagatggaaaataatgtaaaaacaatatgatcagttttttcaccgtacttgattttatgcagaaatgtcttcttccaaaacttttcccacaaatgctaaggtatagatgctcagatatattttctggatctcacagctgccacactctcctctgcaggctctagtgggccccagaaaccacgagcagatagaagaaggaagaaaaccaggagggccaggaaagtcctcccaagtggggagaattggcaaatagtcaaaaattgacaggatgaatgataacattggagaaatgcaactttcaagacttaatgtatacactgtaaattagggaagaaactttatgtagtgagaaaaacatggacagtaggggagagcttcttagaaggagttgcttactgggcaccactggaagcttggtgggggcgtggggagaaagagagggagagagaaatagaaagagagagagggagaggtagagaagagacaggcacaaggaggcattccataatggaagagcctgcggtaatacaattgtgcactgcagcatgggataatgctgggacaaagagtagattggttatgggatagaatgataagaatggaatggatttaggagcttttgtgtgttaggggcaggcagtgattttcttcttattttttcgtccgtgggataataagacaactaaataccatagtagcaagactggcccaagacattgtccccaggtcagataatttggcacattgtatactaaattatgaataagcttatctttgctttatgccattgagctttgaaaccaccctttattctgaaaagactgtgagccaccccgtgagacaatttcaatcattatcataataatatcagtagcagaatcaaatcatatgtagttggctctctaaaactaatctaaaattgcttcatgggttagctgagaggtacctaataacttagattgtcctcaggtgaggacaaatggatgagtttttatttaatcttgccattttaaataggggaaaaatttttttaagggaagattgtttgatacaggaaaagttgaagaattttcagaaaattttatgaactccaggagggctgaattaagagagaaaacccccaaaatgtcagctttcatatctgttcaagtctatgttacctatggttgtttctttgtcatcaccttcttcataaagacacagcatagcagggttggtgatttttgtctgtccttgtctctttttttaaatttaagagggaatgttctaattgtgaaggtaatacagttattgtaaaggatttgtaaatatagaagcataggtggggtgtggtggctcatgcctgtaatcccagcactttgggaggctgaggcgagtggatcagttgagttcaagaccagcctggacaacatggtgaaaccccatctctactaaaaatacaaaaattagccaaatgtggtggcgcatgcctgtagtcccagctacttgggaggctgaggcaggagaatcgcttgaatacaggaggtagaggttgcagtgagccgagatcgtgccactgcactccagcctggacaacagagtaagactctgtctcaaaatatatatatatgtatatataagcatataataaagaaaaaaaaagtctaccttacaaccaaaagataaccatagttaacacttattcccagtgtttttcttttctttaaattatatttagttgtacaaataatgagtaaatacatccttattgaaaaagtcaaaccactgcgcctctcaccacaactccaattgtcgtgtcaccctcaggggtaagtactgttatcaggtgatggggattctgtaaaattcttttttttcttgtctctaaatatatttatagacaaaaacacaatacttttcctcctgcatgtgttttatgaaaaacagtaacaaacaatgaatttatattatcttatttttgttcagtgatgtcttaaggatattaccatgccaaagcatacagatctatctcatattacctgttgcataggattcaatagtatagaaatatttttatttgataattgctttgtcaacaggaatttatggtttcaacatcctcatccttcttgctgctattactaataattgtattcctgggcatagtgactcacacctgtaatcgcagcactttgggaggctgtggtgggaggatcacgaggtcaagagatcgagaccagccgggccaacatggtgaaaccccgtctccactaaaaatacaaaaattagctgggcattgtggtgcatgcctgtagtctcagctactcgggaggctgaggcaggagaatcgcttgaacccgggaggcggaggttgcagtgagctgacatagagccactgcactccaccctgctgacagagctaggctctgtctcaaaaacaaaaacaaaaacaaaataatggtataacgaatatctttatacatatctctatgcacatgtatgagtattttcataaaggagataattggagagtggagcggcagtgtcttagtccagtttctgttgctataacagaataccacagactgagtaatttatgaggaaaataagtttattccgttcatagttctagagactgggaagtccaaaagcatggtgtggtgtctggtgagggtcatcccacggtggaagggtagaagggccagaaagcatgagtgagagagaactttattttataacaaagtcactctggtgatacctaacctactcccagaataacagcatcaacccatttatgaggattaatgtatcaggacctaatgacatttttctccaaaaatataatttttaattactgaatataatttcattgtgtgactgtatcagtattgttttttctttatattaacattcttttatttttgaactctagttgttttaaatatttgctatggcagattttttgaaaatgttgctaaagagtacctttctgaatatttttgtgtttaatttttgggtttatttccatttcttttgataagatcatgagaaagaaattcaccaggacaaatagtgttaactttaaaaattttttaatgatacatattgccaaatacttttctggaaattttgtaccagtttatctttatttgagcagtgtattagcatgtctttcttatagaactatcttttcatatgattaataatgataataataataattattattattattttgagacagagtctcgctctgtcagccaggctggagtgcagtggcgtgatcttggctcactgcaacctctgcctcctgagttcaagtgattctcctgcctcagcctcctgagtagctgggattacaggcatatgccaccatgcccagctaatttttgtatgtttagtagagactgggtttcaccatgttggtcaggctggtcttgaactcctgacctcatgatcggcctagcctcccaaagtgctaggattacaggtgtgagccactgcacctggccaatatgcttaattattaaatatatttaaaatgttgctagttttaaagatcagaaataataattaaatttatatttaattgatgatgagtgaggtgggacatttctcattttattagccatttatggcccttctgataattgttagttcttctatagatgttttctcttaggtcattggttttcttactggtgtgaataggctctttgcatattaaagttttgattctttgtattatttctggaaatatttttccagtttgctctttcactttaaattctgcttacacatttaaaaaatttgttgtcatctgtgcactttttcttgaatgttcttgcattgcttttgtgcttagaaagtcggctatggctttcatgtttgtgttgttcctccaattcatatgctgaaatccttacctccaagaagatggtattaggagatgggacctttgggagaagatgattaggttatgagggtggaggcttcatgaatgagattgaaaaaagaaagcttagagctgtacttacacattataaaccaaataaatttaagatagacttaaagcactgaatataaaaaataaaatcaggccaggcatggtggctcacacctgtaattccagcactttgtgaggccaaggcaagcaaatcacttgatgcaaggagttcaagaccagcctggtcaacatggtgaaaccctgtctctaccaaaaatacaaaaaattagccaggtgtggtggcacatgcttgtagtcctagctactcgagggactgaggcaggaggatcaactgaacccaggatgtcaaggcttaagtctaccataatgtttagggggaaaacccaaatacattcctatgaaagttaggaacaagacaaaatgtccgttattgctattaatgtttaacaatgtgttattagtttttatgctgctaataaaaacatacccgagactgggtagtttataaaggaaagaggtttatttgactcacagttcagcatggctggggaggccccaggaaacttacaatcatggcagaaggggaagaaaatacatccttcttcacatggcagcacaaggagaagtgcagagcaaaaggatgaaaagttccttataaaaccatcagatctcatgggaactcactactatgagaacaggggtaactgccccccatgattcaattacctcctgctgaatccctcccacaacttgtatgtttatgggaactacaattcaagatgatatttgagtgggaacattagatttgagtggggacacatccaaaccatatcaaatgttctggggttattaaccaatgcaattagtcaagaaaaggaatagaggtataaaaattggaaagaagaaggtgaaattttcattatttacaaatgatttgcatgtttacagtgcaaaacccaggagaatctattgaaaacaatcccaaacaataagaaacataaaaaagatatttaggtacatatttaatatataggaataagtagaccccatttacaatatgacaaaaagataatatttttagagataaactacaaaatatagtaaatctaaattgctaataagaataagacttcttggctgggcacagtggctcatgcctgtaatcacagcactttgggaggccaatgtgggttgatcacttgaggtcaggagttcgagaccagcctggctaacatggtgaaaccctgtctctactaaaaatacaaaaattagccaggtgtcatagcacatgcctgtaatcccagctactcgggaggctgaggcaggagaattgctggaatctgggaggtgaaagttgcagtgagccgaaattacgtcactgcactccagcctgggtgagagggagactctgtctcaaaagaaaaaaaaaaagaaaaaaaaagaataaggcttcttgaacaaatgagaaaaatgattttagttggaagcctcaacatttaaaacatataaattctctatagtttatttataaaattaacatgaccccagtaacaatatcgacaaaattttttggaattttccaagaagattttgaatttcatatgggaaaatgaatatgtaagaatagccagggttattcagaaaaataagtcctaccagatacaaaatatattaatgacctcagagctgccttttaagccctgctgccactattttttgtctgtgtttgtctgtaggcatcgctgctttctctcagatccttgcctgcacgggccagatccctgccgcagggcccttgcatggcctttttgctatttgaatgatgtgggcagctcctgcttcaatacctcttgactatttctctttttttttttttttttttgagagcnnnnnnnnnnnnnnnnnnnnctgtgtcgggctgtagaaagggggctggcggtgaggtggtgggctggacgggccggaggcgcgcgggcagggcccgtgcagggccgtggggggtatgtgaatgaatgtgggcagctgctgcgtcgatacctctggacgagttctcgttgtgggtctgtgttgctgagatggagtctcgcgctgtcacccaggttggtaggcagtggcacggtctcggcttactgcatgcttcacctcccaggttcatgcaattatcctgcctcagcctcccgagtagctgggactagcagcgcccgccaccacacccggctaatttttttttatttttagtagagacgggtttcaccatgttagccaggatggtctcgatctcctgaccttgtgatctgcccgccttggcctcccaaagtgctgggattacaggtgtgagccgccgcacctggccgactatttcattcttatttaatcatcacttctggctgggcgtagtggctcatgtcagtaatcccagcactttgggaggctgaggcaggcagatcacctgaggttgggagttcaagaccagcctgaccaacatggagaaaccccatctctactaaaaatacaaaattagcagggcgtggtggcacatgcctgtaatcccagctattcgggaggctgaggcaggagaatcgcttgaacctaggaggtggaggttgcagtgagccgagattgtgccattgcactctagcctgggcaacaagagcgaaactccatctcaaaaaaaaaaaaaaatcatcacttctttagggaactctttccttccacctccttcatctgaagtcattttcctttgttagctgcctttttgccttccttgcatttatttcattttgtaattacacaattctaagtgtggttgtttgataaattctctttccctttttagactgtcagctcattgcctgatccagagtaggctatcagtaaataccacttggtggacaatctccagtctgttggactctgagggtgatttagattcagcacctaccttctaaactcactcatcaaaagagctctccaaatgtagtccctactccagtgttaagggaataatatcttaatacacagcttcttttctttctttcttttctcgttcattcattcattcattccttttttttttttttgagacagggttttgctctgctgctgaggttggagtgcagtggtgcgatcacagctcactgcagcttgacctcctgggactcaagccttcctcccacctcagcctcccaagtaggtgggacaacaggaacatgccaccacgcccagctaattttttgtagagatggggtctcactgttgcacaggctggtctggaactcctgggctcaagtgatcctcttgcctcattttccccaaacactgggattacaggcctgagccactgcacctggcctagcttcttttcttaaaaaaaaaaaagatgttagtcattgaaagaaataatcaaataatcatagccattgggaaacttattttcctaataaattttataaaatggtatgccatacatactataggtgaaatctcttataagtgacgtatgtcctcatatggcctagtttagaaaatatggtgtggtggtcagggtggagaagaccctccgactattgaatgagtctgaacaggatgtggttctctaataagagattcagttaaacttcttatgctttttccccagagtacatatctaccattttcttggttgtgctatgattggcaaacagtagctattactaagagctccgaaggttttgtttggcattttgtggactgaatcacactggtcatgacgcttgttggaaagttatgagctttaagaagacttttgcattcatgactatatcaaacagtagttgctggtagtggagtagtctctggcagtcttaaatagattttatcgctgagcctcctgaggccatttaaatactccaggaaatcctcctttatgtgacctcttttgtattccttcaaaaatgaatggctttcttctgtgtctttcacaaagaccacaggccttggaaactccatagaggtggtgtagatatccaacctcagtaataattcttgaaggaagcaggcatatggcatgagtcagatggaaacaggaccagagggttcagtctgcagcccacaggccaaacccaccaaatctgctctgcaggtgtgtttatttgattcatatgtgtttcttttttaaacatttaaatcagttgccaacctgcaaaaactgggaatttacacttcaaaaagtctggatatatgacttgtcttgaaaaactggaatgatttggaattggaaattccaaaattggagtggtttggccaggctggaaatccttatttctgtatctgcaaccaccagtggagctgagacctgttcccttccagatgggcaggggctgtccatgtgtgacactgccatctctcgtctcacatgttcatttcagttgccttcatgattcatggatatgagattatgagattgagaatatgatggttatgaggttatgagactgagtataaaaggcatagtgaatagttacaaaggagacagccttttacatttatatcacatgatctgtttgataaataaatgagacactttaatcaacagacaagaaatgagctgatcatctttgtgatctggacaaagaaaaataacgaaaactgtccctcgttacacaggatgtagcattgttcttctctgataattctttgttgagtctattgattctgggcagaggtcaaataccatttgagtcgggtggaaggaaaatctttttttgtttttttgtttttagaggcagtctctctctctctattggctgggctggggtgcagtggtgcaattatagctcactgaaacctcaaattcctgggctcaagtgatcctcctgcctcagcctctcaagtagataggactacaggtcatgacaccctgcctgacaaattaaaaaaaattttttttctttttgtagagatagggtcttgctgtctctatctggtcaggctggtctggaacttctggcctcaagcaatcctcctgccttggcctccaaaagggctaggagtatagatgtgagccaacacactctgccataggccaattcttaaatgacaaacctcatcaccatcctggaggagcacatcatttgttcccgaactttctcctgcttccctttgaactttgagaatgagaaccaaatggtctgaacataacacttctctgcgtagcatgtttgacatatttggaatacaaagaatgcttctgcctttaatctggctttgtgcagctgcacggaaaagatcgtttaacactcttctttatattttgtattttgggggaattctaccaggaaacttacgatcatctttcggaagtcccggtcacgcgggagcagttaaaccactatcggaatgtggctcaaaatgctcgaagtgaacttgcagcaactttggtcaaatttgaatgtgctcagtctgaggtaagataatgcatttccagcactcagaaatgggccttcttagcttcttataaaatgaaacagatcacgcctgtaatcccagcactttgggaggctgaggcaggcagatcacgaggtcaagagatccagaccatcctggccaacgtagtgaaactctgtctctactaaaaatataaaaattagctgggtgtggtagtgagcgcctgtagtaccagctgctcgagaggctgaggcaggagaatcacttgaatccgggaggtggaggttgcagtgaggcgagatcacagtactgcactccagcctggtgacagagtgagactccatctcaaaaaaaaaaaaaaaaaaaaaaaaagaaaaagaaaaagagacagaatgtaggagtgattagaaataggacagtgggatatagatttaaggcttttggcaaagttgaaacttgttctcttgtgcctatcccctagaattcctgaaaagttatgcatttgccagattgtaaagctaggtggcttgggctgaattctggatctcagaggagctatacagccttgagagatctgggggcgcctgaagatgttaagtaaagctccatgggcctcagagaaatttagcatctctcagaatatcttcctttaatgtgggttgcttgcaatctggagttcttaagagggaattctgaatccctttcctgtggtagttccaactggctggggaaattctaggaagaagagtgggatccatctaccctgtaggctagctcgggtttagagtggagtttctgagagtcttcctaaactcattctgcttatagcctggtggccccaaggagttctagactggcctgtgatttctcactaaggctgccaggaccccatagaacgatgagttgataatgtgtgtgtgaataaatgtatgtatgcacactcacagttccaaagaagtagatgctttcataactttttctcatagggtagatctgacattttaactcaatagggcacatatattgttcagcatttcgatatcacagaactcataaaagttaaaatgttctctttatataaatcctataagggtttttcttttctcctatgttttttttcccagaaatttaaatgttatttttatttatcactcacagttagaatccaggagataagtgtgagaaatatagtgatatactgagtagtctgtatttaagtgaggaacagttatggctgtgaaatcacagatcatatggtttgtaggttccttgtctgactgtttatcagcagcaataatagcaatacagatttagaaaatgtggaccattgcaaaatattttattgcttatgcaatcaacatcataaatgtctcctgaatgagactaaacaacataagacattgctcaattggttttggaaaagatagaatataaagtccattatttaggcataatttctcatttggtaatacagatacaaatattagaaaaaaaataaagttagattaagtcatgaataaaagagtgaacatttaaatgatggctttgggtttcttaaagataattcaaacttatgttgttaaggttttttttttttttaacttcttttccatgttagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacagtaaggatactgcaatatatttttcgctttagctagcattaaaatactagcttctgatagcaagatatgtctttgaaagtactggcattttgcattacttggcccttaaactcaatttgaaaaaaagttattgacctcaaatatctttggagtcttgacaaatttttccaaggctcatttctaaatgtcatcaagagtcttaacaaatacagccttgtcttaagcatgtttatagcctatcaattagggctgcaaatgcttatttacacaatttcgaagatttctctaagtagagtttaaccctgagcttgtggggtagtacacagaggtaggtatttatttagtagccagttataaaaatatcccagaagctagaccactccagatcacactgaacattcctcattagattttattgctagtttatgcagagaactcatgaaacctaggttttccacacttcattctgacaagaggtgattattgagacaaaattgggaatgagttgttcctaaaatatattttaaaattctacgaatgagttaaatatctttagtaacaaaatacatggtatttattttacttatttcatcttaaaaaaataacccaatacttccagcccctgtcctctttctctacttccacttacagcaaaaactccttaaacattgtatgtatggccgggcatggcggctcacacctgtaatcccagcacttttggaggctgaggtgggcagatcacttgaggtcaggagtttgagaccagcctggccaacatggtgaaaccccgtctctactaaatacaaaaattagctgggcgtggtgccaggtgcctttaatcccagctactcgagaggctgagataagagaattgcttgaacctggacaggtggaggctgcagtgagctgagatcacaccactgtactccagcctgggcaacaaagagagactctgtctcaaaaaaaaaaaaatgttgtatgtattcatggtctccaatttctcttctctctctggaatctgctccactgaaaccactcattaaggtcatcagtgagtgcacagtgcaagttaaatggtcagtcttatcttacctgacctatcagtagcatcagttacagttgatctttttctttgaaccgttttcttcttctcttggcttccaggactttacacatgcctaggttttttctttttctaatcttaccttgctagctagtgtctttcactgtttctcctcatctctttggctttcaaatactggagtacctcagggatcagcccctgaatctcttctcatttgtgtctaaatttactctcttggtgatatcatttagtttcatggctttaagaatctaaatgctggtgactcccacatttctgtgtctagcctggatctcttcccagagctcaagaaccacatatcttactagctactgtatatctccatgtggatctctgacaggcatctcaaacttaatgtgtccaaaacggagctcccagtgttcccacaaaatccttctgtacttttcctcatctcatgtgatcataattccattcttctagttgatcatttcaaaattcttgctatcaaacttggttctctttctctttcaccctccatgtctgattcttcagcaaatcccatcatatctatcttcaaaacaaatctaaattgtgtcagttttccattatcacctttattgtcactaacttggtccaagccaccattaactctcacctggagtattgtaatatgtatctgtaacagcagcatcccactcctggtactaatttctgtcttagttggtttgggctgctataagaaaaataccatatactgggtggcttaaatgacagaaatttattccttgtagttgtggaggctgggaaggccaagatcaagatgttggcctattcagttcctggtgagggtcctctttctggtttgtagatgaatgccttcttgctgtatcctcacacggcagagaaagagatcacctctccatgtttctcctcctcctcctcctcttccttcctcttcctcctcctcctcctccttcttctgctgctgccttttttttttttttttttttttttttttgtgacagagtgttgctctgttgcccaggctggaatgcagtgggtgtgatcttggctcactgcaacctccgcctcctgggttcaagcaattcttgtgactcagcctcccaagtagctgggattataggtgtgcatcaccatgcccagttaatattttgtatttttagtagagatggagtttcaccatgttggccagggtggtctcagactcctggcttcaagtgatctgtctgcctcagcctcccaaagggctgggattatagggataagccaccacacccagccagtgtcccttcttataagggcactaatctcattcacgaggtctcctctcttatgacctaattacctcccaaaggcccaacctccaaatattataccatcatattgggaattaggacttcaacatatgaattctcagaggacagaaatatttggttcataggagtggttttcctgcctctgactgtgccccctgcagccagaatgatcctgttaaaacacaaattagatcatgtcaattcttagcacagagtcctccagtgacttctgttctcattcagggtaaagacagtgttttctatgagccaaaaggctcatcctgacctggttttgctaccattctcccccttattctttctattccagatctctggcttctttgctgtcccttgaacctgacagacctgattgtacctcaggacctttgcaattgttaatttcttttcctggaaggctcttcccccagatatcacatggctgcctccatttcctttaagtcttcattcagatggcactttccaagtgagatgttccatgaataacatatctaaaaatttactcctctaatatctcttgcccctctttccttcctgcttaattttttctctctagtcctattatgatgtactatacattttacacatattaatattttgattattgtccatctttccaaatagaacataagctccatgaggtcaataatttgtttttcagagatggggatctcactatcttgtccaggctggcctaaaattcctgggttcaagtgatcctctcacctcagcctccctagtagctgggactacaggtgcacaccactgcgcctggctggatttgtatctcttttgtttactgttgtatctttagcacctttaatggggcttggtgtatgatgggtactcaataagtatttattaaataaatgagtaataaaaacactatatgcatattgtaaaaaatattttttatacagaaaagtgccaagaagaaattaataattacttaaaacctcatgattatagaaaagctataattaatattaatattttattgaacagatttttcagaaaatcatatacaaatgactttaggtagtgtactatttttactgaatcatatgttctaaatatatatatgtatatatataaatataagtatatataaaaaatataaatataaatatatatatatatatatatatttttttttttaagacagagtcttgctttgtcacccaggctggagtgcagtgacatgaccttggctcactgcagcctccacctcttaggttcaagcagttctcatgcctcagcctcttgagtagctgggattacaggcatgtgccaccacacccagctaatttttgtagttttagtagagacggggttttgccatgttggccagactggtctcgagctcctgacctcaagtgatctgcctgccttggtgtcccaaagtgttaggattatagaagtgagccactgtacctggccatatgttataaatattttaaaaactcatttagtatataattttatttatttacttatttaagacaggttttcactctgccacccaggctggagtgcagtggcacaattatggctcactgcagctttgacctcctaggctcaagcaatcctcccaccttagcctcttttgtagctgagaccacaggtgcatgccactacacccagctgatttttaaatttttttgtagagatggcgtcttgccatgttgcccaggttggtcttgaatccctggcctcaagcaatcctcccaccttggccttccaaagagctgggattacaggcgtgagccactgtgccaagcctagtacataattttaaatggcccattgtattccattgcttgaaataccataatgtactcaatcactttggctatttctacaggctcttaggttagttccactaaaaaaattactataaaccaagttgcagtgaatatctatgtgattcatatttttaaatttctgtgattattttcttagggtagattcctgaaactttgttgggtcaagtgaattgcaaatagaaatggaagtagtttagagacctttggaatggagaagaaagattgaaatcttggggttaatgtatggaatcctatatgtatatcaatcagcaccatacaattaattatgcctttcctgggtccaaaagactgaagagttttacctttcatatgctaaaataagaactcagaaatatagtgaagttagtcttttatcgttacacatttttctaaatagaaatctgatatgctttgagtatctgcaattacatgctttgttaatctttgaatagcgtgaaggaatttgcagtaaacactcaacatggtaaaaaggaaaagcaataatcatgtttattatcttggatatttaaaaaatgacactaaattactgaaatgattctaatttgcctttaaagtatgcctatttttgacaatctcttagttgctaacatttaaagcattagaaataggccatactatttcaacaaacctatctgagatttgaaacaatatattcataatggaccataaatttcctttttccttgactggccaattctagtactttcctaatgctctttttttccttttatttttagttgacttataataattgtacatatttatgggatatggagtgatattttgatacatgtatacaatgtataatgatcaaatcagggaaattagtaaatccatcatcttgaatatttatctttttttgtgtgtgaacattcaaaatcctctctgctagctatttggaaactaaattcttgttaactgtattcaccctactgtgctacagaacactagaacttacccctgccatctagctttataactttataactatctttataagtttatagccattgactcacctccctgtatcctccttcatccgctaccctttccagcctctaataatcaaaattctactctgcttctacgagttcaattttttgtagcttccacatatgagtgaaaacatgaggtaattatctttctgtacttgacttattttgcttaacataatatcctccaggttcatccatattgccactcctgacaggatttcactcttttaaaaggctgagtagtattccgatgtgtatatatcatattttttttcccattcactcactgatgggcacttatgttgattccctatctttgctattatgaatagaactgcagtaaacatgggggttcagacatctcttcgatatactgattttctttcctttcttccaatacactttaaagactgagggagtgtgaaaactaataatgaactttgctggtgattgaacacatctcctttccagaggcaagaaccttctgtgcttttgatgtatttgatattatagttatgcctggccatgaaccaggacccttataaatcactgtattgtaaagtttgaaaataaaatgaagcttggttctctagaaccaatgtggtagcactctccttccccatgaggccccaatgaagacccatggctatgtggattgtgtgtgctctagacacgtgcctccatttttagagatcctaaagggttgaggctaggggaattcatttcccctcctgttactaagtccacaatgccttgaagatttccttatatttctgcaaagcacaggtgtcccaaaattgctgccacttttctccttcctttatagggctttatagggcttctgtgacaataatttgctctgtgtctgggaaactgtgttgtgttgaaaatgacaattatttcccccatagagcttatattctgacttggtttgatgaatgttatcttccatggtgttaaattctgacttatttgttatttgcctaacagaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaaggtgtctgtatgcagattaaaaagtctataaatgtagtggtgattctgacatgtggcatgaaaggaagtgctgtggttgagtttgggggtggcaggagaatggcacagtagaccaagtgtagtattaattaactgtatgacttgggacaagtcacgtcacctgcctgagcctcaattccaagatcttttctagcattattggaattaattattctccaaaagagattaatggctttgtctaaaatatatttaggttgtcatatagagttaattactcattgtaaccatttgctttagggagtttttttccttttagttacagccagacatatactcacacaagcagctgcatgtcatttttaggatactgattgagtgtgagatctaaagtactttaaaaatttacattaaaaccaaatagtggctgggcgcggtgactcacgcctgtaatcccagcactttgggaggctcaggcgggcagatcacctgaggtcaggggtttgagaccagcctggccaacatggagaaaccccgtctctactaaaatacaaaaattagccaggcgtggtggcaggtgcctgtaatcccagctaattggaaggctgagacaggagaatcacttgaaccaggaggcggaggttgcagtgagatcaagccactgcactccacctgggccacagagtgagactctgtctcaaaaaataaacaaaacaaaacaaaatagcaaaaattctactttaatggtagattaccattaagtcagaaataaataataataactgaataattcacttggcccatagtgcttcattagggtacctgaaagtatttggttctctttggctatttacaaacctttcatatccttgcttcctgacagatttccatacagccgtttgttgttgttttttttttttgtttgtttgttttaaatttagagacaagatcttgctctgtcatccaggctggagtacagtgatatgatcctagtttactgtggccttgacttcttgggctcaagtgatcctcctgcctcagcctcctaagtaattgagactacaggcatgcaccaccatgtctggctaattattttatttatgtagagatgaggtcttcctatgttgtccaggctggtcttgaactccttgcctcaagcaattaccccacctctgcctcctgaagtgctgtgagtacagttgtgggccaccatgcccagcacccatgcatcattttttttttttaaatggagatgaggtctcactatattgcccgggctagtctctaactcctgggctcaagcggttctcccaccttggccttccaaagtgctgggattacaggcgtgagccatcacgtctggcctatcatgcagccatttttgaaaaccacctctcaggtgtctactagtgagcttcccaaatgtcctctctgaaagccgcaagatgacttcattcgactttgggaagtattccacttcacggatgggttttgatagctgggaccatgggtccacctgatgctctcatgggtgctggatgcctctcctcctccctatggctaacttgtgaccaggaactcagctgtaaaagtccacttgtagtttgagaattatctttcaaaccaaatgatggggacaagaaaagggaattcagaagctgcttcttccgtgacacacttttctctatcggacacaatctccaggtgctaatcagggtgtttctactacatttatcatgtccttgtcttttctgtatttctaatgctttgacttccggggtcttgctgagccgggagagcctgcccttcccagcagagctttcacgtgtgaactgaccaatccagagcccactccccagccacctcctacaactggctgttacctgcagattactgccccttgccctaagccccccagacagctcgggtcagcccctacaccccaagagccactgaaatcattcaatagccaaccctaagtctgcttactctgctttgcttattccttcctgtggaggcgacaataaagcctctcgcccgcttttctccccacttcttctgcctcctgactggccctggtgcttccccattgccctgtgtagtgtggtgggttcctgccacttgggaacaatgaataagaaaccatctttttgatggcaatttcctcctgggatttgttggcctcagcttacctgaacagtaatggaatctatatttcacgacacagggtaggaatctggagctttggcatctcggccacgtgagcaggtgcctgtcttaagaagaaaaaaaaaaaaaattggcccagatcaggaagtctgctgtcttgaccaagacttcagcctcattaggtgttcctccaagaacaaaatggctctggtttcaaaactgttccttcgctttcacacgccctcataaacacgtgtgcacacgcattcgcaaggaaccatgcattcctaacaattagacattcattccttcatttcacaaatatttagtgagtgcttactatatgctagacactgttctgagtgctggagagatagcagtgaatgagacaagactatgtctatgctcgcctagagatttcattttcaaagggtaaggatagtgaagaaataaccaaataaatatctacgattgctccacatggtgaaaggtgcaatacagaaaaacaaatcaggatgcagggatagagagggaagcaagtcacaggtgttggacactgtctgaagagcgcccccgtgaggtcgggagttttgagggccattgaggagagagatcatgcaaatgtgaggaagagtgttggagagagagggaacagcatgagttgggagtggggcaccatgttttcagagcattgaggctcaaaggtatatcacttccacggagagtctcaacacaaatgctggccctgtcctgaggggtctcaagtcaccctacaggcctccccctggccctacagagtgaaattgtctgtatggctcgttccctgaggtcaaggagcctgctggcttttattttccccttgtaaatcttataaatgctcccagttaaccattccaatgcacaacatagtgagcaaaagccctgctaatctcaattccctatgataaacactgagctgttattcagaattttcctatgcttatattacatagaagaatatttttttaaaaagcatggccgtgtgttctctgtatttcctccagtgccacatggtgacttgactgcagaaggtctgagtggacatgggctgaaggcaagtcccttgcttcatcgcctactgtagcctctgtagagcttcaccttacctgatgtatttagcaggtttgctgatgtgtgttccgtcgggacacttttggcttcattatccttgccttgtggccaccttttggataatttgaatttgacccccaggtctaaaacagagtttacaggctgcctttgaaaatgtgacctttccagtccatgtagggatagtgctcttacatttttcatatgataatgcagtctatagatgtgacttgcttagagaaaatgatgaaattgttaatttttataggacagctgtaattgctttctcttcagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggtatgatatgtgaagtatacgtgtgcatctgggaccatgttgaagaagcagaaatggaagagatggatgtcagataagtgccctagaactactgattacgattttttttattgatcacaattttaagagcctgcactcagcaggagggttgggggtgacatgggacaaagtgacttgaacaggccattggctatatatgtacatttaaaaattttttaatttaaattttaattaattaattaatttttgagaaggagtctcactctgtcacccagactggagtgcagtggcacgatcctgactcactgcaacttccgcctccctggttcaagcaattctcctgcctcagccacccaagtagctgggactacaggcacccaccaccatgcccagctagtttttttgtttgtttgtttgttttttttgttttggacggagtctcactctgtcacccatgctggagtgcagtggtgctatcttggcttgctgaagctccgccaccctggttcacaccattctctcacctcagcctcccgagtagctgggactacaggggcccaccaccacacccggctaattttgtttttttgtatttttagtagagatggggtttcaccgtgttagtcaggatggtctcaatctcctgacctcgtgatctgcccgcctcagcctcccagagtggtagaattacaggcgtgagccaccacggccggtctaatttttgtttaatagagacagggtttcaccatgttagccaggctggtctcgactcctggcctcaagtgatctgcccaccttgacctcccaaagtgctggaattacaggtgtgagccactgtgcctggccacatttttttaaataatggaaaaaaggaatacaaaacacttaaaattaaagaatttgtagagaagatgtcttactttagttaaattataggatcttaaaaagtttaaatttaatatatttgaacaaataggtaatatatttacaagaaacaaaattctaaatgtacaggagtatatggtgaaacatgttccccatacccctctccccagccacccagttctcttcagaggcaacctttctgttaacaatttctttctttaaaaaatttatttgtagagacggggtctcactatgttgcccaggctggtcctaaactcctggcctcaagtgatcctcccacttgggacttccaaaatgctgggattacaggcatgagccattgagccctgccccagtgatttcttatatactcttctggaaatattttacacacatatatacatattcttttaatttctttttaacacaaatgttgacacactctgcacactatatgtttctctttttatttattttttaacacaagtggcaatatactatacattattgtcaatacagctattatgagtaatcttatatcattcttcatgtgggaggatatatcagtaagacaaaatccaagaagtagactcgctgggccaaaggacatggaccttgtaattctgacagatattgccaaagggaagtgactgaattgtaaacttttatttacacaatgaattggctgatcttttcaaatggtctgcaacctatttgagctatttaataccatatgtattttttaacattgtataatcccttaactataattttgtgataaagaaatttattatgggattaataataatgatccatttccaaaagcaaaaacgagcttatacaatcagttaataaaagtacataggaaaaaagtgaatggcagtggcccagcagatggaatttaagatcagctaaggactgatgctgataaagggagcctccttgtgggtgaagggctagtggtggcccacaggctgaggaggggcctggggaattggtgggtgcaggagaaggagttgccttttcaggaatttcttttgggccttttctgtctagtgacagccacactgaggtgagaagggaagttggaaagcacagtcatgatgataatttctattttcaattaattccctgcatcaaaaggcccttcgcaccactagctttattctcctgacacattaactctgtggaaagtgcaaagtttattattgttgtcaatgccctcattgtcagcttgggctgccataatacagtaccatagactgggtggtttaaacaacataaatgtatttctcacaaatctggaggccgggaaatccaagatcagaaccaacatggtcaggttctggtgagggccctcatcctgcatgtagatggctgccttctccctgtgtcctcacatgtcacagagagagcaagcaagctaagtgctatgatgtctttccttctaagggcactaatcccatcgtgaggtccccaccctcaaaacttcatctgaacctaatcatctcccaaaggccccacccacaaataccatcacattgggggttaggacttcaaagtatgaattttggggaagatacaaatcagtccatagtattaggttggtgcaaaagtaattgcggtttttgcaattacttttaatggcatcaacctaataacttaccattatttttcaccaacattgtcttttaaaaaatttcaaatatatagaaagagtgaaggaatatgacaatgatcacccacccaccatccacccagatgcaacaatggttagcattttgttttatttgctttattattttacataatatgtatttgttattgtttatttattgttacataaacatagatatatttgcagaatcacttgaaaataagttgcagacttcataagtattgcctctaactatgtcagcatatttatcctgagaataaggacattgccctatgtaaccacaataccactgctgcatctgaaagttaactataatgccggataccatctgtggtggttttcaagcacatacatttttttatatgcttcctcttgagcacggtctggacttagtgattcccttctagtgaatagaatatgtcagaaatgatggatatcacttttgatattaggttataaaaaggctgtggcttctgtcttaaatacactctattgatctctctggagtcacttgctcttgagggaagccaggggccatggtgtgaggtaggtctagggagagggaagtcagctaccatgtggtgaagacacttagcctcctctcgggaggcccacgtggtaaggacctgaggcctgtcagctaccatgtgagtgagcccagcagggaatcgtcccctggtcaatcctggggaggactgcagccctgctcaacaggttggccctaaccttaggagagcccctgagccagaaccaccaccagcaaagtcgtgctgagattcctgacccatagaaactgtgagataatcagtgtttgttgttttaagccaccaagtttggcttagctaataataatctagtatcatttcacattcacatttcaccccttgctacaagaatgtcttttacagcagttttcttccccaaatttggaacctacctaggttaattcactgcatttgttgattagtgtcaggttttttttttttttttggttgttgttgttttaaatagcattgacatgttggagagtccagagcagtggcctgattttttcttcactgtgtggtttaacttgtttctctatatcctgtaaacttaaaagttggatctagaggctggattggattcaggttaaggcttttggcaagaatattatgtattatatttcatattgcattctattagaaggcaaataatgttagagtgttccactgctggtgacgataagtttgactacgaatctctttggcgtaagggtacattttttctcttctgcagttaagtttctatggggtgatcattatcaggttattcctgttccctctgactttacctagtgatgttagcatacgccgattcttgtctggattaactattacatcatgggtggcaaagtggtgatattctaatttcgtcattcctcccatctattaggcagtagtcttctctaaagaaaagctttctttattttctttccttttgttttcaattctatggacacatgggtttttatttatttactgtgttataatcaattattctctttcagtgctccaaattctccaaatttgtccggcagaagctccttcaggatgtaccctgtgaccttgtagcatgagtcctttagtctctcaagtcttcctcgatctctggctgaagaagtcatcacaggctttcttgcaatattcaggccactgaactaaaaccagccaaatcagccaattcttttttttttttttttttttttttttttgagacagagtctttctgtctccaggctggagtccagtggcatgatctcagctcactgcaacctctgccttccaggttcaagtgattctcctgcctcagcctccctagtagctgggattacaggcacgtgccactatgcttggctaattttttgtatttttagtagagagaggtttcaccatgttggccaggctggtctcgaactcctgacttcaagtgatccacccacatcggcctcccaaagtgctgggattacaggcatgagccactgcgcctggcctaccagccaattctttaaagagctttggttcctaagactggtgaatggtgcttagaaaccaaaattgatgatttataaatgctcatttattgaatacttaccattagcccagtcattgtgctaatgatcagagaggttattcactttgctcaagttcacacagctattaaatggcaaagctaggatttgaacccatatcattacattattgtaccttcagcaataatcctctttccatatatattcacagttacatcctacatacaagtctgatgccagaaactatttattagtcagtggaacaacaataataaatagccatacaaatgtcctcagtgagtaattttaattcaattataactagtagttattaaattatcaagatttgaatattagggggagaggaggggttaaaaaagacttgactattaggaagaatttaatatttatttataaaaatgcatctctagagatcagtagtaggaaacgagtaaggaaatgtgttgtaatagcacattcaaaaaccagaacttattcctcttcttatataagtgtcttcacttgtaatgactgatgcaatgttgttcagactttggaaacacattcactttgggatgaagttcctgccaaaatcataaaaattgtaaaaaaaaaaattatatgggcaataaaaaaacttgaggtctttaataaagtactttattcataggattgtgcctcccgaagatttactacttaaaaataccatcaggtggttttactgacacattaacagactcaggaagagtcttcataatgctttctaaagctctgtttttgaggtaggaaacttactttattagtgaagtccagaaggacggcagaagtagaagtagccacaggactagggtgtggtttctatataactcagcccttttctgatctgcttgaagactctacttcagttccttcaagaaaatttcgcaaataaaaatccaagtgatttgtcatatatatgataaatatattacttaaaaatattttagtagttcatattgaagtatgtcttaaaaactaccaaaagttggtacttggtactttttcccttggttttcttgaaataacctactgaggaataacctatttgaggaaagtagtcattttgcctgggcaagccacacacccatttcctatgaattacagaagttaaaatcaatgagatcagaaactaaacttccatgttgcatttaattctactagcaagaattaaagctaggaaataaagtggtgttagagtcaggcaggcctggatttgcaatgatgtcagttctgccttttttgttagcttacagtggagtatgtaagagagacactgcacaggccaggtgcagtggctcaagcttgtaatcctagcactttgggaggccaaggcaagcggataacttgaggtcaggagtttgagaccagcctgaccaacacggcaaaaccccatctctactaaaaatacaaaaattagccaagcgtgtggtgggcacctgtaatcccagctactcgggaggctgaggtagaagaatcgcttgaacctgggaggcagaggttgcagtgagctgagatggcaccactgcactccagtctgggcgacaaagctggactctgtctcaaaaaaaagagagagcaagacagagagacactgcgcagagcggttaagaagctaggctctttaattaggctgcttgggtttttatcctggctccagaatcattcggctatgtgattgcaggcacgtagcttgatctttttggacctcagttttttttttttttttttttttgtgagacagagtctcgctctattgcccaggctggagtgcagtggtgtgacctcggctcactgtaacctctgcctcctgggttcaaatgattctcctgcctcagcctcccgagtagctgggactacaggcacctactaccacgcccagctaatttttgtattgttagtagagatggggtttcaattcactatgttggccaggctggtctcgaactcctgacctcgtggtccacctgcctcggcctcccaaagtgctgggattacagatgtgagccaccgtgcccagcctggacctcagtttttaaaatctgtaaaatgggaaaataaggctctcttactattacgttagaattaaatggtaaaatatacataaaatacttaggacgtgtctggcacacaattggtgttcagtgttttcatttccttttcctagttatttacttttacctggggataagataaacatgagattaatttatagtcatatggaaatagttcctggaagtaagaaatgactagatgagatagactactgaagaaatgacagacctctttacaattctagaatcataaagttggaagtgaccttcaggccatttagaatctagatcatctaactctctatgtgaaataagaatcatgttttaaaacaatttccctgactagctaatgttcaacctttcctttaactcttctagaaatggggaactcactactgtataaggaggtccgtctcatctttgtgaactgtttgacagttccgtattgtagcaagtcaggattagagtctctataattcaactcctcatcctgttactcacttgtgaaatttcactgaataaatgaaaatccgttttcttatggccacccttcaaatggttaaggacatttattatggatttctaagtctcttcttctggctaaacagccttagatctttcaaacttttcttacttgaaccctccttcttattgcctgtgaggctgggggagttctagtctgtgggtgaggaattaaaatgaaaacaaacaccaaataatatctgcccatattatacaaaattaaagctggattggggatggtggcgtatgcctgtaatgtcaacactttgggaggctgaggctggcagatcacttgaggccaggagttcaaggccaacctgggcaacatagtgagatctccatctctataataaaaagaaaagctgtttataagactcctacaaaatgacttattctcttttttagttcttttgaaaattaccattaagactttaaagtggccagctgtggtggctcacgcctgtaatcccagcattttgggaggctgaggcaggcagatcacttgagggcagaagttcaagaccagcctggtcaacatggtgaaaccccatctctaccaaaagcacaaaaattagctgggcatggtagtgcatgcctgtaatcccagctattgggaggctgaggcatgacagtcacttgaacctgggaggtggagtttgcagtgagctgagattgagccactgcactctagcctgggcgacaaagcgagaccctgtctcaaaacaaaatcaaacaaacaaacaaaaaactaaaactttaaagtaatacaattttattcctgattcatcaatttgaggcagtatttggcaaagactttctgctatgaaatatgaagaatttcatgcctcctactttttttatttattattgctacacgatacttgtatgtatttaacgggtacgtgtgctattttattacacgcatagaatgtgtaaggatgaagtcaaggtatttaaggtcttcatcacctcaactatttatcatttctgtgtgttgggaacatttcaagccctctcttctagctatttcaaaatatacaatacattgttaactatagtcaccctactcgctgacaaacattaaagcttatttcttctatctactgtatgcttgtatccattaaccaatctctcttcatccctcctcccacccacttacccttcccagcctctggaatctatttttctactctctaactatatgagtcaactcttttagttcctgcatatgagtgagaacatgtgatatttgtctttctaggcctgacttatttcactcaacataatgacctctcattccatccatgttcctgcaaattacatgatttcattttttaatggtttaatagtattccattgtgtatatataccacattaaaaaaatctattcaggcctggcgcagaggctcacacctgtaatcccagcactttgggaggccaaggcgggtggatcatgacgtaaggagaccgagaccatcctggctaacacggtggaaccccgtctctactaaaaaatacaaaaagttagccgggtgtggtggtgcacgcctgtagtcccagctactcaggaggctgaggcaggagaatggcatgaacccaggaggcggaggttgcagtgagccgagatcacgccactgcactgcagcttgggtgacagagcgagattctgtctcaaaaaaaaaaaaaaaaatccattcatccgttggtggacacttcggttgattccgtatatttgctattgtgactagtgctgcagtaaacatgagtgtgcaggaatctctttgttatgctcatgtcctttcctttggataaatactcagtagtgggattgctggatgtgtggtatttacatttttagtttttttaagaaatctccatactgtgttccatagtggccatacaaatttacattcccaccaacagtgttaacaaaagttatctcttctctgtatccttgcgagcatctgttatgtttgtttatttgtttttgtctttttaataatagccattctaactggggttagatgatacctcattgtggttttgatctgcatttccctgatgatcagtgatgttgagcattttaaaaacttaaccttttgggacaaatcccagcactttgggaggccaaggtgagtggatcacctgaggtcaggagtttgagaccagcctggccaacatggccaaactccatctctgctgaaaacacaaaaaatcagctggacgtggtgatacacacttgtaatcccagctactcgggaggctgaggcaggagaatcgcttgagcttgggaggtggaggttgcactgagccgagattgcgccactgcactccaacctggtgacagatcgagactctatcttaaataaataaataaataaataaacctttggccatttgtatgtctttcgtgaacttctattcatgtcctattcatgtctattcatgttctattcatgtctattcatgtcctcacccactttttattgagattagtgtttttttttttttttttttttttaatgttgacttgcttgagttcctgtatgtattctggatattagtcccttgttggataaatagtttgcaaatattttctcccattcagcaggttgtttcttcaccctgttgattgttccttgtgctgtgtagaggctttttagtttaatatagtcccatttgcctacttttgtttttgttgcctgtgctgttgagatcttagccctaaaatattttcctagccaatgtcttgaagtgtttcttctacattttattctagtagttttatagttttaggtttaagtcattaatccatcttgaattgatttttgtgtatgatgagaaagatagtgacctagtttcattcttctgcatatggatgtctagttttcccaacaccatttattgaagaggctctcttttaccgcaatgtatatgcttggcaccattgttgaaaatcagatggctataattatgtggatttatttctggtttctttattctgttccatttagtctgtgtgtctatttcataccaataccctgctgttttgtttattatagccttgaagtatattttgaagtcagttagtatgatgccttcagctttgttctttttgctcaggattgctttggctacttaaggtcttttgtggatcaatagaaattttatgatttttttccatttctatgaaaaataatattaatgtttcgacagggattacagttaatctgtagactgctttgggtaatgtggtcatttaacaacattaatttatctttttttttttttttttcgagacagaatcttgctctgtctcccaggctggagtgcagtggtgtgatcttggctcactgcaacttccacctcccaggttcaaatgattctcgtgcccagcttcctgagtagctgggacaacaggcacatgccaccatgcccggctaatttttgtatttttagtagagataggattttgccatgttggccaggctggtcttgaactcctggcctcaagtgatccacctgccctgacctcccaaagtgctgagattacaggcataagccactgtgcccagccaacaacattaattattctgatccatgagcatgagatgtcttttcatttgtttgtgtcctctttaatttctttcatcagtgttttgtagttttccttgtagaagtctttcccttccttggttaaatttataaattattttatgtttttgttggtattgcaaatgggattaccttcttgatttctttttcaggtagttcattgttagtgtatagaaacactactgatttttgtatgtttattttgtattctgctactttactgaatttatttataagctttaagagtttttttggtgtcttttggctttcctaaatataagatcatgttgtctgcaaagagggacaatttaactttctcttttccaatttggatgtcatttatttctttctcttgtctgatttctctggctaggattttcggatacatagaaatgttcatagtcatctctgaggatcttttgtatttctgtggtatcagttgtaatgtcacctttgtcatttctgattgtgcttctttggttcttctttttttcttagttaacttggctagtggtctgtcaatttggtttatcctttcaaaaaagaaactttttatgttgctcatccttttatatttttttggctctgaattttatttagttctgttctgatcttagttatttcttctattggccttgggttgagtttgttcttgtttttgtagttccattaggtgtgatgttaggttgttaatttgagatctttctatgtttttgatgtatgcatttagcaatatattttcacatttagcactatattttcctcttaacactacttttgctgtatcccagaggttttgatatgttgtatctttattttaattccattcaatgaatttttaaatcctgctttaatctcattgtttactcaaaagtcattaagaagcaggttgtttagtttccatgtgcttgtgtggttttgggagtttttcttggtgttgatttctaattttattccactgtggtcagagaagatgcttgatatgatttagtttctttttaaatttattgagacttgctttatgactgaggcatgtgttcaattttagagaatgttctatttgcagatgagaaaaatgtacattctgtggttgtggggtgcagtattctatagatgtctgtgaggtccatcttgttgaaagtccggtttaagtccagaccttctttgttagttttctgacttaatgatctgcctattgctgtcaatgtggtgtcaaagtttcccatgattattgtatggctatctcttttcttatatctattaatagtagtattttataaatctgggtgctctgaatctgtgtgcatatatatttaggaggatagctaaatcttgttgaattgagccctttatcatcatgtagttcttttctttttcttcttactgttgtaggtttaaattctgttttatctgatacaagaatagcaacttttgctcttttctgttttccatttgtgtgatggatatttctccatccctttactttaagcctgtgtgtgttattacatgcaagatgggtctctagaggaaagagaatgtagggtcttgctttttaatccaatttaccactctacttcttttaagtggagcatttaggccatttatggtcaaagttactgttgatgtgtgaggttttgtttctgtcatagtgttgttaactagttgctttgtagtctttttttaaagtaaaaattattttaatttttatctagtaaatttttttttaaaattgtgtgggtacatagtgggtgtgtatatttatggggtacatgagatattttgatacagccatgcaatgtgtaataatcatatcatgaagaatgggtatatccatcccctcaagcatttttcctttgttacaaacaatccaattatactcttttagttatttaaaaatgtacagttaaattattattgactataatgctttgtagtcttaattgtgtaattgcttcatagggtctgtgaactttgtacttatgtgtgcttttatagtctcaagtattattctttcatttccatgtttagaactcctttgagcatttcttgtaggtctggtctggtggtgataaattctcttactgtttgcttgtctgggaaagactatatttctccattcatgaagcttagtttggtatgaaatttttggctggcaatttttttctttttaggaggctaaaaataggacctcaatctcttctggcttgtaaagtttctactgagaagtctactattaatttaataggttttcttctctaggtaatttggcccttttttctaggggcctttaaggttttttctttctaattgaccttggatagtctgatgactatatgccttgggaatggtcttcttgtatactatctcataggagttctctaaatttcttgaatctggatgtcaacctctttagcaagattagggaaaaatttctgaatttttccctcaaatctgttttccaaattgtatactactttttcatcttctctttcaggaatgccaataagttgaagatttgtgaagatttggtcaaagccatatttctcaaaaactctgttcatttttaaaattatttttaaaattttatttttgtctgacttggttaattagaaagactggttgtcaagatctaaaattctttcttctgcttagtgtaatctattattaaagctctaacattattttgaaattactttagtgatttttttcaatttgagcaattctatttgtcttttttcttaatatgggcatctaatctttcatatcctgaatcatttttctggttttttatgtaatggatttcaaatttctctcagatgttattgagtttccttgcaatccgtattttgaattctttatctgtcatttcagatattttgttccgattaagatccatcgtgagagagctagtgcaatgctttggaggtgtcaaaacactctggctttttgtactgctggagttcttgcactgagtccttctcagggaaatgttgcttcttatttttgaatttgctattgtttgaatgggacttcttttttaaattctttttttctcttaggggtatggctgtgatatatattatgtgtgatcgtttggcttcattttgggtgatttcagagggccaaagtgctgtatatgttccttggttgtggatagcttctgtgtggtggctttctcagaccatgcttgttgaagctgtattttggctgtaagaactaattagaaagactggttgtcaggatctaaaattctttctcctgtttagatattctatcttctgtagggctgggggtgcagagtcctggggcacttattttgtggaatagcactaagctcttctggtagcagattttgtatttggtagtgcagttgaaactgcagtccagtaaatggtgcttaagagtaagagctggcaggtaggctgatgtccagtgaaagcaggtgccttgatgcgttttgggggaggagtgggtgggaagagatggtgttgaggtgtaggtgtgctgaggccttaggggaggggctggggagtgtccttgcttttcgccctgagccagcagaaaagtgatttgcttccctatcaaacccctgttgcagggctcatgactttcatttcataaagacttggtcctttggtttttggccacagtgtggctgcaggccaccagtatgcccctctgatgactaccaccaaaatgggctgaggggagagtctcttcccccagaccagagcaggtacctccatggtttgtctgtcttccttttccgggatggtgccattctgtgtagggaaggggaggtggtcccttcccttcgtaaaagcctgagcagcatggggctcactttcagcatggtagagctgctgtgaagagcacaaaaaaatgctatgtccaagtatgtgttcactggcccctagtgggaagaaccactcttgtgtccataactgcataagtggggtggagatgaccgctctctacatatcttccctggctatgggactgcctcctttagtacttggcaccttatctgtgtttcctttgtcccaacagggacttggtgggctgtgctcccctctcccttagaggtgtcccatgttgagagttaaatctccagggatgcagctgctccttggggcctacgagtcccctgcacctgccaaagtcagaatgggttgtggggtatgtttgcaagagatctagtggtacagtgactcaaggttggagagtccctgggcagggctgtttcccactatgggtgcattaccagtatggtgcccacagtctcagctcaggtgtgaggggagtgtgggcacgtctgtgtgagctggccaccaagttctctgtccctgagaagttctcagatgcccccaatagtgttgacctggatcacaagggcagaggggctcaccagcagtttaacagtcaggggatagtcagagaggtgagtggggcagagaagctctcccacctaccctttctgtggggctctgagcttctcaggggtcaatctctgccagcctcttgttgctttctttttctgcagctcagcttctttttgtgggcactctgacaggtcctggctcacttctttcagttttccattcacattttgtccattcactagtaactttgatcttctttctgaggagaactggctttcaatgtccctagtctgccatcttggagagtcctattgtgctcctttggaggcatcatatttccttgcttttgcacgtttcttgtgtctttatgttggtatctgtgcatctggtgtgacagtcacttcttccaatattttggatttgcttttataggggaggatgttttcctggagatgcatctgtgatgttggttgggtagggcactttggctctgattgtgggtgtgtgcagcagtgtagtttcctaatttgttcagctgtaaatagtgtcattggtgtccattatttcctcaagagcttagggtgtggttgttggtggagttgtgggaagttttgctggggacagggataccaggtgggccagtcctcaggccccgatgggaacagcagtgggccaagagtgcctgttcttaggccgcagggtggcatttgctggcactggtcttagcaggtctaggtgggtctatactggcagtggcagcagcaggtgggtctttcagtccctgggcagcagtgtggcatgggctatcatagtagcagttgtgggacaatgctttggctctcaagctgtctgtgctggtgttgacagtggctgtgatggctgggcaggccaggccctgcgcctgcaggttgtgtgtgcaggtgggtgccatctgtggtggtagcaacagggtgagtgagtccatcttcaggtccctggtggaagtgctcaggtgctaatgatggtggatgtggcagagtaatccccaagtccccagatggtgttttcatgcactgcggtgggggtaggggcagagcaaagccaggtgagcctgtcctcagaccccctggtggtgcctatcagcactggctgtgatgtgcaagggtggggtgatccctggactcctggaggagtgctttgataggggaggcggtagctgcagtggggccctgctgctggagaaggtggggttgcttttagtggctgcagctgtaggcaggcagctggggagcacgtgctttggccccagttggcacctatgcgttggggagcctgtccttgggacacttgtatatgtgcgatggtggcctgctgttagtggggtggggttgctgcagtggcttggctttggccctggcagcagcagccagctgaagcagcagctgcaggtggggtatggcagtggggctcctgggatgtggagatgcaggggctgttgggccccaaggcagggtgatgtctggtggaggctggctctcaaaatggcatcttgctgtagctgcctaggactcagggtggtgtttgggattcagcctgagctctggagcaatgccattgtgcggtctgcagacagctccctatgttggtctctgggcctgtgaggggctctctggtggctgggactggaggaatccatgatgggagtatggacgctgcaggtctgtcactcccctttccctgcattggggagcttctctgtgctcccagccagtcctggccaaccaagcaggctgcttctctttcctccccttccttgccctaggtgtttcctgttggttctctgttgaattccaatgttctgtctttgctgatctattcaaactgtgattatctactcgctgttttattcttctttgtggaggggcagctgatagatgcctctagtccatcatcttgaagccctgccccttgagaacttctaatgtcccctaatttttagcctcttctttctatatacttcccggtttttaccatattattttatttaccttgtccaagtttacattctattctgtacatgtaactaagtctttagtagcttgtctgtaggttcattctaaaaatttaaaatcagttaaatccatatgttaaataacatgattatataaatatttttattatgggtctaatcttagcatgtgatgctgagcacattccattttgccgtgtcccttttacaatttccagatgggaactgtcggtggttgtccaagcacagtctgatcagttcagggcagagtgtctgcagggctgtagtgaagcccaggaacacactggcctcttgggcagctaaatctgttgtcaactagtactgattttgtcaatgttgagaatttcaaacttaagctgaattctaattttccagagttgatgatgtcattgggaaagctcagatttggggaaggtcttcctcattttgaagtaaagtgtttctctgaagattccattctattggctcatgggcctgagcaggagaaacctaatcctccttctacatgagtcttccaatcatttgaatacatctacaggataaatgttccagttcttttaacatttcctcttagaacatgatttcaagacttttgccattctccttcctaaactctgaatgtgcatttttttttcaaactatctttggggaagaatacttttttccttatttccagtccattgctgacaaatacttctataaaatacaataaaatgaattaatagaaaaaaattatttaaattctataaaatgaatgaacagaaaaaaatatttaataagatacaccaagcacaagtccaaatttttaagtattagaagccacagacataaaattaattttcaataatgaaaatcagaataaacatgagagaaagaatagaattacccaaattgtacacattcttctttgtgtgtaggagattagtataatgaatcactagtatcactattatactcatagccttccttttgttgttctttagtcataagttttattatgactaaaattccctgtatttaagttctacatacacactttgaatgaatactgcttatgttagtatttaaagtttgtgacaatcagctgcttcttgctagttcacttagttaatcttggttggattgatgacaatgttgctttcagtgcctgttgtataggaaattttttcttttttttgagactgagtttcgctcttgttgcccaggctggagtgcaatggtgcgatctcagctcactgcaacttctgcctcctgggttcaagtgattctcctgcctcagcttccccagtagctaggattacaggcatgcaccaccacacccaactaatttgtattttcagtagagacggggtttctccatgttggtcaggctgatcttgaactccggacctcaggtgatcagcctgcctcggcctctcaaagtgctgggattacaggcgtgagtcaccgtgcctgacccctgtgaaactgtttttatgttttgcttttcagatacttacagtagaaaacaaatctaacagaggtttgttgagaatagattttaaagcaatttcaacaagctcaatatatttgtaggtaccttgtattcaaattaaacaattgtaatttcagctttccttttttttctgtttattttttcttaaaaatatttgatagagacagggtttcaccatgttgcccaggttggtctcaaactcctgagctcaagtaatccacctgccttggcctcccaaagtgctggaattacaggtgtgagccaccatacccgtctgaaacaaatgtgttttcaaaatccatcttcaatccttcatctgtcaacagttctattagtttattttgtaaaggtatagttatgtttaaatatgatgaaattcttttgaggaaagaaatgggttctggattttatatacttatttagattatagttggcaaaccagccttaaaatatcacatctgtagcctgttccttcagtgtacaacagatagcaactctcaccactagccacttaccacacaagtctaacaaagagtgaataggtacatacttcattcaaaaatggagtataggctgggcgcggtggctcacacctgtaatcccagcactttgggaggccgaggcaggcaggcgggtcacaaggtcaggagttcaagaccagcctgaccaacacggtgaaaccctatctctactaaaaatacaaaaattagctgggcatggtggcacgcacctgtaccccagctactcggtaggctgaggcaggagaatcgcttgaacccgggaggcggaggttgcagtgagctgaaatcatgccactgcactccagcctgggcgacagagtgagactctgaaaaaaaaaaaaaaaaaaaaaaaaaagggagtctatggtatttggatgttgcatcagtgtcaacttgctatagaaattgctaatatcttaccctcaatttctgaaatgatcttgttgggactgtgaacagcaggtgcaggagtggtaccagaatgtaagtttgaatagtgctgtccaaggagggttttgtctgtattaaagtttgaatcacagaactgaatgccaaacttcaggcttggtgtaattcgaaggaaatagagcaggacatcacctctctcattctaaatactttacttttgtgaatgcagcccaagtttgggaaggggggaatgggtgtgtgcatgtgcatgtgtatatttgtgctcatatcactgttgactcaacactttaaatggactaaaattccccggtgttttcatagttgccactattctatcacatcttcctttcattcctaacccctggctacaattcccttctctagaggtgatgagaattggcagttgcttgtgcatgtttctagagatattcttttcataaaggtacaaatggtactatactatgtaccattgttatttgtatagatgcactattaaacaccttactttcttcactaactgtatcttggagaatcattcatattggtatataaagaacttccccatttcatttcaagactacatcatattctatagtatggatgtctcatatttgtttaagaagttacatatcaaagaatattcatgtagtatgttgtcttttgctatattataattggataactacatattcctcattttctatatttagtaacctatcttatagatatatcctcaggactggaacttcagggccaaaagataagtgcatattaagttttgttatgtatttatgccaacaatttataccaaaattatacctgttcacattgccaccagcaatgtatgagactacctgtttgggggaatttctgagtttttttgttaatcataactgcagtaggtagaattaaccaactgatttttttattttataaaattgatctaggattgaaggaattaagctcaagccacaggttctctgtcctgatgataatcattgtacttttgagtggcaatttgatctcatgtgtatctaaatccataaaatagcaacagaacaggaatcaattgtgtttttaaaacgcaaacctttggatggtttcattacttaatgcagactcgtgcatttaaatgggaagctaaattgaatgccataatcatattgtttattaaagtttttgttaaaagtaattttgaaagaatcattttacatttgtcgcttcagtcagactgaacctaaagacttattaattataaaaaaattttttaagtgatccccatcacagtctatagggcctgccctctgtgatttcctctgtggaggtcagtcttggttttgctcacaggaagctttatgtttcttgtcctgtatgtcagtgtggtctgacagcaatccccaggtcctggccagtggtactgatgtcacattattttatgccgcttgcttcggcgtatccttgaggtagccatggaaccagaatccactctgatggctttctcctgataggtgaacaagtaattgcatttgcagtctgaggacatttatttccagaagatcagccctgtgcccctgaatcctgcagcacttaatcagagcactaagggagcgaccatccccaaggccttgtcactctggctctcgagtcctgcattttatacaagaaacagcttagggttcactgagctgaatgtgcctgaaaaagagaaacccaacttgctcacagacaccattgtattctatgaacacaaactgattttgtgattttcactagacataaatgttgatgcctaggtttaaaaagaaaacgttctttggatttgttagagaggattgttttggcccttttcttgaagtcagtgaaacattagtatgatattggggtagaaaaattcctcatagttgaaatattttaattgtgtttattggtcttgtggtgttggctgccagttgagttgtctactccaaattgacagtaactccataagtcacaagcatctgagatatattttgtgtattttgagggtctttagtgaatatataatattccatatggttttagaattctaaagtgattaggattaatttccatcccagcatcattgaatttaggacctcaattttctaaccacacatcagactgtgcagtcgaccctctgcatccacaagttccacatctgtggattcaaccaactatagataaaaaaatatggaaaaaagccaatacaaataacaaaacaacaataaaaataatacaaataaaaacaacacatgataacagttatttatctagcatttacagtgtatttggtattataagtaatctagagatgatttaaagtatacagaagaatatgtgtagcttatatgagaatattattccattttatatgggagacttgagcatcctcaggttttcatatcttccggggtcctagaaccaattccccaaggataccaaggaacgaccgtagtttccaagtaaaatatgccccaatttattatcacctttactgatactagttactctaattgagcaagtgagaagatattgtattatgatctgaagagaaatctgtaaactgttaaaatattgaatttgtgataaagtgtccttgactctacttttaaggaccgtcatttaattagcagcaacagtggggcttctctacagacatgactagtttagcaaaggaaaggggaaaccaagaccttgaaaagcaaaaggcattttacaaaatagattccataattagttgagttattacatctctgaaaagggcaggcttctctaattacatatctactctgggacttttctttcaaattgatgcctgagacttccttgattttaaaaaagtcaccataatggaaaaaataagatgttatgtttcctataaaaaataggaactagtgtttcaggctatcctttttcctgtttccaagctgttaatggagagaaatttcttttaaagcccagttctaatgcaaaagaggtgactgcattttaactggcagcctgaaatgttatcagctcatttagatgtagagtctgttatttaaaaatattgtgtttctttttagtgctttttacctctaacatactatttttaataatttttttttttttaccagttaactaggcagcaatactacagccatgctagttaacacgccgcttaatatttcttaatgtgaattcatgtattttggaacttgatgttaaaaaataattttaaaaatcaattttaaagatgctcatgcctgtaatcccagcactttgggaggccgaagcgggtagatcacctgaagttgggagttcaagaccagcctgaccaacatggagaaaccctgtctctactaaaaatacaaaattagctgggcgtggtggcacttgcctgtaatcccatctactcgggaggctgaggcaggagaatcacttgaacccagtaggcggaggtcatggtgagctgagattgtgccattgtactccagcctgggcaataagagtgaaactccgtcccgggagaaaaaaaaatcctcctttggtgcctctgtgggccattctagattatggtaaatagaattaagtacacaggtaaccttctttatgtccttcattatttttctgaacctaatttcacatgttatgttcttatgttgttattttgagacaaggtcatgctgtgtcaccaagtctggagtgcactgatgcaattactgctcactgtagctttgaattcctaggctcaagcaatcctcctatctcagcctcccaagtagctgggaccatagcacatgctaccatgcatggcaaattattttattttatataagatgggggtttaccaagttgcccaggctggtctccaactcctgggctcaagcaatcttttgtctcgatctcccaaagagctgggattacaggagtgagccactgtgcccagcccatattatattctttaagattattcttctaagtatgatactttccctctacttttaatcctcccacctaccaaatggctagttgtttctgtttcctttcttcaggttctttctgcgttgtctttatgagacaaggggatatgcaatgaatattggatattggaagtcaatgaatagttttatgcaatgatgtttttatgagaatattcctctattattcaaaatagcattgagggggcatctttattcaaataattgttagtgcctagctaggactctgagagcttactgtttattaaaaataaatttccgtatacaccaagcttgagaaagatagttctataaacatattctacatatggactgaatctactaatatgttatccaatgatttgtttttattaactctttccagtattccacacagaaaaggcttatgtgtcaaagtttccttcttttttctaacccagattttatattttatatcccttctctgtgtttttttttttttttttttttttttgatggagtcttgttctgttgcccaggctggagtacagtggagtgatctcagttcactgcaacctccacctcccaggttcaagcaattctcctgcctcaggctcccgagtagctgggattacaggtgtgcgccactatgccccgctaagttttgtatttttgtttagtagaggtggggtttcaccatgttggccaggctggtcttgaactcctgaccttagtgatccacccacctcagcctccaaaatgctgggattacaggtgtgagccaccacgcctggccccattttctgtttttaagacacctaaattttcctgacataccattgggatttaataactttatgaggagactatagggaacttggagttaaaaatggaaggagtaattaacccaaccccttgtagtcattagcaggcaaagtcaatgaatttgccatagcaaatgcaggtgtaccctgttgacttctaatgttattgtcttcactttctgtaatcattttaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtactcctcatttagggagaaaatcgcagccctccttaggggcagattgagcatgactgggtccactgaggacaccattttggagaagattcgagaaatggacagccgggaagaaagcagggaccgggtgagtgggtcatggctgtttacagacatcttaagaacagtgagctcattcatttagcatgctcagtgactgtattagtctattctcacgctgctataagaaatacccgagactgggtaatttataaagacaaagaggtttaatggattcacagttccacatggctggggaggcctcacaatcatggcagaaagcaaaggaggagcaaaggcacatcttacgtggtggcaggcaagagagagagtgtgcaggggaactgccctttataaaaccatcagatctcctgagagttattctctatcacaagaacagcatgggaaaaagctacccccataattcaattacctcccaccaggtccctcccacgacacgtggggatgatgggagctacaattcaagatgagatttgggtggagacacagccaaaccatatcagtgacttatctcaattagctaaaagcatcacttaaggccaggcctggtggcctaggcctgtaaccccagtccatttggaggccaatgtagtcacttgaggccaggaattcaagaccagtctgagcaatatagtgagacccctctctctactgaaaataaaaattaagtcccagctacctggcaggctgaagtggaagaatttcttgagcccacgagtttgaagctgcagtgagctatgattgcgtctctgctctccagcctgggctacagagcaaatcctgtctctaaaaaaagtataatttaaatgtggttgtattaatttccattttaatggaaaggcatggcagtcccacaagccacatctaactgtgatgcaggttctggagttggacctgcctggtgctgaatcccgtctctgctgtacattcactcactgtccatgtgagcttgggtaggttcttgagtttacggcctcggagattttgttttcttatctacagaaaggggttagcacaggttccatgaccccttacctgaaactcttggggcccacggtgtttttgagttcagaatttttcagagcttagaaaggtaatgcagagtgcagccttacacagccctccactgtggtgtctgggacagtttcctaccgtcaatcacattcacaggtctgtagctaagcccgcgagcaacagtaagtgggataaatgaagaccgcaaatagcctcttgtcattttgggtcaggatttgctgcccagctgggtcaggtcaggccaagctttgtcagtaaatgagttatgaaaaaacctggattttggaattacagataaaagttcccagacctgtaatggtatctggccgatcaggttattgtttcatgtatgtattgaatgaaaaaaattgttataaagatcttaactcattgcctggcaagtcacaacaataaatattaactattgctgctgttgcctctccttcttcctccttctctcctttttttcataatgtgttggtggcctgaacagtctttcaggggtcctatctaacaaatggagaaaaatggtttaattcacgtatatgattgaggcttgtttaactctgtcatcttgtttctactatcaagaactctctttctctataaagctttacctagcagagtccacttcagtgcaggctttgtttaaattatcatcaaacctaaattatagaagtcctagttaatgagactttaaagtaaatgatctccaaagtccttgtataattccattatgaaatatttcttctattgctgtcgtgcttgcttgaaaggagaaaacgcattttaccatcttttaatgttactaaaaaactcagaagaatcactaactcaaagttcagggttgcatttgtcaatttcctttagtgatagtaaattccctttaaaaattctccaaaattcaagcttgcagtgagccgagatcgtgccactgcactccagcctgggcaacagagcgagactctgtccaaaaaaaaaaaaaaaattctctgaaattcacgcatactctaggagcaaccttagtggcccctttagccaagcacattttcttttcttttctttcttttttttttttttttttttttgagatggagtctcgctctgtcacccaggccagagtgcagtggtgcaaactcggctcactgcaatctccgcctcccaggttcaagcaatactcctgcctcagcctaccgagtagctgggactacaggcatgcaccaccacacccagctaatttttgtatttttagtagagacggggtttcaccatgttggccaggatggtctcgatctcttgaccttgtgatccacccgcctcggcctcccaaagtgctgggattataggcgtgagccaccgtgcccggctgccaagtgcattttctatctctttgtggagataaaatgtggagtgctcattggctgtcctccactctaatgtgtagaggtctctgcgagtaacttagtttttcttgtgactcagtttacatggaggtacttgagaaagaaaatgatttataggtttggaaataagcttcattaagtcatttccttaaatggtaacagatatgcagacgatttccagctcatgaaaatttaatttaaaaaattttcaacttgacgatggtgtgaaagtgatacacattcagtggaaaccacactttgagtgtgcatgcagccatcctgttcttcactttcagtattcaacaaattacatgagactttcaatactttattataaaataggctttgtgttagatgattttgcccaaatataggccaatgtaagtgttctgagcacttttaaggtagggtaggcgaagccatgatattcggtaggttaggtatattaaatgcatttctgacttaaggaactttcaactaacacgtctttgttgggacacaacctcaccattcgtcgaggagcatctgtacttcaatagctaattttttttttttttgccatttcattttattgctttccacttctatattttcaagtagtttcttaaaactactttaatcccaaacaaggcgcataattatcagcatgatgtatatgtttattttctaaagccaaatgatgtaaattggttaagctgggtatgctttctcccactccccataaaaattagaatgattcagagtctttttagtgcctttgtctgccattcctaccctgtaatttttttcaatagctgccctccctatttaaaagcctgaaatcaagcatatagctggtgtcttgtgtgactcatcttcacgtaaaatcaggagaaaatggatttcatatattgtcttagaaatgtttctaaagaatgggagctttacaaattgatgaatctgtttgttgaggaggctgcatgtccctgccagctgccatggctacgcacacagtcagtggctgagtaattctgatgtgaaggctccacggcgggttcaggctcagcttggcagattctccgcttcaggccggctcctgcttcccgaacgttgcttgtcttgtttacccctgtgctatccatttttcccctcctgtgtttgcaattctcagtagaattcaggacaccacccacacttttacagcacgtcatttctacttgttccttgcatatctgcttctggcaagatctaatcttctttttagaagctttactatatcttagagcaaggttttccatcctcagaactattgacattttggactggataattttttgctctgggggccagtcctgtgcattgcaggattttgagcggcgtccttggcctctacccgctagtagcactccccttcccagtttgtgacaaccacagatgtctttagagactgcctaatgtccgccgggggtcaaaattgcccccagttgaaaaccactgtcttagaggaatgttctactgccaggttcccacgaattctaaatgagtatttagatgttacttagccttggaatttcaggacaccatagcagttgtttatgaaataatgacttcttgcacaatgacagaaagttacgacattttcagattttactttagaattttgaggcaattttgttttcttcttcacctctatctggacatttttcctgttctgctttaggtacacctaaggctttatttccttccttgaggtgtttgctggtccaggggctctgtgggagctgtggggaccccccccgatgctataaagcaagggtctccaaccctctggctgcgcacccgcaccagtgcctggcctagtaggaaatgggctgcacaggaggaggtgagcggtgggcgagcgagcattgcttcctgagttcacctcctgtcagatcagcagcggcattagattctcataggaacgtgaacgctattgcgaactgtgcatgcgagggatctaggttgcgtgcatcttatgagaatctaatccctgatgatctgaggtgaaacagtttcattctgacacaaaaattgtcatccacgaaaccagtctctggtgacaaaaaggctggtgatctctgctgtgaaggactggagatgtgcttcacagccccctcctccccattctgatctcagagcccgattatcattctcctgctctgttcttaaccctgccacctactaaagtgagcatcttcccagaagcaccagcacacttccatttgggacgtttcattatccaaaattatgttgtgcggttgctccgggctacagaggcatctgagagagcgaacagatggaagtttcagcttttccagcctctccagttatatgagtttcctggggctgctacgacaaagtaccgcaactgggcggcttaaataacagaaagttcttgcctcacagttctggagatgagaagtctggcatcaaggtgtcagtagggttggttccttctgagggctgtgagggagagtctgtcccatgcctcactcctagcttctgctggcctcaggcattgcattctttgttgtagggatagtgttcttcctgtgtgttcacattgccttcctctatgcatgtcggtcttcgtgtccaaatttcccctcttataaggacctcagtcatctgggattagggtccaccttagggacctcgttttcacttcatcaccactctaaagacccgatctccaaagaaaggcacattctgaggtactggggggcttcaacatatcttttttgagggggacctaatttaactcaaaacaaaagttgagatgaacagaggaggtgggatagagttagccagtcaacagtgctggccacacaagccgacagaagggaaggaggatttggtcgacactttctagtacctgataacttacatattccccaagtgcaaattatagcttgagtaattggaaaagagtttatgtctaaaaggaactggactttaagtgacccaaatggctctttcttcagtgtagaactttttggcttctatttggtttaattttaggacaaaaatgtctctctggtgaaatcaatgcatagttgtccctggggagtgaattaaatcttttagggcattatgactttacttctaaaaaccatgcagcttattctttaactatattgtgctttttgtttaaaaaaaaaagcacaaacaaaaaaatatcttttttgtttaaaggtatgtattcttcacccctcaccctccactgcccacctctagtgttgaaatatctggtgcattttgtcccatagaatatcaggtatatgttaagaaatgatcctaagaaaaagaaaagaaaagaaagaaaggcttatttattgtttagactttttggtgtgaaaaacagcacaagtttacggttttggtggagcacatatgttcactcaggcactggcatttgatgttcccaagaataagtcagaatggaaagttaatttatttgaattaatttatctaaatttagttagaaaaaaacttagtggtgtcatgtgcactgacacctaaataagcttctgaagctacgttctgtgatctgatagagtgcaggagggctctcagctgttttcttctctctggacacaagaatcttggcatggcaggtatcccctgcaaatttcagcgatctacgtattagtggttttaaagtctcacttcgctgagtctcaaggctctgtagagcaccctcaggtccagatggggtgaagatgcaagagagaccttcttgcctttgattcaaacacatttgtcccttatttgttcttcctagaaagacttctagttgagagaaagactatgctgaaaatagtttgagaaacatgacataggacaattcctggagggttctttagctcctcatggcgacagcataggattgacagaaccagtacactggagcagtaaccctgatgacggaaatggacacgatgtgttgaacttcaatatggtgtgaaatactgtaaattatctaaatcagctcattgagtcttcatagcaaagtctacgaatttcagagagattagttacttgcttcagttaacctgctagtaagtggtacaggggaaattgaaaccagggctatctgactccaaagcctccgtcctgcactctggtctacgtcagatgcttacatcttcctttagggtcagtatcactcccttagtctaacttactgcagttactctgggcatcagcttcagaatggagaccatactgattgatgtctacagaaggcttgcttttttccagtaaattcggtggtgtgctgactatggctaactgatcacacagttctccctctctccgcttgaggtttattgaatcaattttctctttggtttcattctctccgctatgtcatttgtggtataggagacgttgaagggtcttcaggtagaaatactcacttcctgtttgcagtccaacgtgaaaccacatctcctgatgtgctatactcctaataatgcaaatcagtcccttgggaggcagcatcttgtggacatttttctgtagattacattatttgttataccaagataaacactgtttctcttgcgttaagatcagatttatctgctatattagtaagttatacttactaatatagctatgaatgtatcagtagattttttattattggtaagcaggaaaggtaggaaataagaaatgaggtttctcagagcttcatgttctgggatgacactaaaaatttccttggtaaatgtaattccttggatgtggctctgaatagcttaccatcaaatatctaatttcaagcacacacacagaagtgttaaattaattgaatgtctggaagcttgagagccatggaagcacaggattgaagagtttagagctcaggtggtctaaccttcctcatgtagcacttcaatctgcattgcaacattcttaattggtataagcatacctcagagaccactgcgacaaagcaagtgtcacaataaagtgagtcacacaattttttttggtttctcagtgcatataaaagttatgtttatactagactatgtagtctattaagtgtgcaataaccctatatctaaaaaacaatatagatactttaattaaaaatactttattgctaagaagtgctaacaatcatcttagccttcagcaagtcataatctttttgctggtggagggttttgctgtaatgttgatggttactgctgatcggagtgatggttcctgaaggttgggtggctgtggcaatttcttaaaataagacaacaacgtagttgaaaacaacaattgactcttttttttctcaaaagatttctctgtagcatgtgagctatttgatagcgctttaccaacagcagaacttctttctaaattgaggtcaatcctctcaaaccttgctgcttttttgtcagctaaatttatgttatattctaaatgtttattgtcatttcaacaatgttcaagcatcttcactaggagtaaatttcatctcaataattttctttgctcatccatgagaagcaactcttcatccattcaagtttgatcatgaggttacagcaattcagtcacatctttaggctccatttctaattctagttctcttgctatttccaccacatctgcagttacttcctccactgaagtcctgaacccctcagaatcatctcatagatgacacctatgatgttattttgacctcctcttatgatttatgaatgtccttaatggtatcaagagtagtgaatcctttccagaaggttttcaatttactttgcccagatccatcagaggaatcactctctatggcagctgtagccttatgaagtatatttcttacataataagactttaaagtcagaattattccttgatccatgggctgcagaatgaatgctgtgttaatagctgtgaagacaacattcatctctttgtacatctccatcagagttcgtgggtgaccaggtatgttgtcaatgagcagtaatattttgaaaggaatcttttactgagccataggtctcaactgtaggcttgaaatattcagtaaaacttgatgtgaacagatgtgctgtcatccagctttgctgttccatttctagagcacagtcagaatagatttagcatatttcttaaggggcctagggtcttcagaatggtaaatgagcactggcctcaacttcaagtcaccagctgcattaacctctaacaagagagtcagcctgttctctgaagctttgaaggcaggcattgacttctcctctttagctatgaaagtcctaaatggcaacctcttcccatagaaggctgatttgcctacattgaaagtctgttgtttggtgtcgccaccttcatcaatgatcttagctagatcttgtggataacttaccccagcttctacatcagcacttactgctttatcttgtacttttatgttatggagatggcttctttccttaaatctcatgaatcaatctctactagtttcaaacttttcttctgcagcttcttcacctctcttaggcttcatagatttaaggagagttagggccttgctttggattaggctttggcttaagggaatgttatggctggtttgatgtctattcagaccactcaaactttctccatatcagcaataaggctgttttttttcttatcatttgtgtgtgtcttagtccttttgtgttgccataaaagaatacctgaggctgagtaattgataaagaaaagaggtttatttggctcatggttctgcaggctatacaagaagcacagtgccatctacttctggcaatgaacctcaagaaactttcactcatggcagaagatgaaggggagcaggcatcacatggccagagagaaagaaagggagagagaggaggaggtgccaggctcttttcaacaaccagagctcatgggaactaagagtgagcagtcactcaattctgcaagaatgacaccaagtcattcatgaaggatctgcttccatgaaccaaacatctcccactaggcccacctccaactgtgaggatcaaattttaacatgcgatttagagaggacaaatatccacactgtatcagtgtgtttactggagtagcacttttttttttttttttttttttttgagacggagtcttgctctgtcacccaggctggagtgcaatggcgcaatctcagctcactgcaacctctgcctcccgggttaaagtgattctcctgtctcagcctcctgagtagctgggactacaggcgcctgccaccacgcctggctaatttttgtatttttagtagagatggggtttcaccatactggtcagcctagtcttgaactcctgacctcaggtgatccacccaccttggcctcccaaagtgctgggattacaggcgtgagccaccgtgcctggcctggagtagcacttttaatttccttcaagaacgcttcctttctattcccagcttggctaattggagtaagaggcccaatttttggccgatctcagatttcaacatgcctttcttactaagcttagtcatttccatcttttgagttaaaatgagagaagtgcgactcttcgcttttttttatttgagatggaagtctcattctgtcacctaggctggagtgcagtggcgtgatgttggctcactacaacctctgcctcccaggttcaggtgattctcctgcctcagccttccaagtagctgggactacaggcatgagccatcacgtccagctaatttttgtattttcagtagagatggggtttcgccatgttggccaggctggtcttgaactcctgacttcaggtgatccacccagtttggcctcccaaagtgctgggattacaggcgtgagccactatgcccagcctgactcttcctttcatttgaaaacttagaggccattgtaaggttattaactggcttaatgtgaatattgttgtgtctcaggaaatagggaggcccaaggagaggaagtggggtcagccagttagtggaaaagtcagaacgtacacatgtatcatttaagttcactgacttattatgggagtggtttgtggcaccccaaacactgcaatagtaacatcaaagatctccgatcacagatcaccataacagatatcatagtaatgaaaatgtttgaaatattgctagtattgccgaaatgtgacacagggacacaaagtgagcgtgtgctgtcagaaaaatgacgctgatagacttgctcaatgcagggttaccacaaaccttcaatttgtaaaaaactaaaatatctgcgaagagcaataaagtaagtgcaataaagtgagatgtgcctgtagttagccaatttccggccatcttcggtgactgggaatccactccctactggacagtgtctttacacagctgtaatcattgtaaagttttccctttcttctttattttgattatttattatttttaattttttttctcagacctcacagggaagagtttttcctttcttagaaaggaatgcttaagtgaatgatgacacattctcatgatgaattcttaatgcagccattaaaatgttaattaagaatttcaaacggcatgagaataattaggtaaaaacaaagacatgaaattgcatgtataatatttcaactatattttaacaatacacaaaaacaaattatttaaaaatattaatggcttttgcctctgggtggtgggatcacaggggattgttttttgcctgtttatactttttgtggttaaaagaaatttcatggggatatcttactttataattataggaactggggaaaacattttcctttcataaatatggaatttcttctctgatttatacctgttggttctcaatataggctccgagggtaactcagaacaaatccttttgttctcccatataatagcctttcaaaaagtttaaaggcagattacgtgtttaagcacggctgtttatagatgggcaaacagaaattgttttctttttaaaaatttagacagtaaaaatctgaaacagtcaggatgtttccatttctgtgagaatggtactgtactgttatgtaaatactatgttttccctcttctcttccaaaataaaccatcgaaagaaaacaaatttatcaccctaggcttggtggttttattgaattcaacattttatgaaactggatttagtaaaatcagtttgagttttctgagagtgtccctgaggtccttggtaaacttgcactcttggtttaagggaatgatcaggacaaaaagaggaactcccgggaaggatgggagcattgggcaaatcaggtgggttgtggagagcctggagggactttaacatgggacagtactcagattcccctgctctcttgtacattgacactgaccttatttagagtcaccatattaaagagatgttgacctctccaatgcaaaaatggtattactctataactatgtagtgtagagtcagcatccctggagtttagggcataggtaaccaatcttcaacagaaagctgaaaaaagtttgaaaaagcatatatctgtacatgaattccctgtaatacctcaatgttacctaccaagattatctcactgtctaatcttaagtcaactcaaaatggtgaaagaatttttctggggaatgactctttgtagatttttacagtactttttgtcttaattctttttcctactaaactttgaaactcttagcaatagttttggggtaagtaaatgttatccataaatttttattgattaacctgataaaagaattatataaaaattaaaaataccaatcgaaaaatttaattcaataatgaaagtagattatttcaaacagaggcaaatacagctatcaattacatattttaaatgggatttttacaaataatctggaagttggtatcataaacagttatgctgcttaggcagagcagtagatgtgaacacttccttgcatctgaaacaaggcttattcttgatctgtttctttgtttccagatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaagtaatgacccgagggcatgtccatgagtggaagcatctgttgtagtataaaattttacctgaaaatatcctgaattttacagtatttagtttggttaagtcctggacttaattggttaagtcaatttcaaggaacaatgggtttggagcttccttgattcaaattaatttaattaaactcaacgagtatttattgaatgcctaccatatatgaggtcctaaaggtttggcaagctaaaatatgaataatacacagttcctgatcttaaaggctcataattcaataggggagacagatactcagataatttgctgtactataagtttacacatgttatatgtattgaattaataaagtgctgtaggaacttccagataaagggaagattttataggagaggagataattaagttcatttttgaaagataagtcagattatagtggagacaggagacagatactgtaggggaaacagtttgaagaaaggcatgaaatctggcaagtgcatagtatattcagaggacgcaaaatggtgaatcctccatggctggaacatgttattctcggtggatctgtggcaagagaaaagactggaatggcttagactatgaagatggagtgttctttactctgtagaatatgaagtgtggtaagtgtgagcattgcagtattttattttattttatgtttatgtttattatttctatttttttgagacagagtctcgctctgtcgcccaggctggagtgcagtggcgtgatctcgactcactgcaacctctgcctcccgggttcacaccattctcctgcctcagcctcccaaatagctgagattacaggcgcccgccaccatgcccggctaattttttgtatttttagtagagacggggtatcactgtgttagctggggtggtctcgatctcctgacctcatgatctgcccgcctcggcctcccaaagtgctgggattacaggtgtgagccaccgtgccaggccacattgcagtattttagaaagatagcgtgatgtccccgtggagctgagattgtggcatggagggtctcggaaacaatggcactgataacccagtgggagaggagagttagacgggaagagaaggagcccgcactgaggattcgaatgtggggagactgtcagtgatctttgagaggcagttttggtggagcggtggagagcaaaagccagtttgtttgtgctgaggggatccttgagaggaaggggagcgaccttctagtagaccagtgtgaagtctggtgaccaaagagaagagaggcatgaggcagtggctgtgaaaaacaagatcaaagaaaggttttgctggacaggatggcggggaaagtatggactgaaagagtctgcaggagggagtgtgggaagggaaagggaggcacacaggctcaagagcctcgatgccaaatttggcatgaaaaatgccctaaagttgaaacatgtacactcaagtaacatattccttttcattcttctgtacttaaaacattgaggaatcatcatgcctgcattgaggttggatatgcaaagatgtgccaaaggtgtctgtggaaaatcaagtctagcagatgagacagggagatcggggcgtaatagtacaatagtgcaattagtgcgcttagtgcaatagtacaatggtgcaatagtgcaattagtgcaaatagtacaattagtgccatgatggagacaggtataaaatttaacagaaacctggaaaaaggagcaatgactttttttctgtgtggtaagtgagccatcttcacagaagaggggagcattaaagaatgagtaggaatttgtcaggcagaagaggtgggaaggaatttgaggcagaaagaatagcaggaacaaagaagaaatggaggtgtgaaaagatggctcaggaaatgaatgaggtgcagggagcctgggacatgatacttggcgaaaccaaaggcgtgagatggcactggaggcagctataggaatgatcgagatgggtcagtctaatgactcaggcttcactgcgtaggtaatgggaagccagagaaggtttttgagtaaaagaaagatttccctcaagtcagactcgcttagagggtagcaggggtgtccaactttttggcttccctgggccacattggaagaagaagaattgtcttgggccacacgtaaaatacactaacagtagtgatagctgataagctaaaacaaacaacaacaaaaacacacacacacacaaaacaaacaaaaaacaaccatgcataatttttgaggtatctgccaccacagataagcaaaaagtcctcgccttccaagggttggacacagctgagggaaggtagggagcccagttggtggctccctgactggtccagttagatagtccagttcagactagcccagttcagaagataataaagatctgaaccaagtagtggttttgtgaatggaaataggggatagatttgagaagtctgggagagtgaagggagctttttctgttagatgtctgtaaaggtgtgatggtggaaaatttgattttgtaaagaaatattggctgggtttggtggctcacacctataatcccagcactttgggatgttgaggcaggtggatcgcttgagctctggagttcaagaccagcctgggcaacatggtgaaaccccatctctacaaaaaacacaaaatttagctgggcatggtggcacacacttgtgatcccagctacctgggaggctgagatgggaggatagcttgagcctgggaggtggaggttgcagtgagctgagatcataccacttcagcctaggtgacagagtgagaccccgtctcaaaacaaacaaacaaacaaacaaaaaaccaaaaacaggccagatgtggtggctcatgcctataatctcagcactttaggaggctgaggtgggtggatcacttgaggtcagaagttcaagaacagcctggccaacatggtgaaactccatctctactaaaaatacaaaaaattagccaggtgtggtggtgtgtgcctgtaatcccagctacccaggaagctgaggcaggagaatcgcttgaatttgagaggcagaggttgcagtgagccaagattgcgccattgtactccagcctgggtgacagagactccctctcaaaacaaacaaacaaacaaacaaacaaacacaataaaacaaccacgaccaaacaaaatgaaatattgcacctgagtatggtaatgtaaattggaagccatctaactgcctgctggacagcttcacctgcatggtccgtgaacaccaaaatacactcaaaactgaaatgacatctgctcaaatttgtccctctcctgcttcagtcatggtggtaatctgcctccatttgcccaagccatcttcaacacttccctctttttaatcaattcctaagcactgtaaatcctgtctccttactagatctccaatgcctcccccatctctatatccagcagctgtgctttggctctgagaattgtgctcattaacacggactagggaaacaacctactaactgagctcccagcattgttctttgtgcctcagatttactctcttcattgctgccagggaggtcttaatgaaaggtatgcctaatcttatctttctttatcttaaaactggtcagtggttctctggtgcccccaggatcaggtacagattccttctttttccatggccccacgttctgtgagctggccaggtggcctctccatcttccctctcccctgcaatttctcctgccagcaggggcaaactcagaagccttctgggagtggcaggaccctggtggggtctgcggtgattacggagcctaaagacatccatgcagatttgtagcagcactcgtctggcgtcctccagctgcctcctacattgcccactgctattttcaccgagagaatgttctccttacctccttcacctggcagcagcaatctcttcgagattcagctcaaataccacttcctctggcagtcttccctaagagacttacctatctttccttttgctctccaagcaacatgcatctgcctctctcatggtactttttaccattattggattgtttttaaattttttcttctccaaatataccaagcttcttaaggccagaaaaaatcattttttcctgtatttctccagggcctagagaaagagtcaataaatattatttgaattatagaagaaatatattaaaggcaagaatttcaggtggattggtatttcttcccttcccttactataaatgaatcattaattttaattgggattatgttcaaataactctcagttatgaaagcaaattatgtaagctaactctgtccgtcgtgaattttccgtcgctaactgcatatgaaatgcacgttctggtaaggatggatagtatcatgtaaattgaaaagcaaagttgcacagagtttaaatgctaaatgcaggtaatctggcagactcaaagacagtagaatgcagtttcttatttatgctgaactgtgattcaaatgaacaatatatacagtaatccttcatttctatgaagttaaaagtttctagtaaccttaatcttttgaaatagagacaaaatccttgaaatagaaactttctctttggggtctcggcttgctcttgtcttaatccctttttgcctgttgtagtcctggcctagtaaatggatgggtcatatgtagaaatagaaagaaagagggtttcataccgtcatgtaataggtacttatctattttatgtaaaatacaagcaatagcagttaggtcactttcatggacacaggttaaaaattaaaaattccagatagctgatacagcattaaacagtgataacctgaggatgtagagacaaaagcagtttatggtattgtagcacaatgcaataagtgatatttgcaatgactgtgacttataaagaagagataaaattgtattcatatgtatgctatttgccaaaattggaaaatatacacttataaataatttcatcctgataattaaaacatagctagttctgggctttaatctggtgtgcttcagttggcaggaagttgtacctatttaaacatttaattgcctgaaaatgccagatggataagttattgcaatcagaagaaaatatcaaagataaaacccaaatcataaaatgatgatatagaaagctcattgattgatttattcatccagcaagcacttagtaagcattgtcctatgtgtggacttgccagataaaccacagaaatcaagcagaggaaaacctttaaatagctttctaactgtagactgctaaaatatgaatcttgacttcctttatacagcgctgttttagggggggaggtgttcatttaacttggatgcattaaacaattttttttttttgaggcggagtcttgctctgtcgcccaggctggagtgcggtggtgcaatctcggctcactataagctccgcctcccaggttcacaccattctcctgcctcagcctcccaagtagctgggactacaggtgcccgccaccacgcccagctaatttttttgtatttttagtagagacggggtttcactgtgttagccagcatggtctccatctcctgaccttgtgatctgccctcctcggcctcccaaagtgctgggattacaggcatgagccaccgcacctggccctgcattaaaaaattttaaagaaattttctaaaatatcttaattaataaaaaagaccccaaaatgttgttcgaaattttgtttgtatggtgagctttgagtttggagtgctctgtagagcccaagaagagtaaagtggcaactggctaagttgccagtgacaaccggctaagttgccagtgacaacctttgaggccagggcccagttaggtgggaaaaattcccaaggaaggtgcatgggtgggtgtgttagtccattttcacactgctgacaaagacataggctgggcacggtggctcatgcctgtaatcctagcactttgggaggccaagatgggtggatcacctgaggtcaggagtttgagaccagcctggccaatatggtgaaaccccgtctctgctaaaaatacaaaaaaattagccaggcatggtggcacgtgcctgtaatcccagctacctgggaggctgaggcaggagaattgccggaacctgggaggcggaggctgcagtgagccaagatcaagccactgtactccagcctgggtgacagaggaagactctgtctcaaaataaataaataaataaacaaataaataaataagacatacctgaggctgggtaatttataaagaaaaagaggtttaatggactcacagttccacgtggcttgggaggcctcacaatcatggtggaagagtaagggatgtcttacatggtggcaggcaaagagagagaacgagagccaagcaaaaggggttttccccttataaaaccatcagacgtcgtgagacttactcactaccatgagaacagtatgcgggaaactgcccccatgattcaattatcttccactaggtccctcccacaacatgtgggaattatgggagctacaattcaggatgagatatgagtggtgacacagccaaaccatatcaatgggtggatcccaggggctagattagcctgagaggggcatggttgcagcaacaagttgtcgaagcagagagatgaagatgtcatcaaacatagccaaatgtgttgtttggcagagttaagaaaagtatataatattcgattgaacatgaacatcaagggctaggagagtcaagagcattcagacaaggggtaggcagggaactggcagggtggttcaggaatttattaccacatatgggtcagagtccgtgctccgttccatgctctctgcaaaggagaattacctgtaagcttgggagaaagaggaagagattctgtgagatcactcattaactttgactttcatgtcccatttttgtttctgttcttgggtttagtatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaaggtaggagatattgaaacttgctagtattgagagaagaaatttctgaaaaacccaaacattgaaaaataatgtactgccaccatgtttaccagtgtagctaggaaggctcttataaaaatatgtatttagaattggaggctcaatttcaagtctgaagagttggtaagtgtatctgtcacctaaggttgtgtttcactgtgtgtaatgggtacccacaatggcagtgacttaagcaagtaaaagttttttgttgttgttgtttgtttgttttttctcacacaaattcctggagacaggaagtttggggctggtgtggcaactctcctctgtaaagtcttcaaggaaccaggctcatttcagctgattcacttcccatccctagggtgatccttattctcatggttccaaatggtgcccagaaccattatatatctgtgtttgagatagaagagaagaaaggagtgaggaatagggctgcaaaagaacaagcagaggcatctttaaaaaaggcactcagaatttgctacatgaacttttgtttatatcccatggccagaatatgttttggtggtcaaacctagctgcaagggaggcttgcaaatgtaggctttactctgggtagccatttacctagctagaaaaaaattcacagtttctattactttgggagaagaggagaactggggggacatttagcagcctctgcatttgtaaactcagctgcactagaaattctagcagagagagaagggcttacttttcttcactcaaaggaagagttagaaacagtttatactaaatcaatgaatgaatagatgaaaggtataaaatataattattagttacataattattggtattggggaaagaaataggaaaacacagatgtattcttataatagttcttaggagagaaatgctatgatacaattccagtgtagatgctgtataatgagtcacatctgggctcccaattcggttccatcaagctgtgtgaccttgaacagattatatacctctctgtctctgtttcctcatatttaagatggggatgctatataccccaaggagttgttagtttttaataaataacattttcaaacccttggctcacagaatatgctgtattcatgtttggcttcttctccactaccatatcttgaggaatattttataaaagatagcatacaaaccctattaccattagagacattaaattcagctaccattctttccaaagttctgctcagataattgattctttttctcagtgtccaacaccattacttcttaataattatataattattaaacttaccagtttatagaatttaccagtgtaaaattgcaatggagtggaattttcttttcttttcttttttttttttgagacagagtttcactcttgtcgcccaggctggagtgcaatggtgcgatctcggctcactgcaacctctgcctcccgggttcaggtgattctcctgcctcagcctcccaagtatctgggattacaggcacctgcaaccatgcctggctaattttgtatttttagtagagacagggtttctccatattggtcaggctggtcttgaactcctgacctcaggtgatccacccgccttggcctcccaaagtgctggaattacaggcatgagccaccatgcccagcctggagtggaatttgacatgaagaagcttaagaaagggaatttgattagagaaatattaaaaaggtcttgttcaaaaatgatctgggtatggacacagctgtcactgttaggcaggatactcaaagcagcatttcagtaagtctttccacctgttaccactttacaagtgcagagtagataattaggggaactttgatggtcttcagcttgaacacttgataatatatgattctgattctgatgtttatagcagatgacagaggtttctgtacttaatattccatctactaattgtgacatgtggagcctaggaagcttcttccccctctagagtccatagtcattttcttaaatatcactctaatttccttttttaggtttggttaccaatgataaatgatgtttgaggagctatcctctgcttagtttgtggaccttacaggccagacatataataaagaccaagaaaccttcttacagtcccttttatttctaagattttatatgtataagcaaagctttaaagcaaagcttacttaaaaatctccttggtatatcttactttaaaaatatatcaactctcagccaggtgtggtggcttacacctgtaatcccagcacttttggaggctgaggcaggtggacctcttgaacccaggagttcaaggccagccaaggcaacatgatgaaaccctgtctttacaaaaaaatacaaaaatcagctgggtgtggtggcatgcatcacaagtcccagctacttgggcggctgagaggtggaaggattgcttgagcctgaaagggagaggctgcagtgagctgtgatcatgccactacaccccagcctgcacaatagaatgagaccctgtctcaaaaaaaaaagttgatatatatccactctcatgttgggggccacgtgttccagttctaagggattgaaatgagccagtctaggtttacagtactcacttgcattgtatcttatttcagaaaatgccagtgcagatattgtggccgttagatgttggacaggattttgtctctctgtcttattacattctgctctgataaactcatctgaggagttttttaaaagtaattttacatttttatgatgatgcacataatgttagagagcatcagatgtggaaagctgactcctgcacattttctggggctcttttgtctcagattttaggtatgcaattaattcttggaaagggtatgagtaaaaaatgcaatcaggaaaaggaatccaatgacttttttgatggtttacaaattactcttattgaggtgtagatagagatcaacattatctgggtaactcatttatatttactattgttcaattattaaaaaaaaaatccctgtttgcatcaaaccagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaaggcaagtgcttggcttcattttgttgttgctttttgctggttactgtcaatgttttatgcaaaagaatgacagctttatcgggacacgccagaagaagaaagatgaaagcctcctctgattttctagaattatgggaaaaatgcaaaaatgacacaaatcagggtacatatccattcagtgtctcttcaatatctgaagtgaagccatcattgctaggtgaaaagtcagtcaaaaagtggtgatgtttccttttttaaaatttttttgaggaggagtttcgctcttgttgcccaggctagagtgcaatgacgtgatcttggctcaccacaacctcctcttcctgggttcaagcgattctcttgcctcagcctcctgagtagccaggattacaggcatgcgccaccacgcctggctaattttgtatttttagtggagattgggtttctccatgttggtcaggttggtctcgaactcctgatctcaggtgatccgcccgccttggcctcccaaagtgctgggattacaggcgtgagccactgcgcctggccttataaaaaattttttcgagactgagtctcgctctgttgtccaggctagagtgcagtggcatgatcttgactcactcactgcaaactctgcctgggttcaagtgattctcctgcttcagcctcccaagtagttgggattacaggtgtgcaccaccatgccatgctaatttttttgtatttttagtagagacagggtttcaccatgttggccagactggtccccaacttctgacctcaagtgatccacctgcctcagcctcctgaagtgctgggattacaagtgtgagccactgcgcctggccaaaaagtggtgatgttttaagtccagaaaagaaatacatttctccaaagtgttggtgactgctattagtgatgatgcagggattaatcacattggaatttgcttaggaagaaatgagaaaatgggcacaactgtttgctgaaaagagtcaggcaggcaagggtatttacgttgtgctctgtaggatacatcattaccaagtccagtggagaaggtcaccagaactggggagacagttcctatattcaaggtgttcaacttctaacgaaggcagagcaaaaagaaatggaaacttacaagaatttaatcaaaagatttacgtgtcatgcatgtgtgccactggcaataatatgtaacttaatatgcacacatcatcctcagcaggtgtgcaaatcgcaagtacagtggacaataacatcctggctctttgcagacaatgctctgaaactgctttttggaaggtttccgaatctggaaacagacaagcagggaaaaagaatctggaattaagccagcccttgaacatgtgtagtggggaccatgttttagaacatattttccactgtagtttcccttctgggtagttttcttttccctgctgaagcccttctgccattggggctagactgccaagttgaagtgtacttccttggagaaggggagaacgggcaccccccagagaaggacacatctgaatacaaggaaggggggaagcaagggaaagcatctgaggtggtgccatgggtggggaggaaatatcagaggtaaatcccctcaacagtccctttgcaacttgagactgacctttagtggggatttggaatagggtggaatagcatcagctgctctaatcctggctggaagaggctgcaaatggtgatgaatcttgggggcctagattgcacctcaattccctggagcctggagttccattttcactagtgagggatatggatgacagctgaaacgcaagctggagagctcattacaggagcagatgggggtgttcggttcaactgagggacaaagtgaccctccatcagaggccctggggtcatcacctaggctgtggcccaatagcagctacagccgagccttgaattagctgagaccaatgatgtggccttgactctggtgagagaccgtcacaaatttcacaagtcaaataatagatataggagagattcaggggcagcatgagggccagaatcactttttctaaaatcacaaggactttcctccacccagttatcatctcagaaagaaggaggggagagaagaatcccctaaagatggcattgtatgaataaaaacaaattttaaacccaaagaaatgcagttagctgcaaataccatctgctctaaccatttggggtgacggtagtggggagtttgtttcctgtatccaaaggactatgcagattatcctaaagttaatgtggctgggacattgcaccagctgctcctgattgtaggatgtgcgggtgttcatccctaggccagaggcactcatcccctctgacatctttgcttataaggatacaggagtactactttgttagagagaataaagggcctttggacacttccaaagaagctagaaaagaaaagttaaagaaatggaaaccagtggtaagacagctaatagttggagaatgtcattgaacaaaataggaaaaggaacctcaccattatagccaatgtgtgatgcacacctttgaaaaggaaacaaaatttggggctttagagaacaataaggagaatttgcagacctgatctaacacttttgaagaatttctcttacccatagggaggtgctttcatgtagacaaggatatggcaaaatcagagctgtacagtgtttcttgaactcagactgaaaaatcaaacagtcttctgtctttgccaagactttataaacatagattacctcctagtgctgtcatggtatttggtacaacattgcttctgatcaaacaacagttgtttggagtagaggatgaggatgagtgacagtcaatgcaataataggtgaataggaggtctggttggctgctgctgatgccttgacaatgtctgggagttggggaggggaagaagctgagcagtggacaggggctggatcacatggagccttatgtgtcacactaagatgtttggacttatcctctgggtcctgaggagccattggaggataaaattgtcaggaacgagactgagaagaaacagagagagagatagagagagagcagaatgaggctgtggtcaactataccaagtacagcagtgcgataatgactgaaggagtgtccactatacttggctttggaaaatctgtgagtcaagcatgtgcggatcatggtggtagtgggtgagggttctgagaataagtcagatttcagggatgaaagagaaatgaaaacaaagacagtgcaatacccttccgggatacttggatgaaaagaagagagttaggaaagtaaataaagttggcttgcgtatttacttggttgccttattttgaatagacagatccacatacttttacagataagataataggaaaggtataggagagacttggtttgactgactcaagaattactcgggcccctacacatttcaaaggaatgttaagtcttccttccagtgtagaacagagatctctctaacttgttaacacagtaagtgtcaacttcatgcatttatgagatatcaaatacagaatagatttttgttttgtatttgatacaaatccaaaatatcagacttctgaaatcaatttccaagacagattaccggtatcagctatccaccattgtacattgccttaagcttgtccctgtattaatttcactattcataaagcaatatttctgaacattagcaaaaatagctttactgtattagtttcttagggctacccaactaccacaaactgggtggcttaatactcaatcccgctaacagtccttggtttatagctgcataattccaatctgtgcctccccttcacgtgacctccccctgtgtgtctcttcttttctgtctcttataaggacacccattgttggtgttagggcccatcctaattcaaaatgatctcatcatgagactcttaccttaatcattacctgcaaaggcccttatctaaataaggtcacattccgaggttctgggtggacacagcttttgggaaggcactactcaaaccactacacttattaaattaacaattttaccactcttagagggacaatataaaataataatttgaattacatttctatggtttttttttaaatgagaaatatttacatgccataaagtttattttttaaagtgtataattgaatggtttttagtatattgacaaggttgtacaaacatcaccgctatctaataccaggactttgcatcactcctcccacatcctcccccaaaatcccacacccatccacagtcattcttcatttaccctttcttcaacttctggtaaccagtcatctttctgtctttataaatttgtccattctgtaaattgtatataaatggaaccatataatacgtggcctttgtctctggctttttgtattagtctgttttcctgctgctgataaagacatacccgagactgggcaatttccaaaagaaagaggtttaatggatttacagttccacatggctgggaaggcctcataatcatggcagaaggttaaaggcacttcttacatggcggtggcaagagagaatgagagccaagtgacaggggttttcccttataaaaccatcagatcttgtaaaacttattcactatcatgagaaaagttgggggataccacccccatgattcagttatctccaactgggtccctctcacaacatatgggaattatgggagctacaattcaagatggcatttgggtggtgacacagccaaaccatatcacttcttttacttagtatgagtatacttaatattttcaaggttcatcccatgttgtaccatggatcagtacttcattcctgtattggtcagtgttctccagaaaaacagaagcaattggtcagtgttctccagaaaaacagtgcgtgtgtgtgtgtgtgtatgtgtgtttgtgtgtgtatacagacagatatatgtagatataaatatctacatcggtctatcaatcatctctctatctatatagagagatttattttaaagaattggctcatgcaattatggagactagcaggatgggctgacagactggagacccaggtagagctgatattgtagtaaaaatatgaagactggcagattatccttgtgttgagggaagctcattgtcttgtgctgcttatgccttcaactgattggatgaagcttacccacattatggagggcactctgctttatgcaaagtctacccatttaaatatttgaccaagtatctgggcatgattgcccagccaagttgatacataaaattaaccatcataattcctttttatggatgaggaatatttcattgtatggatataccacattttggttgtccattcagcatttgatgagcatttagattgtttccacttttggctattctgaacaaggctgctatgaacatttgggtcaaagcttttgtactcgtttctatgtctgtttcaaaaccatgattgaagaccttgatgcctaggttatataaatcttctgttttaagacccaggctgtaaatttactcctgaattctagaccaagaaaaagtagacctttccagatactattacattttaatttggcaggcaaacataagtataatagaaatcctttttgcaagtaaaatgttttttcacgaattcccctacctgtattgagttaaaataattttattatatttacaatatacaaacttaaaactacatagaaatttcttaatcttattatgtttcttaatattatgaaatccatatcagttcaaaaatcaaaacaaaggataaaatagaattttaaaaattagggatattaattcaatgtgatagattattttactaaaatcaccattgatatggtttggctctgtgtccctacccaaatgtcatcttgaattgtaatccccatgtattgagggagggaggtgattggatcataggagcggttttccccttgctgttctcatgatagtgagttctcatgagatctgattgttttataagtgtttgacagttccttcttcacatgctctcactcttgcctgccaccatgtaagacatgcctgcttccccttctgccatgattgtaagtttcctgaggtctccccggcgatgcagaactgtgagtcaattaaatttatttctgttataaattacccagtctcagatatttctttctttttttttttttttgagatggagttccgctcttgttgcccaggttggagtgcaatggcacaatctcggctcactgcaacctccacctcccaggttcaagcgattctcctgcttcagcctcttgagttgctgggattacaggcgtgtgccaccatgcccggctagtttttttatttttagtagagatggggtttcaccatgttggccaggctggtcgtgaactcctgacctcaggtgatccaccctcctcggcctcctaaagtgctgggattacaggcgtgagacaacatgcccagctgggtatttctttatagcatggactatatactatccattaatggactaatacatccattaataagaatgtgtggtaccaactgctcatgatgcaagttcttttgagtttggcatgtttaaagtttattatcttttgagtttggcatgtttaaagtttattatcttttgagtttggcatgtttaaagtttgttttccctaagggtataggagttattgtaccatgtgttttattttaatactgcagatactttatttgtacctatgccatgacatagtttggctttcactttgcatgaacacattatttatgtattaactctgcctttaccattttcttattagcccaggataactactaattggcacaaacatagccttatacacaaatgcaaatgccaagtactgaaatcatggggcagaatggcagaagatgaagaaagtgctttgtgtaatttatatcatgctaggtgctttatggcctgcatcagttatcattagtttcagctcaatatattgaaacaccccatgatatcagtggcttagagaggagaggcatttattcccttctcactggaaagaagcacctggtgacctcagttttcaaccttctgcttcagtatcctagcaatagctttagtcctcaatgccatcttttaggccaagctagctgctggggctccagcttcactctagtcatcaggaaggagggacagtggaaggacaccctgtgtgctgctttccaggaatgatacaacacttcttatgtctccattggccagaacttagtaacttagtccctggacctcatttaagtgaagtcggtctgagaaatgggtctttattctgtacagtaagaaataaagtaagaatagctatttggtggagagccatcagctatcagcctatatcatgtggcccaaccttagtaaggagctatggccgaagatcagcagtcagacaaccaaaaactagtggaaagctcattatcttcattgcactctttcaaggaaacaccaaaagggattaacattcttcagccacctgtgaagttctctcccactttctaactctctttatatctcccacacaagacagcctctccccacattccttccccactccagaactttctccaacccaacgagtatagcctttcttaatttttttcccctgagctcccatctcatactcagctccgatgatgtagatccattggatttctgggactgctttgagcttttcccacttctgaacgtatacagcaagcagatctccagcaagaggcatgctcctgggggtcagatggtgaaggagtggaggggtgtgtccttattaggagctgagaaaggtgtgttggttaatggctacaacattacagctggataggaggaataggttttagtgttctataacactgtaggatgactatagttaacaatactttattgtatatcttcgaatagctagaaaagaggattttgaatgtttccaacacaaagaaatggtaaatgtttgaggcgatggataatgctaattgccctgatttcgacacgtgctcttacggtagggaaggaggggaagtgagcccagactgcaaatctgaacattcatctttgatttctgctacattcctgcttagttacacctttttctttcatttttagtttcacataacaactgtacatatttttgggatacagagtgatattttgatgcatgtatacaatggataatgaacaaatcaaggtaattagtgtatccatcacctcaaatattttatcatttattttagttggaaacattcaaaatcttctcttctagctatttgaaaacgtacaataaattgttgttaactagaatcaccctatagtgctttagaacgctaaaacttattccttctatccagctgtaattctgtatccattaaccaaccttttcctgtgccctgcccccacccttcccagcctctaataaccacaattctactctctgcatctatgcactcaacttttttagcttttacatatgagtgagaatatgtggtatttatctttctgtacctggcttatttcactttacataatgtcctctagactcatccatgttgctgtgaatgacaggatttcatgctttattatggtagaatagtattgatacatggattgaggatgcctcaagcctgtgtttgcctcagctctagtcaatgattggagcattgcctatcccaaatgggaaatgtcgcaaaggggatattctggcagtgtgggaggctagcaagggttcatgcccaggagatgtatggaacatacctcctacagtgtggtcctgctgaacagatgccattctgatttggcatttccttcagtcaggttaaagagctgtctcccctgtttgtctctggctgtcctctgatatatttttcccttcaggcactcaaagtagctgctttctgtgggttgaggcagaaactgtcctcttaccagggaacttaagatgttggggaagttggttgttcaccttgatcttactttttccattgtagaaaccatgagtctggggaggttttctgcacttgtggtgctgggaaggttgaggggaggggcattgtggctatggaagtctgattttcttactctctgtttagagttttttcacttctctctggctccaggaactgtctcatctttatatttgagttctgggctattgctggtgataatcttggtgctgtgtatttgtttttgtttttgtatatcttggggttccgggggacagtgccaccagcttgcttctatgccgccattttttttttttttttgagacagagtcttactctgttgtccaggctggagtgcaatggcgtgatctcagctcactgcaacctctgcctcccgggttcaagcaattcttcttactcagccacccaagtagctgggattacaggtacgtgccattacgcctggctaacttttgtatttttagtagagacggggtttcagcattttggccagcatggtctcgaactcctgacttcaggtgatccacccacctgtgctgcccaagctgttgggattacaggcgtgagccactgcacctggcctatgccaccattttgaaaacaaaaacctttttatcattttgatgtaggcattattgctataaacttttctcttagtactgcttttgctgtatttcacgggttttaatatgttgtgcttctattttcatttgtttcaagaattttttggattttcttcttaatttcttccttgactccatttgtcattcaggtgcatgttgtttaatttccatgtatttgtagaatttccaaagtttctcttgtgattgatttctaattttagtccactgtggtctaaaaagatacttggtatgatttctattttaaaaaattcgttgagacttgttttgtgtctaacgtatggtttatcatggagaatattccatgtgctgatgagaagagcatgtattctgcagtagttgaatgaaatattctgtaaatgttaattaggtcaaattgttccatagtatagtttatgtccaagaattctttgttgatttttctgtctacaggatctgtgcaatactgagtgtgaggtgttgaagtcctcaactattattataatggaatttatctctcttgttatctctaacaatatttgctttatgtatctgggtgtgttggatacatatatatttacaattgttatatcctcttattgaattgttcttttcatcattatataatcacctttttcatctttttcttacttaaaatttagcttgttttctaagtatagctagttctgcttgattttggcttttgtttgctgaaattatctttttctatctgttcacattcagtctatgtgtctttacaggtgaagttgatttcttataggcagcatatagttgagtttttaaaaaaaatccatttagccactaattggagagcttagaccatttacattcaatgttattactgataagtaagatcttgttattgccattttgttgtttgtttgtggtggcatcagtagagcaggcatttgagacagaaaaatatcccctactaagtgtgggtctacgggggttgaccttggagagaaatgtattttcagtctatattttttaattgaggaatttaaactatttacattcaaggttgttattcataagtgaggacttactcctttcattttggtaattgttttctggtttttaatatatcatttgttccttttttcctctcttattgtttatcttcgcagtttgcagtttggtgatttttgtagtgataacatttgattcctttctctttcccatttgtgtatctgctttaatagtgagttttaactttcatgtgttttcattctggtaaatatctttttgcttctagatgtaggactcaaacatttcttcttgcgcttgtctaagggtgttgagttccctcagtttttgcttgtctgggaaaaagaataactttgttggctgtgtattgttgataggcattttttttttcccttttagcactttgaatcccattctctcctaacctgtaaggtttctcttgagaaatccactgttaatctgatggaagttcacttatatgtgactttatgcttttcttttgctgtttttagaattctctttttgtctttgacttttgacttttagactataatgtgcctgagagaggttttttgggttgaaactgtttggggatctttgagcttcctgtctctgtctgtctatatctctcacaagacttgggacattttcaactagtatttcattgaataggattttaatgtgttttccatcccttttccttctgtaacttccagtaatgcaaatatttgttcacttaatggtgtacctatgccacatagactttcttcattattttttcttttttggactgggttatttcaagagacctgttttcaggtttagaaattatttcttctgcatgatctagtctattgttgaagctctcaataatgtttttaattttattaattgaattcttcagttccaagacttaaccttggttctttttcttatatttatttctttgctgactttcttattcagatcatgattttttcttatttcattgaattatctcttttatttcattgagtttccttaagatcatgatttgaattctttgtcaagcatttcatagaggtccttttctttgggatttgttactgaagttttattgtgttcctgtggaggtgtacttgcttttttcatgtgtcttgtgtccctacatttgtatctgtacatctgttgaaacaaacacttcttccaattttatgaaaccgcttttgtagggaaagactttttcctgtagatatggcctatattgttgattgggtagggtgttttggctttggttctgggagggtaccgttgtgtagtctctgtatgatttctttagctgtaatcaatgttagcagtatctgtgagtacttcagtggcctagggtgtggtgttttgtggaggctgtggtgtggctttgctggggatggagatgcatggcaggctgttccttgggcctctggtgacacatgcagagatgaggtggtcccaccactggaagtggggtcagactgccagtggtcatggcagaaggccatgagtaggtggctgtcaggctctggggagcatgcactttcagtctcaggaagtgagtttgcctcagcataaatttcctctctggaataatgaggtcacatggactccaggcagctcattatactgcgcttgtgtcctgtaagggctgtggtctcctgtagctaactttataggtgtccatgatatgactgtggactgttagggatctcccacttacctttttccttcagtgggaagtctctctttgctccaagctgatcctggctgactgctttgctttcctttctatgctgccttcctgagtttttgcatctcagaaggtctttgtcacttccttgctgaattccagtgttcctccctagacactgtttgatgtgtggttatttgttgttttggtccttctttggggtagagatgagtgttggttgcctttagttagccatcttgatgatgtttgctacttagttaagtttttgtgtccttttcaaagagggacacagcatctattcgggccatcaaaagaatctcccactttgctgtcctatcccattcagagagcctgagttcacttcctggctcctactgggtggtgttttcaatgcagcttcctgaaaccttccagctggagaatttagatcctctcagggagccaacacaccaaaatttaaatttgatcatcttccctttctgggtctttggcccttataacatgagagaattgttcaccagattttaaaattcttttctttaaggaagcagacagtagatacagtgtttatgacagcaaagcacacttggaaccttctctgcccttgctagagtctgagtggcacatcaatcttgtttatgaccagttctgtcccactggaagaaaattaggggcacagtctctcgctgaactctgagctgggtctgaggagttcccttaggaagattaagaaaccgacttagtcccattccactctcaggaatctgttgctgggtttgaggctttcttcaccactattggctccctgttctgccctggtggcttggctcggagctccattacttgttcttgcttcctgggaacaaagattgaggcagccctgaggattctgataaagtctcatattttttagagattcttggcaacaaattcttctcattaggacttgattcatgagcttctagacctccaagctgtgttccatcacctttggtagatagcccactgtaaatgttttcccaatctgaacagacaggctgaatgtatctgttcttttataaatacaaggtttaaaattcaacataccaatcccagcaatttaccatttgccacatattttctttgtagcagtgagatagtttgtaagtgaaaggaatctctttgttttaaagggagatcactttgttttaaacattgatatttacttaatcaatgtaatgtccccattttataaaatgtttaatggtctacagaatatattattttgagcaatatgcttatgtaacttataattatgtatacatatatatcaaaaaaattctactagtatgatccatgatcaatacttccctttcccaacttcttgttttgaaaatatttaattgttttgaaaaatgtctaagctgtagaaaatggcaggaatagtataatggatactcttttacccttcacacagattgttaatattttactgattactatattttgcctggagagagagagatgttttatttttgccaaagcatgtgagagtaagtagcaaacatcatgacacttcacccctcaaatattttcccacgtatcacttaagaacaagggcattcattctgttacatgaccacaatacaatcagcacagatagatattaacattgagacaatgctctgatgtattggtatctactatgcagttcataatcaaataagggttttggtaacttgggatccataaatggtctgcaaggtcagcccctgtagacctgcacttagtgggtgccatttccctgtctcaggtgcctgctctactggtgatatttttcactggctctgttgctcacttagaattttttctcccagctgttgacattttattttctgcatagttctgaagctgcagcagttgttcttatgccttcttgattgtaaatttcatagaagctgtcaatttctaagggatttcatctcctttgatgcagccaggtcaatagctacaaacctatctgagaatgtctgccatcggcctcctctctgtctagaaaggtgtcttagtctctcagcactttgggaggttgaggtgggcggatcacaaggtgagaagatcaagaacatcttggccaacatggtgaaaccccgtctctactaaaaatacaaaaattagccaggagtggtggcgtgcgcctgcagtccagctactctggaggctgaggcaggggaatcgcttgaacccgggaggcggaggttgcagtgagccgagattgtgccacttcactccagtctgggtgacaagagcagaaccccatctgaaaaaaaaaaagaaagaaagttatcttagtctattaaggctgccataacaaaataccataaacgggatggcttataagcaacagaaatttcttacagttctagaggctgggaagttaaaaatcaaggtgccagcagatttgatgtctggtgagagcatgcttccttgttcatagatgatgccttcttgctgtgtcttcacatggtagaaggggtgaggcagctctctggggcctcttctataagagcactaatcccattcaagatggctctgccttcataacctaagcaacttccagaggtcccacttcttaatatcatcattgtggaggttagaatttcaacatatgaatttaggaggacacaaacattcagactgtagcaaaagaagttttgtgccttaagaagttctatgggttatagtaggtaaaaactgtttttgtttttgtttttttgcgacggagtctcactcttgtcacccaggctggagtgaatggtgtggtctctgctcactgcaacttccacctcctgggttcaagtgattctcctgcctcagcctcctgagtagccgggagtacaggcccccgccaccacaaccagctaatttttgcatttttaatagagatggggtttcactatcttggccaggctggtctcgaactcctgacctcgtgatccacccgccttgttctcccaaagtgctgggattacaggtatgagccactgcgcctggccaaaactggtttctagtttatgagttcagcagatatttgactctggattcctcaatttagtgatatcacacaaaatggtataaataaatctgattttttccatctggacatctatatcccaagcagtcacatctcctctagatcatgtcctaatcttagaacagttgctcccattcctcagactttctagtgggatagtgagagccttcagagtgtagaacaggctcacttgtgccattattcagatgctcagccacagtgaagatgcactctatgcccaaccgtagggagagatttcaatctctgacagtagtctccacatgtcatcaacgtaagtcatagtcatctcaaagcccttcagcaatacataatcaggaatcgagcaactaaataacagttgtttgttttattatcatcagtaaaaaaatacaaagaaattcattcattggggcagcaacattctcattcccctttctctctcattacattgctgcacaacaccaatgccttctcacagttccctcttgcatgattctaggtttcgtcaggaaggctttcctgcagcctagttagcatagacttcatttttctccccacttctctctcagctgtttaccgtgtaggtcagtttagcctccctggcttgcttccttcctgacaatctccccctttacccaaattctaccctagaagcaattagataaaaatagatgcatcaagaaaacatcttttcttcttaggaaagaagggatgggagggaaggaagaaaacagcaaatacttattatttggtgtcttttattctgttactttcttacttgtttttttttaatgatctaaccacaaaacgaaaacacaaaataatgctttttctttgagaatatacctgaacagtttacctcaattgtcaggaagcgcaagactaaattcagagctgtactggtctttgtttgctttgtttgctctttgtctattcattccttactgatatgtttatttatttatttcaggttaatttattttgatccttttaaagagcttccttgtaaatgcactttcaaataagagttttattaagatacagttgatataccataaaattcactttttaaaagtgtacaatttaggctgggtgcactgtattcccaacagtttgggaggctgaggcgagaggatcacttgaggccaggggtccaagaccagcctggccagcatggcaataccatatctctactaaaaatacaaaaattagcgggcatggtggcgcacacctgtaatcccagctactggggaagctgaggcacaagaattgctcgaaaccagaaagcagaggttgcggtgagctgagattgtgccactgcactccagcctgggtgacagagcaagaccctgtctcaaaaaaagtgtacaatttagtgatttttagtatatgcacatatatagcaaatggcaccactatcatatttcaaaacattttcatcccctccaagagaaaccctgtacccataagtggttgctccccattctgtcctcctactagcccctggccttttctggatctttcatataaatgggataatagaatatgtgtttttttgcaattggcttctttcccttagcatgatgttttcaaggtttacctatgtggtagcatgtcccagtactctattcttttttactgctgaatgatattccattgtatggctataccacattttgtttttccatttgccagctgatggcatttgggttgtttctactttttggtgattacgaataatgcttctatgaacatttgtgtacagtttctgtgtgggcataagttttcagttctcttgcccatacgcctaggaatggaattgctgggtcatgtggtaattctatgtttaatattttaaaaactggcaaactattttccacagtagccacatcattttacatacctaccagtagtgtatgagagttctagcttcctcacatccttgctaacacttgtgattgtctgtcttttttattttagccatcctttgatatttttaatgatcagtgaaaacaatttgtgtctgtgtgaagttgcttcaaattcttttttttattgtggtaaaataaaaataacataatatatatcattttacccattattaagtgtacaattccatggtgttaagtacattcacagtgttgtgcaaccattatcactatccacatctagaatttttctatcatctcagactgaaactttgtgcccatcagacaatagctctcatttctcctcttccccagcccctggtgacttctatcttacatacaattcctatgaattagcctattctacgtacttcatataagtggaattataaaatattagtccttttgtgtctggcttattttacttaggatgttttcaaggctcatccatgttgtagttgtagtatgtgtcagaatttcattcattttttttttcttgagactgagtctcgctctgttgcccaggctggagtgcaatggcgcaatcttgactcactgcaacctctgcctcctgggttcaagcaattctcctgcctcagcctcccgagtagctgggattacaggtgcctgccaccatggctggctaacttttgtatttttttttttttttttgttagtagagatggtgtttcaccatgttggccaggctgatctcgaactcctgacctcaggtgatctggccggctgggataataggcatgagccaccacatctggccttaaattctttttgtaagtaactctggcctaatcttaagtaataagctaatacggagaatgtgcctcaccctccagcatactgtgtgttttggctttaagatcttgggacagcttctcagaggaagacaccactcctccccacagttgcagctgttcacctcccagactcactggtaaagttagaagacgcttctgaaaaactgcccatctatattttcctcacagcagttgtgaagacttgctgaggtggatttaaggtggggctctcatgggatacagcattagaagaggggacattttgctcttcctaatgtttatataccagcaatgtcccattggtcagggcagaaagttgaaggtgcttttgcttatggacctcatagagtgtgtgtgcacataccagcaggcttaattttaaaatctgaccccagaattatgctgtctacagttttatctcattgatttttcaaataagggtactctaatgtgttgtttttagctgtaactgtcttaagacatgtttgtccagcacatatgcttagcaaaatctctaactgtttgggatgaactccattctttattcataaaaagggtatgaagtgaattccattgacttctgatttgtcatgtttatacagttttcctaactaaatacaaaaggagttatcagcattctcttgactttctagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcaggtgggtctaaatctggtgatgaaaccttgtttaggaaatgacaggacaattcaagagcttgatattaatacttattcatgcatttctttttaaaaaagtttggactgtttcatgaatttgtatgtcatcgttttacgagggccgtgctaattttctctgtatcgttccaatgttaacacatgtgctcccgaagcgagaactagtcacatatttattcaaaagcaatttacaaagctttctatatcttttcaacatatccacctgcccctccagcatctttttggcattcaagtaaccactatgatttaccccgctaagaaaaattattcacatttccatggcacaaattgtaggaaaggaaaagacattcttattcaagcagcggaagggttttggtgaaaaaacaggttctggttctggggaggtttttgttatgttaggtgatcgcctctgaagtttgcatcatcatagagctcttaacgttaaccagggctttggcctcaggagggaagccttatctgtagcagagatcagttgcaggaaacagccccaaatctcaaacagtggcacccagacttgatggccgaccaggcacagatgtaagccataaaaaagtactcatttgcttgctggctacaagaaggagcattttatctagtgagtccatcaggaggtcaggcgtaaagaaacatgtaccgggcagcttgacctccattgcttttggcttttgtctctttctccttttgaagctcaaaagggcatagagtggactctgatcctaggatttttttttccctgctttggctgcctctgttttggttcatgtgtcaagcagagacggggaaagccaaacgacacaatgagcgttctcagaaaggaaacttcttcggaatgaaaagctttggccacattggaaagggtagaagtctgagagaaactttttcatcagggagactaggtcggtgtcttagtcctttcaggctgctgtaacaaagtaccatctactgggtggcttataaataatagaaatctctttctcacagttctggaggctgagaagtccaagatcaaagtgtctggtgagcacagcacagcttcctggttcagagtcagccccttcttgctgtgtcctcacatggtggaaggagcaaggcagctctccggggcctcttttataagggcactaatcttattcatgagggctccaccctcatgatctaatcacccaccaaaggccccacctcctaatagcttcacattggtcattagatttcaacataagaattttgaggggtcataaaattcaaactgtaatagctaaaaaccattcccaaattggactctgcaagggaagcgggttgcagagcaaatgagcctggggtgggactgtttgggtggcattctcttggatgtaactgtattcagtttggatcatcccttttctaaaatggagggtgcctttaatgaggtgttggccagatgccctgatttatctgcttttgcattaacctagaaccacagaaaccagcctatgagaatttgaagggatatgaggcatatttcaaccattgtccccagcccctacttttctttcttcaatggacaaatagaagtcccagagcagtcccatggaatatggcttgtgaaatggcaatctgtgtgacatgacttgatagtaatttagaagtcctcctgttttcattagcttatactttcttgctgtttgttctttttttttttttttttttttttttttttttttttttttttttttagtgtaagaggttatcagccagctaaaatcccaaagcatgtttaccatccatgggcacaaccccaccaacatttgtttagttcttcctagtatgcagagcacacacacagtcaccatttcatgtgatctgaatttcagggcagcccttcgacgtaggtgtatggttaatcccaacctggagatgagaaaatgaaggcttagtgaggtctgggtctcattcatggttacttaacttggattcttgacttagtagccaataccacatcagttggctcatcagaaaagtgattgtgaaatctctgaaggttggcagttgatgtgacttatctggaatctggtattttataagtgagagaactaggaagagagtagataatttccctacctcatgcaaacctgggttttctacaggttttttgtttgttgcatttggctcagcagtagttgatacattttgttctcccagttaatgagtttctgtttgatattgcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgcctattatttcatttactagcattttaggatccagaagaattccaccagattgcatgagttagattgggaaatgggagtgggagataatattgggaggtatctattttaagtcaggggctttactagccgatttagttctcacaataaccatgtggagaagctgtgacatttttaatttacaacctttctggggctcagacataaagttacctatccaaggttgcagttgggtagtggtgggaccaggatggacaactcattggccctgcctcaaaagccatacctcttctcctgctatgcagaatctgtttctcctgaatctctgtgatgctggtgggaattgtttgcatagaggaaggacaataaccctgccatcgtgagttaatgtccgggctggtcacagtggttcatgcctgtaatcccagcactttgggagtccaaggcaggcatatcatttgaggtcaggagtttaagaccagcctggctaacatagtgagaccctgtttctactaaaaatacaaaaataagccaggtgtggtggtgcatgactgtaatcccaactactcagcaggagaagcacttgaacccaggagacggaggcggcagtgagccaagattgtgccactgcactccagcctgggcgacagagtgaaactacatctcagaaaaaaaaaaaaaaaaaaaaaaaaaaagttaatgtccaaaaatgacagatttacaagtgtaagctatatgatttcttcaaaaagcaaaagcaatatacctaattcatttggatcaaacttacataggtctcaggtcctgtaagaaacttgcctgttctaactgttgctaccagattatatctggtggtaattgttaatgtttcagcagggctggtctcagtcctttaaaatggaaagctttatttggagcccaaccctataagatgaagaaatcctatatagtcttattcaccaatatatccaatacacccacagcaatggtacctttttaagatcaggattttattatgaattcctgtcactttctgttttccatttaaatttctattttacaaatttttcagggaatcatattcttaacttcactgagaaaaatgtgttactcttttggacaatttatcttatttctatcatataagatgtatttttttattgtccttaaaagaagctctagcatgaaattaaaggaaagggaaagaaatagatctggtgcacccgaacattaggagaaaatgaaaaatatacaaccaaccgttcgtgagtcatcaaaaagtcaaagtcagcctggccaacatggcaaaactccgtctctgcaaaaaatacaaaaatgagcccggtatgttggcatatgcctgtaatcccagctactcgagaggctgagacacgaaaattgcttgaacctgggaggcggaggttgcaatgagccgagatcgcgctactgcactccagcctgggcaacagagagagaccttgtctcaaaaaacaacaacaacaaaaagtcaaagtcataataagcaaattattggcttctttcttctagactaaaagaaattaaagagatgaaacaatcaattgcaagggtcaaaactagattggatcttggtttgaatgaaaaaaagcataaaatattcttgcaataattgtaaaaatttgaatgtggactaagtcctagattatattaaaatatttttaattttttaagcttgacaaatgcactgattgttatactttaaataactaaaaatctgagaatccacagtgctacagacaataagtgataaaatgggaaaaaatagtgaagatcttcttttaggaaaactaccaataaatgtagaatggatgattccaaaaaaaaaaaaaaaaaagaagaaagagagaaagaaagaaacagaaaaacctaaaagaaagcgaatgaatttgacacctgttggttggatgacagaccacacagagggagagtgaccaggctttgcttgtggagcgggcatccctgcctagctatctccttcatgtgcaaggacagtataagtagtattttgcatgtgagtaaacacacctgcgcagccctggctgaggtcactaggctggccagaggcaggacaggcagtcttgaatttcctctaggggaggcctgcagttttccccaccaaccccttttcacatgctccaaagatgtagtagtgtctgctgttttggatcgaaaatcaccttgagtggaggaagtgacttcactgggtctctggaggctctcggagcttgagtggctctgccccaccctgaatcatgcacccataaatgcagttatgggtggatgtgggtgtatgagagtggagattgtttttgtacattctctttgttttcattttccaaatataatctttaataaacttgatttagtttcttgggaaatttattttctacgctattcaaagatattttaaataatattttaaaaacatgaaatttttttttcatttttgatttgatatcattaattttatatcaggattcatgtaagagactaaaaatgatccatagtggttagtactgtaatttctgtttattacatgaaattacattccatttatccaaatatatgtttatataatatttccactgtgtgactctagtgatctttaacatacacagaatgatctacagtgatctttaacatactcagaaatatgaaaaatgtttgaatatgatctttagggacttctaatgaaaagggtatatgaaatgggaacaataaattctgtacatgtatacagtccatatacacattaagtgtttgtcatttggacaaattgaaaacttttaataaagccattttcttctttgttaaaatgccagttggttgttggatttccctttatggcaatcattccagagttggcaggccagctttgaatttttaggttagattttgttcttctataatatccatgtatattttatgctgtccaataaaatgcactaggttgatatgatttttacataaggctttaaaatatttaatactaactcttctgtcaaatacacttgagtgatagtgattttgcactgaggttattattctggtcactgtctgagacatctaaatcgatgcataaaaacatctcatttagggaaaacaatttaagcttgacctatctaaaatttccagttttaccttacagtctgttttacaggttaacagcaagtgattcaaggtccaggggtggcaggctgaagctgttaaagaaatctacattattgatattgtcataatacttacgactcagaaatggagtctcattttaactggggaagcatttcatggttatgtagcctttggcttggaaagtctcacccagttgatgcagtagtgattttatccacattattggacacttcacttagcttctcattagcaagtggggtctgtatgcttctctttccgctatgtgcttccataccgtattcctctgcctttgtataaacacatggttcatttgaggctcctgctagctgatagatggataactttcttctagacctcattggggttacctactaaaagcctatctattctccctgctttagacttttgcaagtggttcataggtgtcttcactacccccaccgggtgctgccttcatcttgggtagctttaatgcccataaagccaactcatgtgacatcatacctttttttttttttttttcttttttgagacagagtctcactgtgtcaccaggctggagtgcagtggtgcgatcttggctcactgcaacctccgcctcctgggttcaagcgattctcctgcctcagcctcccgagcaactgggactacaggcacgtgccaccattcccggctaatttttgtatttttagtagagatggagtttcaccatgttggccaggatggtctcgatctcttgacctggtgatctgcctgcctcggcctcccaaagtgccaggattacaggcatgacccaccacacctggcctatatctttagttccttggccttctcagtgcccatacttttacctcctgttgtttcagccactcacatcctagactgcagcttatagtaatccaatttagactaccttaagctgaaaggagaattttgggggcttgcttgaaagattcaggggtagactagcttcagctttgttagatccaggggttcagaattggtgtctgaattctttctgcttctatccatctctcatgttgacttgattttgcttgtctttgcatgttggcctgactttttccttccgcacatgggttcctccatgctaccagaagagatgatcacaagcagttgcatgattgttacaactcatgtggtcaggcacgtggctcacacctgtaatctcagcactttggaaggctgagaagggcggattgcttgagctcaagagttcaagaccattctgggcaaaaaaacagaacaaaacaaacaaacaaaaccaaaaaaacccaccatgagtcgagaaaaagagacaccccctgtctccaagtgtccatgccaaaaatattagccgagaggctgatcatctcttccaggtcatatacgtatccttgaaccaatcactgtagccaggtggatgaactcactcaccagcctgcattccatgccaaccactgttagtgaggttggggtcgggtgacgctctaggattacctgttcaaccaggaccacatgtaatgacagagggaaagttccccaaaggaagggcagctggtgagacacacacacacacacacacacacacacacacacacacacacttctgtgacacgtggcctgtcaggactaacacctagaacttatgcatctctgaaatcttaactaaaaagctctacaacctcttaccatcccaaacctttatctcttactcccaaatagctgtgctttgagcctttgagcctttgcgtttccctggtcctcctattttctccctcccagtcttgcccatcctcgttccatctggagccagcctagatattaaggttcatttcttcaatcattctcttcctaacacctttaactcgttgttcccttgcccttctgtcctcgactttgaattactcccaactatcaatgtttctgctgcttttcctgccccactgaatgaagctggagaaaatcacatgaaatcacagctaagtggcatcccaaattcatggtttttgatcttatctgagcctcctgtcctaactggtaaagctgcactgttttccctgttacatctcactgttattttccaaaatgatttttgcaaatattcttttttcctttgaggctctcatcctgtgtcttccctcttcaccctcagcagacaatctcatctcctatttcacccagtaaatagaagtcattataggaaacaccttcaatatcacatcctaatacagccttatatgtgtccacacccccccttccctccttgcctctccctgtctcagctattttctctacctgggcacttgcatccacagcaacttagccccatcaattgttttcctctctttccagtgttgtcaacctcaccttcataaatgacttatttccatcagcatttaaaaatgttcaaatctctctcatctcaaagacatccctctctctactccacagcaacttctcctcagagccctacctctgtcttcttctccccagttgagccccttggaagtgtcctgtatatgctgtctttctggtctcaccttttattcatgccatcatccgttcaacctggcttttttcttcattcttccagtgttctcatttttgtgagcaaatctgtgttacttttaaagtgcttatcttcaaaggcatggtatcaacccaaatgcccatcagtgaaaaactgggtaaagaaaatgtggtacatatacaccatggaatactatgcagccataaaaaggagtgagatcatgtcctttgcagggatgtgggtggagctggaaaccatcgtcctcagcaaactaacacagaaacagaaaactaaacactgcatgttctcacttataaatgagagctgaatgatgagaacacaagggactcagtttgaaggcacaagagggttttctctgatatcctaaggctggggtaggtaacccaactgggggtttccatggcatcttgtgtgtagctagaccaacgcttatttacaacaacttcccatagtagcatctccttttgtggacaaagaaaccctgagactcggagaaatgaagcttacagccacctaaggtaaaatagaaatctactctgtgttacttcaaagtccacatgattcacatcgagccacgctgcctcctgtaggcttgttcatcacatgtctagtgcttggcccatagttggtgagcatttgttgaatgtctgactgaatcagctgatagaatggagtttgaatattcaggtggattggatcctcctctctttatggaccaggacttttaaccattatctgtatagagatttgaatggattctcaatgcataatttacgtaattacaaagtgggcaggtgaccaataatgataatagcttacagatgtattataactcttactacaatgttctcacatacattactttttttgatctccacaataattctgatagggcaggcatggttattcctaggaaatgaagaaagaaagagtgagagaaagagagagagagagaagagaaagagaaagagaaagagagagagagcgcgagagagaatgaatgaattagccgaactgagaacaggctccaggtttcctaactcctggtcccatgaactttccatttcacaaagctactttccctgcaatcccttgggtaatcctgtggttaattcttgacttagcagaaagtagggaagaggtagtataaaaaaaagccactattcaagtggtaacgaacaataaatataaaaggagagattgcacccgctgttgatctggaaattgaaaatagggtcaaagcctggactcatgctctctggctccagactcactatgttctatcagaaaatcacgcgtagctggagtattgctaagtggaagaggggttttgttgttgctaccatgctgaaagtcatttacatactcagaacaacacctttccagttttcctataggactgtgaatgtcttcccaaggcatttaggaagctataaagaaatgataaagaggaatgcttgtctgtgctcagcagcagatgtcgtggtgtaccccagtcctgctgtaggactgaagcacttgttctctagctgcccagagcaaatgacttctgacaagccacatctgggtcccttccaagttcttgcccttggatgaagggagctatctcatcctgggtcgcagaccctttccaagggcaactctcatccagtggctagccagtgaaggggtacacagccatggcccttttccctccatgcaggaccactctgaagggtcatctcagtttccaaacccctcctttcttgtaagattggggaggcctctgttgcaactgcatgtcagggcagccagtccctccccatcctgctcttttactttcttgcaggtttagctcctgagtgtgcgattcgactaaacttctgcatccaaatctccatctcagagtcttccagaaaacctacaacagattaattccttctctctgcaattggttatgaagatactcagccatttttgtgacttccatcatatggttttatcaatctgtcagtcataagtactttttgatcacttggtgctagaggagtcacaaaacccaaaaacaacaaaataaaccccaaaatatctgtgttcagttttcagcttcttttcagaattatccaatagaaatttataactgagttccagtataatgttgagtaccagaaaaatatttagttttttctttcctgttaattgcaacagggtacagtaccagaataggtgctactcctagtggcttaagcaataagggatttatttatttttattttttatgtttttttgagacagagtttcgctcttgttgcccaggctggagtgcaatggcatgatctcggttcactgcaggctccacctcgcaggttcacgtgattctcctgcctcagcctcccaagtagctgggattacagtcatgcaccactatgcccaggtaattttgtacttttagtagagacagggtttcaccgtattggtcaggtcaggctggtctcaatctgctgacctcagatgacccacctgcctcagcctcccaaagtgctggcatgagccacctcacccggcctaagaagggatttattatagggtactaggtggcttacagaatcatgtgagggctgaagaaatgaacttgaggttgagctttccacagaaattcccaaaggcccaccacagaactaaaccaccaagagagctgctgctgctacgcctaggtggatgcagaattgcattgatacgaccctaatcctgaagccaccgctttcagggtgccttccctcctactgctaattctagaaccctactgcacctgctgctatctggaccacaaaatgtgtgccttttaccctgcctctcaggaaccacagaatagtgaccatattctgcatcctctgctaatgatgccacagaagtccaagagcatccatcagaaatagctgtggcagtagaggtgtgaccactgccatcgtccacatctcacactcgggcatctaatggctaaatccaaatcacatctggaatcctttctcaagggattcctggaatcatagcattcagcttcccaatgatggaggtacagaaaggcatgctggaagagtgttttccaaaagttctgacatattctactgtagaatcattttcctcacacatacatacagtcacatacgcatctacctgaaataaaagattcacaagacagttgaggcaccctgatggtttcaattctagtctatgctgagcagtgctatgctattccatgctatttcattccattaagaaatgctggtcttgacccactaagttggtttcgtgatggactaatggacgataactggcagtttggaaaaacacttcacaacaagaagggagaaatggatgttgagtgccaatccacaatatctacgatactattttatactattccttcccctgtcctgaattgacagaaagaattcaaggctgctcacagaagggactcagtgatatgataaactgcatagtgaactgaggatcaaaagtagcttctagtccatggaccagcagtttatttgtttgtaaatgagagcgttgtgatagttctgtgttgtaatgaccggattgacacctacctagtaggaaaactgagggaaatgttgaccagtctataccttgtaccttttactagaggatggattaagcccacgagggagttttgatggcaaatgcactatggtgtgcctttagaagcaactgttgtactcctgaaaaatattagttggctttagtccagttcctggttttgcatgtaggtgtaaaactaatgattcattctgagagcatgggggtatatattgaatgtgagaagcatgactcattcacctgccccatgtttgaaaagcaattgttaattacactgttaacatttgttaagactttaatttcttcatgtagagcttttaggtaaaagcttatatttaccaataactggggctttcaatgagaacttttttcctgatgcagtgctggttggaaggtaattggtttcaaaaaagaaaagcccattgagaaggcagaacaaagaaacgtttaacacatgtttcatctgtgccaaatagtacaccaagcatttccatgcacaatcactcgtgtagtccttacaatagctcttaatgaagaaattatgattttcctttttgtagatgagggagaaaggcttaaagagattaaaagggattcacccaaggtcattaaactagaaagtgaaagcatggaattcacattcaattttggatgactcacacc

SEQ ID NO: 443 - DNA, 2341 bp, Homo sapiens
gtcatgagcctggactgcaccagccatatcgcgctgggtgccgcttcgccagcgcccgaggaaacttacgatcatctttcggaagtcccggtcacgcgggagcagttaaaccactatcggaatgtggctcaaaatgctcgaagtgaacttgcagcaactttggtcaaatttgaatgtgctcagtctgagcttcaagacctccgatccaagatgctttctaaagaagtctcctgtcaagaactgaaagctgaaatggagagctacaaggaaaacaatgccagaaaatcatctctccttacctctttgagagacagagttcaggaactagaagaagaatcagcagcactttccacttctaaaatcagaacagaaatcacagctcacgctgcaatcaaggagaaccaggaattaaagaagaaagttgtagagttaaatgaaaaattacaaaagtgttcaaaagaaaatgaggagaataagaaacaagtttcaaagaattgcaggaaacatgaggaatttctgactcaactgcgtgactgcttggatccagatgagaggaatgacaaggcatcagatgaagatttaattttaaagcttagagacctgcgcaaagaaaatgaattcgtgaaaggacaaattgttattcttgaagagactataaatgtccatgagatggaagcaaaagctagcagagaaacgatcatgaggctggcttcagaagtcaacagagagcagaaaaaagctgcctcctgtactgaagagaaagagaagctgaaccaggacctgctcagtgctgtagaagcaaaagaagctcttgaaagggaagttaagatcttccaagaaaggctgcttgctggccagcaggtctgggatgcctcaaagcaggaagtgagcctcctgaagaaaagctcttctgagttggagaagagtttgaaggccagtcaggatgcagtcacaacctcacaaagccagtactcctcatttagggagaaaatcgcagccctccttaggggcagattgagcatgactgggtccactgaggacaccattttggagaagattcgagaaatggacagccgggaagaaagcagggaccggatggtctcccagcttgaagcccaaatatctgagcttgttgaacagttgggaaaggagtctgggtttcaccagaaagctctccagagggcccagaaagcagagaatatgttggagactcttcagggtcagctgacacacctggaggcagagctggtttctggaggtgttttgcgagacaacttgaattttgagaaacaaaaatatcttaaatttctggatcagctttctcagaaaatgaagttggaccagatggctgccgaacttggctttgacatgcggctggacgtggttttagctcgaacagagcagctggttcgtcttgagagcaatgcagtcattgagaacaagaccattgcccacaatttgcagagaaagctaaagacacagaaagagagactggagagcaaagaattacacatgagcctcctccggcagaaaatagcccagctggaggaggagaagcaggcacgcacggccttggtggttgagagggacaacgcgcatcttaccatcaggaacttgcagaagaaggtggagaggctgcagaaagagctgaacacgtgtcgagacttgcacaccgagctcaaagccaaactggccgacaccaatgaactgaagattaaaactttggaacagactaaagccattgaagatctaaacaaatccagagaccaactggagaagatgaaggagaaagctgagaaaaagctcatgtctgtcaagtcagaactggataccacagaacatgaggctaaggagaataaagaaagggccagaaacatgatagaagtggtaaccagtgaaatgaagacactaaaaaaatctctggaagaagcagaaaagagagaaaagcagctggcagacttcagggaggtggtgtcgcagatgctaggcttgaacgtgaccagccttgctcttcctgattatgaaatcatcaagtgtcttgaaagattggtccattcacatcagcatcactttgttacctgtgcctgcctcaaagatgtgactactgggcaagagaggcacccacaaggccatttacagcttcttcattgaacactgtatctcttgagagaggtggccataagacatggcacacaattcccaatttcacaaattcctcatgtctttgagatttgatcagtttgtgaatattttatgctttgatgatatagtgagaatgcatcacttgcaaaaacgatctcaaaagtgtcagccttagataaacgttcagcattaaaaacgc

SEQ ID NO: 444 - protein, 715 aa, Homo sapiens [sequence omitted]

SEQ ID NO: 445 - DNA, 22644 bp, Mus musculus
  misc_feature (1)...(22644): n = A,T,C or G
gccactgtgtaggtgctgacaattgaattcagtcctctacaagaagaactaagccatctctccaacccttaggtttgacccttaattgaagtcagaaatctaaatctcatccttaagctattgacaactagttcaggtggggcacaatgatgcaggcagctcccaccgcggaaagatgaaaccagctaacagcacaaagaagggacctcagggaggggctgagccgggcctagggtacctgaggccagaggaggaggtctgaggccgcagcaggggaaagaggcaagggccatcccttggtgagctcagagtcaggctcaggctgcaatgagtctcatttccttccagacctctctcagacagaagacagcctgcaggggtcttcccggagcctgaatgtctcagaaaggtgagcagcacactggggacacccactggctggagaaccagagcctggaagtgacagagcagagtgtgactgtagcctctcacggccaggagtcacagcatttccaagagggtgggccagagcagagaagaatcccagaatctagggttcctccgacctctgtgctcaggttgtgtctgcccgcccatagcagtgtccccgtgaggaggaggccagcccgcaagatcctaagccaggtcacggtgctggcgttccaaggggacgcgttgctggaacagattggtgtcatcggtgggaacctcactgggatcttcattcaccgtgtcacccccggctctgcagcagatgagatggccctgcgccctggtacccagatcatgatggtgagcaagagagggaccctatgccagagccagcttcctggccaggggatatcatgccagagccaggcatcccagttggggtgggggtgtttggcaggagacagtggtctggctctgacgtggtctcaggtctgttctggattgatagaaaaaggtcatgggggcgggaacggagcccccttctcaaacctgacagtccagatcacccagagcctggaaactcagaaaatgccacggggatacagcagttctgaccttggtactgttctgggggtgaacctgggtagggtgtgtgtgtgtgtgtgtgtgtgtgtgtgagagagagagagagagagagagagaggtcgtatttgtcagacaagtgatctagcatcaagccacaccccagtcctgaccaggcttcctaagccatcctgatataatgcatttgaatgcattgtttgtttactatgatgatcttattgtcattttgtatgggtgcaagaaaaaacatattcatgacacaaaattcattttatctattctattggaaatggtcaaatctggatagcacacaaatatacatataaatgtaaaacatatattattcttattaagtgaatgcatgtgcatggcctaacagcataattttcttcaattatgtgtgtgcattcatatatgcattatggtatgcgtgtatgagtgtggctgcaactttggtttcgtgttctctccttccaccttgcctcgaggcaggctctctcttcagaaagacaattatttagttgggtgtggtggtgcacacctttaatcacagtacttaaaatcaaaggcgtgtgggtttctgtgaattgcaggccagcctgttctgcaaacggagactccgtctcaaacacatttatttatttacttacttatttgtctgcatgtcatagaacacgtgtggaggttaaagggcagcttgttggaactggttctatcctccctccatgtggattgaatgaggtcctcagcctttgggagtgagtgggaccttcactcactgagctgtggggctttctcctcctcctctccctcctcctcctctccctcctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggttttttttttgtttgtttgtttgtttgtttgtttgaaacaggtttttctgtcctgggaactcactctgtagaccaggctggcctggaactcagaaatccgcctgcctctgcctcccaagtgctgggattaaaggcgtgctccaccactgcctggcccatagtttttgttctttttgtttgtttattttattttatttgagacagggtttctctgcatagccctggctgtcctgaatctcactccatagaccaggctggtcttgaaattaaagagatccacctgcctctgcctccaagtgctggaataaaaagcgtgtgccaccactcctagctcttccatcttatttctgcctcttgcacgcccactctctggtgagtgggtttctgagctctgggtcatccccccttcccagctcacacctccatgtaaaagcagattgcagacacacagcacagtatccagcatccctgggttccgagggttgcttgtgtagcaaatgtctttacccaccaagtgtctcccagccccagaagcagaatcattaaacttcaaaccttttaaatgattttttaaattcaattttttattatgtgtattgatattttgctggcatgactgtgcatcatgtgtgtgccatggaagtctgaagaggtggttgtatgtctaggaactggagttaagttatgtggatgctgggaactgaaccctagtcctgtggaagagcagcttgtgccattaaacaccgagtcatctctccagtccctacttttatttttaattatgtgtatgtatgtgagagggacgtgtgcaaggtgcctgcagaggccagaatcaggcaacagacgccctgaagctggagtcatagacagttgtgagctgccatggaagtgctgggaacagaacttgagtcctctggaagagcaacaagtgatttaagccttttaaaaatatcaagaaaccatgccagatgattttcaccccacccctgaggctcacctgttggccctaatgagagaagggagcgggggcagaccacctgggcaggggcattcccttcagaaagggtgtccacagagaagcaagagtcactcattcttaaggagcctgcacacctacaaggactcctctctacatacagtcatggagagctctgtgatacttcagtcctaagactgaccggtcagcagaggagccatcataatgcagagatcccctaaggcatttgagaggcagtcctggggcaactctgaactgacagtccagcatgtatcatagtacacacatacactaacacagaagaacatggctccttaaacttaaccatgcaatgtgggaggcagcagggaatctgcaccttgtggggtttcacagctgtggaggtagggtggaacactctgcacctagagggaggaccagtgacaccactcaacaaccttgacacagccttgaacaactatgtcccaaacatacagaaccctgatctagaatgatccagaatgttctggaacctcctgaagcccatttttaacagaggaaagtggttatgacagagaggctgtcctcagcagtgaaagttcaggggtgggttgatgggcaactcttcaggccagaatgtgtacaatgtacatgttggcatcttgatgctgtaacaacactgttcctacattgtagctggtctttgctactttgtaggttcttctctttaggccaggaatgtgtagaatgcacatatgtgcatcttgatgctgtaacaacactatcccttatgttgtagctggtctttgctactttgtgggctcttcttttccccaccctttattcccctggcttcacaccttaacactagataggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtgtggggggtgtgtgtgtgtgtgtgtgtgtgtgtgatgagagagagagagagagagagagagagagagagatcacgatccctgaatttaatttctttccttttgtttcttctttgagcacaactactaacaaccaaccctccccaatggccaccaaccgctctcccacccacatatcagggctttagcctttataaactctctaaaaagtttccagaattccaaacatcacacaagtgcagaaactatctgcagctggcaaccccatgcttctcctagaacacgaggcaaatcttaagtcagctgctgcggacagtccgaagcagccccacatccccatacctgggattaaaacgaaaacacgttcttgtaatatttctgtgtttttaaagaaaccagaattccagaattctcacttcactacacacagcttgtgacaagggatttggataggccatgagagaagatatgtgggtggctgccgaaagccgagaggtcctctgaaggctcccacccccaccccacctcagctgccatcccatgttggtgagaagcccaccttcacactttgccctcaggtggactataaacctaccaagccatcattaagggccactctggagaatacaacgctggagcaggctgtgggccttctcaggagggtgaatggctcctgctacttgtctgtgaagatcaacactgaaggtacagacaccaccccacacctgctcagctctcagtcccctcctgtgaccctgctgtacctaccaggagccaaggcagttcagccagggtctccctaaattccccagactctaatgaactggaaacttccctccatcccactgggtgccttccataacttttccctctcccatctctacattctagaaccttccttgtgtaagctcagaggtcagggatcatcaaccactgacatcttcttcttttggggggattttccgagacagggtttctctgtgtagccctggctatcctggaactcactctgtagaacaggcaggcctcgaactcagaaatctgcttgcctctgcctcccaagtgctgggattaaaggcgtgtgccaccactgcccagccacttacatcttcttttatcaggttataagaacctcatccaggacctagatgccaaagtggtaacgtctggggattccttctacatccgtgtcaacctggccatgcagaggggaggggacggagaactgcaaactcactgcaatgacatcctgcatgtcactgacaccatgttccaaggccgcagctgctggcatgcccaccatgtgaacccctacaccatgaaagacatggagcctggcaccatccccaactattcacagtgagtagctgctgctggcactgcacaaccccgcagatgtcccaaggacaacatctgcctgtctcagttgagtgttgaggtccctccaccttccagaatcttcgctgcactatagcagagtgcctgcccaagataaagagtgaagaaaaggtttacttgagtgcatgggtctgctggtggtaggtgcctctctgttatgtgccctggcattagctccactgggaccagtgtagggcaattaaattagcatggcctggcctggcctgaggcctaggagatattttcaaggcctgagtctatgcgcccagggtggaacactcctgctccctgcctgtgtcacacttgtccttgaggaggctcagtcaggctgtcagagcctctcttccttcatttgctcagggctcagcagcagcttctggccctcatccaggacatgactcaacggtgcacagtcccccgcaaggtgaggctctggcagaagggtatggtgcccctggggtgggctggaagggagcggggtgctgtggaatcctgtgtgaggggtgtggaccactgagctgagcagggcactatctggaccctgtgttccccaccaagccctgtgggcctgcaggcccttggaatgggccgtgtgaacacaccggcctggtttcagagtggcccctgctcttcctcactttcccagtctcctgtcaccaacccaccccctgttcttgtttcctctgaggtcgggcaccttgttctcttgggacacagagcacctttcactttgagcacccatctgtccctgagcaaggtgctaggatatccctgcccggagcatggcaatgctaagtcgggagagggcctgctcttctctctgcctattgcaccctaccccttcctgcagagccctgctgcctgaggcccctcccctgcctctcacccctggtgtggggcctgggaagcccggttgctcatggcacagcctgattgttcagaggctgttctggatttgcttatgtggcagggtgctgaagcagggagggggtgtcaggccccaaacccagtactgatggctgagcctgctctctttcctgtccccctgttcctcccgtgacagcctcctggaggaccacagaagttagtacgaattgtcagtgtggacaaagccgctgtcagtcctctgacttcatcctttgaccaaagccagtgggattctggcaaggaggaaggtgaggcctggctggttggcatagggaccatgtgggcattgggggtcacttctgagcagtaccatcaaggtggtgtctctcactcgggccgggggctgttgtctgtttgtttagatgttttgcatgcatgcatgcatgcatgcatgcatgcatgtatgtatgtatgtatgtatgtatgaacgtacttatgtgtactattgacatgcagtgtccccggaggccagtagagggcatcagatccattgtgattgagttacaggtggttgtgagtcactatgtgggtaattggaattaaagtctgttgaagagcagccagtgctcttaacagcaaaaccatctctccaacatccccccaccccaggctgttttttacggatcataataaatatctacccaccttctgaacagcaactgagcatcacatttgatgtcttctaaatggccgtgccccactctgaggcccgacccagtgaaactatacaaaagctactagcccacaagtgtgtgcaggaacagtaaaacctaccaatcgcccagtgttctgtaaggaaggtcactaggtgaccagtgtatgcacgtggtcatgctagaggtctgactggtgtaagcccacgggtaacaactacagagtgaagctgatcagaagtgagtctggtagtagggaaataattcgttttctttaagacagtttggatgcctaatctaagctgggtactggggcctaggagatggctctgctgttaagaacacttactgcccttggagagggcccgggtttggttacaacacccaaattagacagcttacaaccacttgtaactccatcctacaggatccaatgctgtcttctagcctctgcaagcaatggtatgcgcgcacacacacacacacacacacacacaccaccaaaacatgtaaaagtaaaaataaaccttttcaaaaataaggttgatattgaaaacaggagctacctaaataacccagggtccaggagggaggaggctgaggacgctgtggcctgaggggcagggatgaacggcatggatgaggagggggaagagttggggtgaagggcaggaccctcacacccttcaggaggaaccaagctcctcctatcctcagaggttcattctgaagagctgtgagctctgtagcagctgtgccagcatgcacagttagcatagcagctgtgccagcatgcacagttagcatagcagctgtgccagcatgcagttagcagcactgaaattgagaatgccccccacaatcagtgtctcctgggagagagggggcagggacacaggtgggagatggtcacaacctctgtcctctgcaggtggtcctagcgtgtgcttctggtcagagagctgcttcaccctggcaccgtacaccctggtgcacccccacaggcctgcccggccccggcctgtgctgtttgtgcctagattagttggaaggatcctgggtaaaaagctgtgtctcctccaaggttttaagcaatgttcagcaggtacgtgctcctcagtcaagcgaccagagcaggggaccataaattcagagatactataactgagggccacagatgggacactgaatggtgacaactgtctcatggttcccaggatgtctgacctcagggcctcaccagagtcctgctctctgggggctgcaggtgtgggtccttcctggctcatccaacactttaggtgtgtgggaagtccccagtcccatcttggctttggtcatttcagaccagttcagtatgtgtgtctttgtctatacatgaccttcttaggggctatcataaccaagtattgtttcacataaagaccctacttccaaagaaagtccattttgggttcttatgggcatgagagagatgggacattacccctccctccaacacaggcacattgaaaacagatgccttagcagggcagcatggcttgagggttctgtcagttttctatcagccacgaggcagtttcattttatttatttatttgagccaaagtttctctgtatggctctgtagaccaggctggccttgaattcagagatccaacatggaggcttcatgaaagtgctttctagggctggtgagatggctcagtgggtaagagcacctgactgctcttcctgaaggtcccgagttcaaatcccagcaaccacatggtggctcacaaccatctgtaatgagatctgactccttcttctggagtgtctgaagacagctacagggtacttacatataataaataaatctttaaaaaaaaagaaagtgctttctaatatgcaggcccataggctcaggaaagactgacagggctaggttacctacactgtgagctgacagagttcatcctagtctcttgactttcagaaaagagagggaagcaggccccatccaagaggctcctccaacaaacaccttccttggctagcattcatgggaaagtggaagacactgagttctgggagcccatgagttcctctagaatcagctacctgggttcagtcgggcaaaccagggagacaaagctatatagactgcaggctctgcccttacccaaagaggaagggagacactgagacatgaagggccagctgacagagggcagaaggaagatggatggtagctagaggaggccaggtggttcagctggctagtgggcatatacaaagataaagggcacacagaacactgggatccagccactgctgtgctggccgaggagggtggaggccagatgtcctttcatagaagcctgggttttaacagggagggaggactcactgacgcttgatccttgaacatctttctaaagtagagtgcaagatggaaagcctggccagggctggagatgcactcactggaacttgggggcagatcaatgctgcagtgatggtgggggaggggactctgagaggtgtacagctcgggtgccttgacagacagaggctaggaggaagacagagcccttctaaccacgctggggccgtgagagcctgctcaggaaggctccagaattgttatcaacctcagcaccaggacacctgtggccaacattctctattgtgtagctgtcccgagcactgtaggatttttgacaggaccgctgatatacacacacaatagaaacactgcccagagtccacacatgccatgcccatggctcagtggtgtgataaggggaggttatcatatggtaaggggagggtctagaggctactctgggggtggcagcttctgcccaggcttggggagtcacttgtagggctctagatacccagcttcatgctctgtaggagggacacaggcacagggtgggtataccagcggacttgtggtcagaggtggtataggtttcccataaccacggtggaggcttctcctggatgtggtgggagacccccagtgttggggggctcagcagggctcactcaggatcccgatgtatgaccacctcatctaatgtcaccatcagagtacttgagccaggaggagtatgccacctggagtcagagaggggacatcatccaggagggagagtcaataggtgaccaccactggatcacccggcatgctgtggagtccctcatgaatatggtaaggggagggtctagaggctactctgggggtggcagctcctgcccaggcttggggagtcacttgtagggctctagatacccagcttcatgctctgtaggagggacacagaaagacccaagcctgttccccccgtttaaaatccatgtgatgctggcctcagttttcttaactagggatatttgattgatgttaataaaagaaataaatgaagacattaagactcagattttacagctctcagtaaaccatcaagtttcacacttccataaggaggagtaggaaggaaaacacacacacacacacacacacacacacacacacacagaggcacatgtgcatgcacacgggcacacacgcacaacggagggcaacagctggcactgtttgattcttaaggtttgtactccatgcaaaatctatctcaatgccaaaagcttgcaaatccagatttccccagggacaaatcaaatgggtttcacccttgaagatatacagcaggcgtcctggcacatgccacactgcctctgttcgggtgtcttccacacagccctgtgctctgctgcacagcttcctctcagtccctcccagacccgaggcccggggcttaacttgcttctctatgccctcccaaagagcacccacgccctgctggatgtgcggctggacagcgtccgagtcctacataggatggacatgtttcccattatcatccatgtctctgtcaatgagaagacagcaaagaaactcaggtagctgccaggggagggagggctgggcagggagagggtagcagggtccaaacaggtgcctgtgctccagaaaaagcttgtcatgtgcctctagcgcacactggagctctaagttccagccccagttgtgtccttgcaacctcaggccagaggtccagcttgctctcccccggagtggacctgtcccctgccctagttacaccaaagctgcgcagtgcctggggctcatgaagcctggtctcaccccatcacttggtgtctggctgggacaaacatcccactgcctatatcttctgggaagtacaatttctttggctcactccatcagtgaatgctgcttgcagccaagtccgtccttccttcatgacttccctggataggactcccatgctcgcgcccaagggtgcatgctgagtcttctgcagaccctggcctggatgacaacagtgtgctgtactaaagccaactgtgtgctttcctggctaccttgctgtcttcgagctgaacatctatctctgctttgtaggaagggcctgcatcggcttggcagctcggaggagcagttcctggaggtggcccggcaggaggagggagagctggacagagtgccgtgtctgtacagcagcctggcccccgacagctggagtgatctggacagcctgctcagctgtgtgcgcctggccattgcagatgagcagaagaaggtggtgtggacagagagcccctgctgaagcccagacctggcttgggactgtggggacctctgtgtgtctgtcaatgctgtcagcaaacaaccccacttccttctctggtcggggtctgacctcaggtgcccccagaaatcaaggtgtaaatgacgaagccaccttcacacagcatggcctgggctgatggaggaccggaaaatattctgccgtgtgggggtactccctgagacctgctcagagccagtgccccaacctcctgtgacaacaggaatagctttgtgggttctggcccttccttttatgtttctgatgtcaaaggaaccttgcaagctcgctggagcagtccttcctgcccagggcgggggcctgactctggagcaccgtgggcacagctgactcagctgctaacagccaagtgctgccacagacatctgcaaatgaaggtgctgtagtgcacagacttgagtggctctttgactcactgcctctgtgcctaaccccaaaccccaggttgctttggtgcatatcccagagccaactgacccttcatgagcaaagaactctctctcaaaactgacatttcccccagtccttcccaggctgcattgcgccacacttgggtgaagcccccatctagccataaactgagtcattttgacacggtgtttgtgtctcggtgcctaagatgcagtgtgctactatgaagttctgtgaatgattatactattgtaaaaaggattttccaacactagggcccataactctcactcccttccaagatggagttgacagaggggcaaaagggacagcccctctctttctagatttctaagcagtgcttctgtcccttggcaagtgaaggaagggaaaagatggagccaggtggtttgcttggtgtcactcagagagaatgaaaggagagagaggggggagagagagagggagagagagcgcacactgtcccaccctgtcctcctcagtcaccctcagaaaggagagcagagcccagatagaccacaggatcaaactcactcctctgagaacagcatgaaccctggctaagcatgtacctcagggggggagcatggaggcggaagcaagctcaaggcctactgaatgctctctccaggacaaggttggttgaagtagtcagtgcggtctgcccactgcccatgtggcacccagaaacctgagctcctcttagggtgaagggcttgaaaacatccacaggttcccgaaaccagagggcttcgagccccagaccctgctcctccatctgcagatctccaaactcacctatcaaaacttggggttctgccatgcccgagttccccctagagtctcctgagccaggacaggcagacatgaggacaacggtgtccttggtatggcagcaactagggagtgcgtgcttgagtgtcctctacaggaggcgggagtggcatcccatatggtagaggggcctcctaggatgggtatgtagaaggtgcagctgttggtactgcctccattgctccctccctccatgtccaggtgggctggcaggtgccccggggatggtcagagttcattgtgaagcggtcggcactggggtgtgagcttttcctccaggactccatctggggcgcacacccaggggtcatgtgtctcccattgccacttgacaagctgagctttcagcatctccagcacttgagccaagtctgggtcagcggccaggttccgtgtctctcgagggtcccggctgatgtcgtagagttcccagcgttcccggtagtagtaacggtggaggtccttgtaccagcccgtgggccggcctgtggtggttcggttcaggaggtcctggaaggtcggcgagacatagaaatcttggtcgatgggaaatggcatcttgaagctcaggttgtgaatgaggcggaagttctggtggtacaccgagcgcatcgggtaggacatggtgacctcgtggtggctctggctgctgaagacagtggcccaaaggggctctgcctccagcgccggcaggagggatcggcctgtgagctggatcgtctttgagccaaagatggcatagctggggtacgggatggagaaccagtccaggatggtaggggtgaggtctggaaaggaacaggctcttagtggggacacggacaggctcttagcaggggttcctggaagacatggagcccattgtaagggctggatctgagtctctcgggaaatcccatgggcactcgtaggatcggatcacctctggccagtgaggctgataacagtataaccagaggccctggcttgctgatatccaagaaccttctaaagtcctatggactagaggaaccctgggtagggagggctcatccactcagtctgggttggtcacaaggttccctcactcatgggttagggtcacaatggagaagcgagtcctgagctggagggagcctatcttgtagccactgagaagaacacagggactctttccaagcaggtgggctgggcacaaactcagtccctctgtttctcagcccctctgttcctcagcccctttgtctgtttctcacacctgcatgtatgcttgctcatctgtggtatggggccagataaccaggctctcagagctgagtcatgagaggctccagatcctgagaaaaggggaaatggttctcaagtgggcaacccacagttcatcggtcctgcctgggaccccaccagacactctggaggtcgtgacgtgacaagaacagacctccaggtgactctggttcttaccatgtaatagagggggccatcttgtccctacctaggtgaaggagcactacctaggttcgggagcactcctgaacctaacccatggctgtcccattggacttcacttctcccttcccatgagacagccaggcaggcaggcaggcaggcaggcaggcagacagacagacagacagacagacagacagacagactgacctagaaggctcacgtaggcgtcgctgacctggccccagcgctgtgggtgctctggagatgacaccagcaaaggctcggctgtaccgggccagtacaggttggtcctgccgctggggaaagggataccattgtcagatgtgaagatgatgagggtgtcgttcagcacaccagcacctcgcagctcctggagcaccagacctacccctgaggatggagaggaggaagaaggctcagaggcacatgtgtccacttacccctgggctctattacatcctggccctcacacaccccttcagtctttcctgcaagcccagcctctagcccaaaccacaaacctcctgtacacatggtacaggtcacatggcttccagggacctctcatcccttagaactcctgccatatgaggcagctggtactgccccaagctggcttctgttttagaatctagtgtctatgaagcaaagagacagcttgggtaagagcctaagatagggcaccactgttagagatcttctggcattcggggatagcctgggctatcaagtgagttccaggctaacctggtctataacaagaccctgtctcaaaaagtcaaaataagatggcaaccaggcagactgagcagcagctaaactgcttgccatgcaagagtcaggatcacagagtctggatcccaggcacccacataattgccagggtgagagagctcgcctggaattccagccatggaaggcaaaaatggggttcccagaggaagctggctcccaagacagcaacatcagcaagctctgggtttgactgacagactcagtctcagtaaaggagctaaaaaagagacaaaatgacttccaatatcaacctctggcccccacatgcacacacacatttgcacacccatacacgtgtgaaagtatgcacacacatttgcacacccatacacatgtgaaagaatacacacacatttgtacacccatacatgtgtgaaaacatgcaaacacacacacatacacacatgaaaaacaaagaaaaaacttaattaatgaaaatgaaagctggagctggagagatggctcgtggttgaagagcactggctgcccttccagaagatgcaggtttgattcccagcgcccacatggtggctcacacccatctatgatgtcattccaggggatctgttgtcctttctggcctctgtgggcactgtgtgtatgcgatgcacttacatacatgtaggcatgttacacacgcccaactggccaggaagaacgacgctgctacaggatccttctgcacacatttattcagtcctgtttcttctttctccatatatctcccttgtttatatctcccttgtttttatatctctcccttgtttttatatctcccctgtttatatctcccttgtttttatatctcccttgtttttatatctcccaataataacaatcctctctcgaataataatcctcctctaacccgggcctctcactcttttatactctcagttcccatccacgcacagcaggccacgccacctcaccaggcacgcagcttcagctaatcagggcagcaggggcaaatctccaccaaattggattcacctgtatcctggtacacctgcgcagcactcaagatgtttgtgtcttatatgaggaagtcaggtgcaagtcatatgacttagctgcagtccctggcgcctttgggactgtcgccacacccgctccccacataggcaaaacatccacacaaataaattaaatatgaaggagaaggagaagaaacaacatttgggagacagaggcaggcagatctctgtgagtttgagaccagcctgttctacagagtgagttccaggacacctaggactacacagagaaaccctgtcattaaaaaaaaagggggggctggagagacagctcagcagttaggagcactgactgctctttcagaggtcctgagttcaattccaaacaaccacannnnnnnnnnnnnnnnnnnnctgcttgcctgcaagagtcaggatcacagagtctggatcccaggcacccacataattgccagggtgagagagctcgcctggaattccagccatggaaggcaaaaatggggttcccagaggaagctggctcccaagacagcaacatcagcaagctctgggtttgactgacagactcagtctcagtaaaggagctaaaaaagagacaaaatgacttcccaatatcaacctctggcccccacatgcacacacacatttgcacacccatacacgtgtgaaagtatgcacacacatttgcacacccatacacatgtgaaagaatacacacacatttgtacacccatacatgtgtgaaaacatgcaaacacacacacatacacacatgaaaaacaaagaaaaaacttaattaatgaaaatgaaagctggagctggagagatggctcgtggttgaagagcactggctgcccttccagaagatgcaggtttgattcccagcgcccacatggtggctcacacccatctatgatgtcattccaggggatctgttgtcctttctggcctctgtgggcactgtgtgtatgtgatgcacttacatacatgtaggcaaaacatccacacaaataaattaaatatgaaggagaaggagaagaaacaacatttgggagacagaggcaggcagatctctgtgagtttgagaccagcctgttctacagagtgagttccaggacacctaggactacacagagaaaccctgtcattaaaaaaaaagggggggctggagagacagctcagcagttaggagcactgactgccctttcagaggtcctgagttcaattccaaacaaccacatggcagctcacaaccatctgtaatgggatccgatgccatcttctagtgtgtctagagatagctacagtatatccagataaataaaattaataataataataattattattattattataattataataataaatttaaaaattaaaaaaaagaccaaaacccaaaaaacagagctacagacaaaagggtctagacatagctaagcagcaacatgaagggatactgaggctccggccccagacactaagcctcaccccttcaacattaaccctggctaacactatgctgattccaggactccactaatggtgaagtccagcttaaaggtccctggcctatgatgagagggacagcctcagtcactgggactcgccttggtccatnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccaccccgctggaccactcggacaagaaccaatgacagctgagccagtgggaggactggcgggaggacaggcaggaggacagatggcaggacagggaggaagacagacagaacgacaaggaggaagacaggcaggaggacaggcgggaggacagagggacagggaggaagataggcaggaggacaggacagaggacaggcaggaggacagacaagaggacaggcaggaggacaggtgggaggacagggaggaagacaggcagaaggacagggaggaagatgggcaggaggacagacaggagaacaggcagaaggacagacagaagaacaggcaggaagacagacgggaggataggtgggaggacaggcagtaggacaagcaagaggacagccaggagaatagatgggaggacagggaggtagacagacagaaggacagggaggaagacaggcagaaggacaggatggaggacaggagggaggacagatgggagaacaggcaagaggacagccaggaggacagatgggaggacaggcaggagtggttgtgttacgtgtgccttctgttgcatgccaggaagccatgctgcttgcacacagaggtctcagctcttgcctctgaccctgatcattcagtcctaaaattcctgctgtcattatctgaatccagtcttcaacagttaagtgagggtggggtccaatcggacaggactgtggcatttctctgtcaggtttggaaatgagacaggtgtcatcaacaatccaggaaggcctccccagaaacagagggaggagccggctctctgaacccagtctctccatataatgaaattgttagacttacattggtttgttaaaaacctggcctgtagtgtggcgtgcatgtgtgcatgcgtgagtgtgactctattttctgctttgtccgtattttccctgcatgtacatatacaacagttacagatccctgtgagccgccatgtgggttctgagtattgaacctgtgtcctctggaagagcagccacttctcctaaccactgagccacctctctagccctgagactgccaggttttgttgtgatggctgtccaagctgagacaggaccgaagttccagagccacacgaactggctccagaggattccagcgccaatcctatccggtggatatacaccctaggccgatcttcgagactatccttggagagattgggggtagtgctgcaaagacagcactgtttatgttacaattaaccaactggcttgcccagataccacaaagtttatcagaagagtgggcctggcccagagccagacctcagaaggcctgggctgtcacaagccaggcactgatcacccaaacaggaagtctcatgaatgcaggaggaacttggtggtttgcgtgggcattggagtactgtacttttgggccaggagctaagagaactgaccagggcatcctgcaaaaactcggggactcaggctattctcatttctggaaccttatcagaggtctgcatgagtagccggggtccaccgggtctccttggcagctttgactacagatgtgggaatgctggccagcttggggatggcagaagcgggagggccagacgcatttagagtcaccaggaagagacctgcaacaggaggctcggcaaggaattggcgcgccggggtcagcatgggccagtggcggggaagagcccagtggccgcttctgggagcagcagcaggtggccgtgccagggacggcggcactcaccaactatcagtagcacgttgcgcgagtgcgcgccgcagagtcccaggaccaacagaattgtgcagcaggccagtcccgggcagtgcatggcggcgccggtcagggtaagcggttccggctcgtccgctccccacggtcacgtgcacggcaggccccgcccatgtcctgcccactctgtttctg

SEQ ID NO: 446 - DNA, 1482 bp, Mus musculus
agtacttgagccaggaggagtatgccacctggagtcagagaggggacatcatccaggagggagagtcaataggtgaccaccactggatcacccggcatgctgtggagtccctcatgaatatgagcacccacgccctgctggatgtgcggctggacagcgtccgagtcctacataggatggacatgtttcccattatcatccatgtctctgtcaatgagaagacagcaaagaaactcaggaagggcctgcatcggcttggcagctcggaggagcagttcctggaggtggcccggcaggaggagggagagctggacagagtgccgtgtctgtacagcagcctggcccccgacagctggagtgatctggacagcctgctcagctgtgtgcgcctggccattgcagatgagcagaagaaggtggtgtggacagagagcccctgctgaagcccagacctggcttgggactgtggggacctctgtgtgtctgtcaatgctgtcagcaaacaaccccacttccttctctggtcggggtctgacctcaggtgcccccagaaatcaaggtgtaaatgacgaagccaccttcacacagcatggcctgggctgatggaggaccggaaaatattctgccgtgtgggggtactccctgagacctgctcagagccagtgccccaacctcctgtgacaacaggaatagctttgtgggttctggcccttccttttatgtttctgatgtcaaaggaaccttgcaagctcgctggagcagtccttcctgcccagggcgggggcctgactctggagcaccgtgggcacagctgactcagctgctaacagccaagtgctgccacagacatctgcaaatgaaggtgctgtagtgcacagacttgagtggctctttgactcactgcctctgtgcctaaccccaaaccccaggttgctttggtgcatatcccagagccaactgacccttcatgagcaaagaactctctctcaaaactgacatttcccccagtccttcccaggctgcattgcgccacacttgggtgaagcccccatctagccataaactgagtcattttgacacggtgtttgtgtctcggtgcctaagatgcagtgtgctactatgaagttctgtgaatgattatactattgtaaaaaggattttccaacactagggcccataactctcactcccttccaagatggagttgacagaggggcaaaagggacagcccctctctttctagatttctaagcagtgcttctgtcccttggcaagtgaaggaagggaaaagatggagccaggtggtttgcttggtgtcactcagagagaatgaaaggagagagaggggggagagagagagggagagagagcgcacactgtcccaccctgtcctcctcagtcaccctcagaaaggagagcagagcccagatagaccacaggatcaaactcactcctctgagaacagcatgaaccctggctaag

SEQ ID NO: 447 - protein, 159 aa, Mus musculus
APTPCWMCGWTASESYIGWTCFPLSSMSLSMRRQQRNSGRACIGLAARRSSSWRWPGRRRESWTECRVCTAAWPPTAGVIWTACSAVCAWPLQMSRRRWCGQRAPAEAQTWLGTVGTSVCLSMLSANNPTSFSGRGLTSGAPRNQGVNDEATFTQHGLG

SEQ ID NO: 448 - DNA, 50602 bp, Homo sapiens
  misc_feature (1)...(50602): n = A,T,C or G
ttgtccgcaggataatcctgaaggttctcaggccatggacctgtgaatttcccttctttcagtgtctgcatcattgggaaccaagcccctaaccaatgtttattcattcgctcaaccaatatttgtggaatatcacagccctaggggtggggacacagcagggaacaagaaagacaagaattattgtcctcagtaggttactgtggagtggggaggctggcaggaagccacgtaactagaatacacgttaggtcaaggcagtattcccacagagaagatggaacagggaaggggagtgaaggccaggatgggaggtctacggacttaagtaggatgatctgggaagtagcatttgagtagagtctggaaggagggatgggaaagagtgttccaggcagtgggaacagcaggtgcaaaggccctggggcagaagtgtgcctggactgtcaagactgttgggctgtgtgtctggagcaggtaaaagagagataaggtcagcaaggacctgataagcagagcctcatggtcacgctgaggactccaggacctgtacaccgaagggaatgacaggagctgactcatgccctagcaggacttctctgcctgctgtgttgagcgctggtgatgggggcgtgggaagaagttaggagccattacagaggtcccggtgggccatgatcaggacaccacaatgcaggtggtgagaatggatcggattctagacatatctcaaggtggaggaccaagactttcatctaaatctaaacaatagttatgaaatgttaacttgagatggatctattggaattattcagatacttccaataatggatcatgagaaccaagaaaggccctagaatttatcctgatcttcgtaggattttcccaagggtagaaatgatgatgaactgggtgaccgttcacaaaggagagaggattcccagcccccaagcctgaagccttcccctcaatcaccctcagtcaccatcttctgtgggtcgaccagatgcacagactgttctcagccatccctgtggttcttacggcaatgtctagctgtgggactgcactggtgcttcgatggctcatagaagccccatataaggcactgctcctgtgggatgtgcctgtcaaacctgcttgtccactgccgttcagttcagccagagattgggccacattcagtcctcgcttccctgggagggggaaggtaagtgcgcgcagtccatccggcgaagagcaggtcagcctacggagggctcagcctacggaggggctcagccgacacaggtctgatggggcccgagagtggtcccaggggagtgggaggggccggcatcttcctcatcaggagtggaggagctgccttgtatgtggactagagagcagaaaacggcttgtctgtgttgctgggtcaatcactggaacattctctgaatgctgagttctgccttaaaacagcacgggtcatgctagatgaaagggatctctgttttatactctcatctcttcgctattgccgtgggatgaaagacagcagaaggaaggtgtctaagttcagaacaaagtgagcaagaccagctggctgctgttggtagcagaggcacagccagcctgtcatggcactggggggccgaggtgagctgtgccccctcctcctgggcttgtgaccctctgccccccatggggtatgtacatgtgtgtgtgtgcgtgtgcgtgtgtgtatgtgtacatgccttcttccctacttcactggcaagggaagagactgacacttgggttaggagaaggatgttgacctgggaggggtcaaataaggagaacccacatcttagatgctcaggattttatgatcttaggctcttctagaattgctgtacagttagattcagagtttggaattagagatctctgggccctcccctcccctcccgtcccctcccctcccgtcccctccactcctctcccctcaaccgggtctccctaatactccgatgacatataatctactttggaatgagacttcctatgaacagaagtatagaattggacatgacgcaaaaaatgagtaactgaaaaaactggctgctggggaagaaaaagtaactcctgcctcggaactaataaatagaagagggctatagagagcaaggacatcatactaagcaaaaaaaagtgtatattcgagtgaagacagggccaaacgacaagaatgtattggaagggtatgtaaaaagcgggcttataaggaaataaggacatattctgaagtgaagagagagtcagaggtcaaccgacgacagaaaagtagtcgtaggaacgtccgagaaaaacatgaagactatcatcagctgattcaaatatatcccaccctggggtgaagatagaccgagattagtaacatgaagtactactttaccggttgtgctctcatcctagactgagaatgcgcgagcgtgtcatgtgaaagttgatcaacgggtagtgtaggaggtaagatatcggcacgacccgagacagacgaagagcaaggcaaagtatttgagacaagacatcgggtcaggcgtgaaaaaaaagggggagggagtgtaaggaggaaagttagggaagcgagggagaagaagggnnnnnnnnnnnnnnnnnnnngggggggggggggggggggggggggagtccctccctccctccctcccttccttccttccttccttccttccttccttccttccttctctctctccttcccttccttcctctctctttcttttcttcttttctttctttctttctctctctctctctttctttcttttcctttttttgagccagggtcttgctctgtcacccaggctggagggcagtggcacaatcatagctcactgcagccttgaactcttgagctcaagcaatcctcctgccttggcctccaaagtgctgggattacaggcctgagccactgtgcccagccctaaggttttttgttttgttttgttttgttttactgttaggactaacccttatttacactgggacaagttacaaagaaactcctgcaattgttaactgccattggagactactgtaagttgcttcatggcaactgcagaagggactagtgacttctatttagctccacccactgatgcttgaagttcagtgtggctctgggggctccagaagcctgaggggcagctggctggggcagttggctggggtctggagagttctgcagagcccctgtcttcagctgctggtgaggcagctttggcttgagctgccctggctttctgagttcagtctgatgggagggcacagtcagcaccctcagaccctcctcaggagtcttgtgaggctcgggcaagtcaggggcagagggacaatccaactagaggaccctcccagacccggtcgttgccacctggacccagccccaggaaggcacccgagaaacctgtagtcctcggctgaccaccagtcctggtcctcaggatatccgcagagacctggctgtccagaactcccagggtttcagctgcaagctggagatgtggccccttggcaactcgatatagtaagatactggagagcgtgccagagtgtcatttgctagaaacaaacattatactgcggtaagccctagtttttcagtcattggctctttggcaccaacttaatcacaaggccattggccccaaagaaaggccttgtaggcgactgtttagggacacctgtattttccatctgccttggaacctctaggctcaggccgaatgcctattgaagtagatgtttcgtaagagatttgggggcaaatactgggattttataaagatgctgcactctccttcactaagtagaaagctgagaaatcctgccctgaggggaagaaacagttgtcttcctgactgatgcatcctagaccagccaagacttcctcccgctttccttcttctagaactttccccacttcagccagtatctgtcatcccctgggctcccaccctctccatgtgccgctttcatcggggctgaggggagcaggagaggagacgtttctgctggtgtccccgctgtagctggaggagctcggcgtcggcgtgccttcgcctccccttcccatgatgccccctaaaccgagtctgtattgagagagaaaggtggcaccgttgatcattactccaggacaagagtcataaaaggactgtcccagacaacctaggaccccagtgttctgtggcgaacacttctaggatgaggcccatctccttctctgtttcatcaattggattaattttattgttttctaaaataatgactatggtttttattgaacccatacttgcttattctaaacattcttttttttttttttttttttttttttttttttttttttgaggtagagtttcactctggctcctaggctggaatgcagtggcaccatctcagctctctgcaacctccacttcccaggttcaagcgattctcctgcctcaccctcctgagtagctgggactacaggcgagcaccaccacagccggctaatttttctatttctagtagaaatggggtttcaccatgttggcaggctggtctcgaactctgacctcaagtgatctgcctgcctcagcctctgaaagtgctggattgcaggcgtgagccaccgcaccaggcctaaacagatttctttacaatctaccaccatgaacagcaagcattagcattggtgaggagtgttccagaatccctctgctctctgcctctccatttctctccccctctctttctctctcatgcacacacacacacacacacacacacgcgcgcgcgcgcgcgcggaatgacaggacagactgatcggcagattggatgaatggatggatgggcacatagattgagggactcccagagataaactaacaccattttataaaaatggtatcatattctacatgattgaaatgtaaacttttaattttacttaaattttagttcagctcagatgttgctggcaaaagtttttttttattatttttattttttatgtactgctccttgaggagctgggctaactcataggcagtgcatccagattcggcatttttttttttttagatggagtctcgcactgtcaccctggctggagtgcaatggcacaatctcggctcactgcaacctctgcctcccaggttcaagtgattctcctgcctcagcttcccaagtagctgggattacaggcacacaccaccacacctgcctaattttttgtattttagtacagatggggtttcactatgttggccagactggtctcgaactcctgaccttatgatctgcccacctcggcctcccaaagtgctgggattacaggcgtgaaccatcgcgcccagccaaaaaatattttttaattgttaaaaataataatggaatgccaaatgtagtagaacagtttcacaatgacaagaactattagttcctaaaaaatccccaagattcagataagagattacaaaaaccttgataaattagtgacattatgtaaaatcaacagtgctgggtttggtggctcagacctgtaatcattgcacttagggaggcagaggcgggaggagtgcttgagcccaggagtttgagagcctggccaacatagcaagaccccattctccacaaaacggaaaatacaataaaataaaatcagcgttttgttttattttattaatttatttgagatggagtctcggtctgtctccctggctggagtgcagtggcgtaatctcagctcactgcagcctctgcctcccgggtttaagcgattctcctgcctcagcctcccaagtagttgggattacaggcatgtaccaccacacccagctaatatttgtatttttagtagagacagggttttgccatgttggccagactggtctggaactcctgacctcaggcgacctgcccgtctctgcctcccaaagtgctgggattacaggcgtgagccacgtcgcctggacttcctttattttagatagcacagggtcatggaagataaagtgatgccttccttcccctaccccctaccccgatttctactgcttgcattatttcttagggtaaagaatcttcttatttggctggaagactctattcccaccgtagtttagtcctggatgtgtgattaaagaaatccagtggttgccctgcgctgagaaggacagccgggcctgggttctctcctggctcagtacagccccctccccactcctgctgaggactcccagggaagctggaggcagctctggggcgttttctctgacttccctagacttctcttcagctgcccaaacagtagagggatgctgaagccctctcttcccgcagtctgtccctaagggttgcgctggcacctgtgcccccagtgccccttggcagcactcctttggtttcagggcttgtctgccatttttcttttttctttctttcttttttttttttaagacagggtctcagtctgtcatccaggctggagtgcagtgatgcaatctcatttcactgcaacctctgcctcccgggctcaagtgatccttccacctcagcctcccaagtagcttggggaccacaggctcacgctaccatgcccggctaatttttgtattttttgtagagacagggtttcgccatgtcacccaggctggtcttgaactcctgggctcaagcgatctgcctgcctcagcctcccaaagttctgggattgcaggtgtgagccaccatgcccggcctgctatttttcagtttgtggcagaaaagttgttttcctttcctcattttgtggttgctgctttattcacttatttatttttttaactttttaaaacgcaacatttggttcatttcaccaggagctggggagggaggtacaggaggctgccctgatcctttgttgggtttgatctggagactttgacgtgacagagcgactgcgcccactggttgtcctctaagaaggcgtgaggggaagcccagacgcctctgcaggagccagagacattcctagggggtcacagggtcagctgaggtgaacagggattctggaatgaggaagccaaggggatggaagggaggaggctggcagggaaacgcccagagcacgtgctcctgcccgacacctccaggcagagaacaggagctggcaagagaggaaccccgcttgtggtggggacgctgaacaggcagggcctggctgggatgggggcccagcctaggctgaaaacgaagagaaaggaaagtgggtgccagtgtcccacgtactgtggacccccagccctggccctggggtggcaggggcagaaccgggcactgcagggacctcctcagcccaccctcctcctgcttcctggcagggatgagagagggaagcaggaggcagggtgggattgccagctgctctcggatcgtttttttttttttttttttttttttttttagagacgggatcgtgctatgttgctaggctagtcttgaactcctgggctcaagcgatcctcctgcctctgccttccaaattacaggcatgagccactgcaccaagcctggatctttttttttttttttaaacaactttgttgagatataactcacggccagacacagtggctcacacctataatcctagcactttcggaggctgaggtgggaggatcacttgagcctaggagtttgagaccagcccaggcaacatagtgagacccccatctttacaaaaaacaacaacaacaaaaaaaatgagcctggcatggtggcacatatctgtattcccagatactccggaggctaaggtagaggatcacttaagcccagaagacggatgttgccgtgagctgagattgcaccattgcactccagcctgagcaacagagcaagaccttgtctcaaaaaaaaaaaaaaaaaaaaggaagagctataacccatacggcacacaattcacccgtttaagatgcttctagtgtattcacagatgtgtgcaatcgccgccacagttaactttaggacattccatcatctgtaaaggaaacatcccctacctttagctaccatcctgacatcctgatagacagggggcctgaagacccctcggtgatgcagggcagggctggagtgggggccctgggctgactttattgctcgctattgctgccttgaaattctgaatacgtttttaaaacaaacgcaccatcctttcattttgccctgagctccacagacgatatagctggtcctgaagtggggcagaggatcattctgacttggagtcagactctagcgacgcaggcttctactgggtggaggcccaggagctcaggagccttctgtgggagtgtgcccattggcagcgcatccctggagatggacggacaatttccacatcgcctttgcccctgtgcacgctccctctggctgccgtcataaattaccacaaactgggtggcttaaaacaacagaaatgtatttgctcatggttctggaggccagaagtccacactccaggggtgagcagggccgcacccccatgaaggctccagggagggtctgcttcatgccttctcttgagtttctagtgttgccaccgacccttggcgtgtcactccagtctcggcctctgccaacatggggtgatcatggggtgtctaggcctagggcccttctcctcctcttcttcttcttctttcttttttttttaagacagggtcttgctctgtcgtccaggctggagtggagtggcactacctcagctctgcaacctacacctcccaggctcaagcgatcctcccacctcagcctcctaagtagctgcgactacaggtgtgcaccacaacacctggctaattaaaaaaaaaatttttttaggccaggtgcagtggttcatgcctgtaatcccagcactttgggaggccgaggcaggcggatcacttgaggtcaggagatcgagaccagcctggccaacatggtgaaaccttgtctctactaaaaataaagaattagctgggcatggtggcatgcacctgtgatcccagatactcagaaggctgaggcaggagaattgcttgaacccgggagacaaaggttgcagtgagccaagattgtgccattgcactgcagcctgggagacgagcaagactctgtctcaaaaaaaaaaaatttttttttagcagattttagcagagacaaggtctcactgtgttgcccaggctggtctcaaactcctgagctcaagcaatctgcccgccttggcctttcaaagtgtgggattacaggcatgagccaccacacccagcccttctcctcttgttataagggcacccatccctggactagggcccaccctaatgacctcaacttgattacgttggcagagacttattcccaaatgaggtcctacttacaggtactgggggtcaagacttcagcattcttttgcggggggccacaatcagtgacaccctgactcgcaagcctcaatcacctgttccagtgagaaacaggactgagatcacaaggaatgaggcagagctgccctcgattggttctcctctcctcctcacctgcccaccccggcctctgcgcccgtcactgtcctctccagctgttcttccttccgggcaaggagactcagcagaagggtatgagtggcctggccctgtggggagccgcagacaggcctgtgggtgctttggataactactgcgcctgtcaactctccttggtagtctagggttcaaagcccaggtccattctagaagtctgcttccaagcgctaaggaagcttcaatagttactgggaaaaccacaggggtcaaaggtccgtcgagttatttcccggatccgagtctgacgtcttttccccgccgcttgcggtggttgtgaccgaaccttgagttttggaacaggtcacatggctttgaaatcacggtcaattcacctggtgctgctttgacttcaggctcttccttctgcccagctccgtcccacccagcagcccgcagagaaaggaggcagctggcaccacactgggctttggagacactgcggggactgtggaccccaccctgctgcacggagctcctgcaaaagcaaacctgagaaccttggtgagtacttccggagacccggctcctgggacggcttctggcgctgctcctgcacacacaactctccaacgatcattttccatgttttatttttatcttttaatttttgagatggagtctcactctgtcacccaggctggagtgcaatgatgcaatctcagcttactgcaacctctgcctcccaggttcaagtgattgtcctgcctcagcttctcaagtagctgggactacaggcacccgtcaccatgactggctaatttttgtattttcaatagagacgggtttccaccatgttggtcaggctagtctcaaactcctgacctcaggtgatctgcccgccttggcctcccaaagtgctgggattacaggcatgagccactggccccggcccattttccatttttcagatgacaggtgttgatttgctctgattttcaagtatttttagcatacagatccctgcaagaggcatctgtctccagtggtccagcctctccttccaaatgaaaagaatcaagtcacaggaattcatgggtctgtaaggaatcgctcccatctgtgcccaggagattaacaaaggcggtggctgcagctctgtgagcagtggagaaaaattaggcacaacctgatatcctcccacaggagcgtaagtccactgtggttattcatatcattaaatccagtgcacagtttaaaggaccatgcatgtatcaagctgcatgtatcagtatgagaaacctcagaagccgtacagccttgcacagaacgatagtttctgtgaagttccagctaacactgaaggcactgttgatgtaaagctgctgtctgcacgaagtatcatgcaaagatgctatgtactgtttatacacacttccatttgtaggaaatgatttttaaaatatcatttttaggctggactgtaatcccagcactttcagaggctgaggtagacagatcacctgagcccagaagttcgagaccagcctgagcaacatacggagattccatctctacaaaaattaaaaaagaagccaggcatggtggcgcatgcctgcggtctcagctacttgagaggctgaggtgggaggattgcttgggtctgggagctcaaggctgcagtgagccacgatcacgctactgcgttccagcctgggcaacagagtgagaccctacctcaaaaaaaatcatttttaaatgattttagaatgtctggccagagagggagggaagagggactgaagagaacaaaaaggcgccatctgcctcgcatttccttaaaaagaaacctgaagtgcagaatgtcaagatggttgaatccgcatggtagatatgtggatatttgttatttgcaggattttttaatatgctgaaaacagtgcacagttttaaaacattttaaaattatttagatggattaatgggctaatggcctcatgttgatgccagagaggggctcaggcaggggcacagtggggtacacagctcatctctcgctgggatgggaggctgggcaggtgacggctgaggacctccaacagctcttagagtctgcactagccagcatgtcccctgaagagcaggtgttccgggctgtaacggcgacctgcttcgtgtattctgtccagacagacctgggcttgggacatcagccctggtggtggccccagatcagctgcagctcagccctttcggggacctgtccaccctctgtctgcctcgccatctttgtaagcccacaccccccgcagccgagccgtgctggccgttactaccctgaagtgtcttctgcgaggcacttgtgcccagtgtcactccccagcacatttccctcatgtggagtcctctgcgcagtcctctgtgtcactgtcctgggccgctgcaaacaagggaccacctgctgcgtagttgaaaacaatgggaacttttttttttgtttttttagacagagtcttgctctgttgcccaggctggagtgcagtggcacgatctcggctctagagaagccgacagtcttgcttctaatgaaaattacctttcataaagaacttataaagcagcatttccaaagtgcagcacccctactgttatttgtttgtttgtttgtttgtttgtgtgtttgtttaccgggacagggtctccctctgtcacccaggctggagtgcagtggcacaatctcagctcaccacaacctctgtatcccaggctcaagtgatcctcctgcctcagcctcctaagtagctgggattgcaggtgcataccaccatgcctgactaatttttgtatttttagtagagacagggtttcaccatatttgccaggctggtctcgaactcttaggcttgagcaatccttcccccttcgcctctcaaagtgctgggattataggcgtgagccaatacgcctagcctactaccattattttagatgaatttctaaaaaaaaaaaaaagtatttatttactttaattttttagaaaaagctgtaactgacacaacaaagtgtgatttagtgactttattgcttaggattggggtagagcaggtggggccgtggcactcaaccttacacagagggagaaaccagaatggcaaatggccactggaatgcttcctctgccgtaaacatctcaagactgtgggttctgactggcaaagagtgcgccttgctaattttacgatggagttgattttaaaacggtgtcaccctggctatcctggggtcctgcttacctgacaactccacccccatggccacccctcctagggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccggtgagcgcagctccctcttccccacctcttccagcttcccgtggcccacatggctccactgtctgcctctgtcttcagggggtctcttctcgtcctgtctcttataaaaacacttgctgttgcctttagggcccacctggataaccaggatgatctgatcttgaaatcattaacttatatctgcaaaggcccttttcccaaaaaaggtcatctggacaggttccaggtggatgtgtctttgaaggggaaccaccattcacaccactacagctgtctttggagtccattctgatggtctgactagtgtttattcattaaaaaatggggatggtaatggctttactgtatacggttgttaggagaagcaaatgagttactgtttataaaacactcactgcaaagctggggccatagaaaacaggcagtaggtggtagctgtcaacatgataatgttcatgcatgttggcgtacgaaccccaaacacaggagagattgatgcacgctggtcattctggctgagagagatgggctctgggccctgggcgtggaaggccccgaggctctctgggacctgtcacccgcagccccggggtgccactctgctttctgtgcgcagctccaaagctgacagcaccgtggtgggaccctgcgtctgcatcacccaccagcttgccagggaggtgcttgcaagcagggacccacctcctcaccccgtcccggtccccccgcactcgccagagcactggggttgcagtagttgctcgatacatgccagctttgcccttctcgagtctgactgaggtcatgggggtaaagggagcctgtgagagcagtgagggcgcgtcccacccagcagaacccagaaaaccgctttcacctcccgattcttacatgtgcggggggtttcccagccccaggcctctcccccgtggggaagccagccagggagcccagcccccttggtagctgggttctgcccagacagacggttctgcctcccaagggcacttgctggatttgctgaagactcgagggaagaacggggccatcgccttcctggagagcctgaagttccacaaccctgacgtctacaccctggtcaccgggctgcagcctgatgttgacttcagtaactttagcggtgagagctccgactttgacggtttggcaggcacttctaggaacctcaggctcctggtaaccccaggtgccccgcttacttgccgatttgccctactcccccttccctccaggctgcagttcctgtcccagccccagcactctgagggtgaggaaccccctcactgtattggggttggataggataaggagcccctgggccttgactctgaagggtcggtccttagttacccagtgccaaaaggagacccctgagcggtagggtggggagaatctgcttggagagacacaagcaaagggcaagggagtgtctcctggagtccgcctttaaccttgcggctttgctggaggggccagaacggcccagcctcagctcttaggaggcgacagagcggccccggccagagggtacagggccttggcagggccgcggagccttctgtgcactgctcaccattttccttcagggagtaattctaggcttccctggaggagctgttgaaagatttaggtattgaaaggagcaggagcaggactcacacgacccaaaacagtggagaatagaccattttccctgtgttccagcacggtgtgtgtttatgttctttagagttctagtacgcggattcgtattctttttttatctttttctcaggataacgttaaaatgagttagcactgagtgcatttcagctaccgaggagggtcattaagtctgaacagtggggtctcacggggaaggtcagagtgggtaaccctcgtgccaaaatcgggagtcacgctgtttattcaaccaaaagaccaagtctgcttgaggtccaggagcttttaaggagaccagcaggttaaagctgggggcctgctggggagtctgggcaaggctgtgggggcatgggagtcatgcctcggcccaccggcccatctgtgcacctgcacacctgcccacatgcccacccgcccacatgctcagctgcccacatgctcacccgcccacatgctcacccgcccacatgctcacctgcccacatgctcacctgcccacctgctcacctgctcacctacccacctgcccacctattacctccctacctgctcacttgctcacctgcccatctgcccacaggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggaggtagggggacaccctgcaccccggcgcgaccctgctgtcgtctgcccccaggcctttgtactagctggtccatctccctggaactcctttcccctcttccttgtctaacacttccctgccccgagagccttggctgagacccctctgggaagctgatccttcccctccccaggaggccacccaggcccctctgtgtagcctgcatggcgacgaggtgtgcctcgtccagtagctgcccgtggcctggctggcttgtctgtgaactgcccatcctgctgacgcctgggcaggtctggacacactctgggctgcatatttgtagggccgcctacgtcccactgcccagctgcggcagtgacatgggatagtcggcctctgtcatcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcgggatagttggtctctgtcgtcctcctttgtccttctcagctggtcctggactcaggcggggagggcaggagggttctcaagtgaggcctctgaaactcagtgtgtttcactcacttttctttggggaggatgatctgactgattggtaaggcttctcaaaatactgaggatgtgcactccttgtcattttggcatttgctttttacctttattattattactattatttttaattttttagaggcactatctcgctctgtcaccaaggctggagtgcagtggtacaatcctagctcactacagccttaaactcctgagctcaagtgatccccagcctcccgagtagctgggactacagattgtaccaccatacccagctaattaaaaaaaaattttttttgaaatggggggttctcattatgttgcccaggctggtctcggactcttgggctcaagcgatcctcccacctcggcctccaaagtgctgggattacaggtgtgagcccctgcgctggccagcgctttgcctttaatcatgacatttgttgtttgtttttaattttttacttcttatttagaaataattccaaatatatatttttaaatcacacaaataaaaatagtacaaataatacccacctacccttgctttatcatttgtacttttactctctcgtggccctttatgtctacttcctgaaaatcagcacctgcccctatatagccacagtgcagttctcaacttcagtctttttggtatggacgccctgtttttatccaatccgcctgtgttctggttttctcatctgtcccagtgactccttcacagcctttcccccagcccagggtcgggccctgtgttctgctgttcctctctttagccaccttcatttgggaacagcccacagcctttctttgtctattatgaggtggccctctttaaagcccccaccccttccctttgatgatagacgacctctcatttggggtttgtcttgtgtttcccacatgtatacagaaattatgttctttggccgggaccctgcacagggggtgctggcctgactcagggcatctcctcgagggctctcgaggtcctgtcgcccctcacaggggacgtcacaccgtccaccatttgtcaaggtgcaggccaattgctctactgcagaatggctctttcttttcttccctgcaactgataaatatctcgggtgtggggcgctgagaccagcaagcaccctgctcctggtggacatttcccaggatgtagctgtggtgactctggcgggagctggcccctaccctgggagctgtgaatgacgaccgtgccagtgctccaccttgctgctgcccacggcctctgccttcccttctcccttggctgactttggaccaggccagcccactttgctgctgcccacggcctctgccttcccttctcccgtggctgactctgttcttggcgcagttcatgggttcctactctgcaggggtctgacctctcactgtccttaatgattttggtctcaaatggacccagatgtgaccaatggaacccttcaaccagctccgtgtcctaagacgggtcccttgtttttggagaaccaactgcttttctggcctcacaagatattccagggtcatcttgtacccggcctaccccaaatccaggctcagcccattctctgagggccccacttcctttttttatttttattttttggtttgtttttttgagacagagtctcactcgcttcccaagctggagtgcagtggcgccatctcagcccactgcaatctccatctcccgggttcaagcaattctcctgcctcagcctcccgagcagctgggattataggcgcgcactaccacacctggctaatttttcgtatttttagtagagacggggttttgccatgttggccaggctggtctcaaactcctgacctcaggtgatccgcccacctcggtctcccaaagtgctgggattacaggcatgagccaccacgcccggcctcctgcctccttttagagaacaagatgtgggcgtaggtgtgtccatcactactagggtgtctttgcttctcagccctttcaggggacagagctaggaaacacacacacatgtatggacatatacatacacatatgcacacacatacttgtctgtgtacacacacatactcatatgcatggaagtatacatatagttcacgtgcatacttcagaaatcatgggttctcacccatacctctaattccaacccatgccctgcggctttttcttgccttctcctgttccgtacgtgtgtgctccttccccagggggaacgctgctcccagcgtcaccagcaccttcagacccgtgctcagtcctgcagcacatctcaaatcgtttcagaatcactctgcccataccactgccattaacagccccgctaagacgggtgccggacttgtttgtaattcacctccccccgccagccaatcttgctcaaggctgagggtttgtaatcaaacactgtgtttgtgagtcactgtatcttcgttctctctgtccttgtctgtctgtctctctcttcgttgtggttatggcgtctgttggaaatagaattcggttcatttgttctggttcactttcagtctcatgttttccggttcccttccagctctgacttgattttactttttgaatctgtggacggtgacatgcccagcccagctggaccattgcaggagctgggaacttgcgaattgacaatgtgctaaccgggtgtcgggaggggagagtccaggtggaaaggtccttcttggccacagcccaggggtgagcaccggcacccaccccgacgtgcagacttcccgggcttgcctcacggggaaagtcctgcctccccagggctgccacacccaggacgggaagagggcgggcccgtggctcgagctccaagtttctcttgggctgctgtccagaggaaggaggccagcaggacctggtgggatagtccctggaaggccagggccctgcacacagactgcaagtcaacacaggagctttgctgtctgaacagccccggtcccgcgttcccaggcacgtctacccctccgacctgactttcctctctcttacttcttactgatttccatgactccaaattccctttcttgatgtatttagcagaacatggacaagcagggaagccagggagcatgctggccatcactgccggctgctcagctgtagagatccaggagttggttatcaaggcctcttggtctattcctgggaccctaaccctggatggagttcaaccgcggtgcctcatctataagacagagctgaaaggcctctgtcctcccagccccagttgaatatttgggactattcattaggtgaaccctttcgtgggtttttcagtctcgaggcaggaagccccctgagtgctaaaagcatcattaggaggaagggtgagaaatgcccccagctcctgatcaggggagaagctgtttccatcgcccttcctgtcgcctccccaccgcacagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggtaggttccggtccccgcagcagagagcggcctcctgccttgggggcttggccctcaggctgtggggtttctgacaggtggtttagttaaggtgaggctaagaacaagagatgaaatttagtgactcatctcacccactttctctttacctccttccttcctgctgttccccagaccccaaaattggcagaattaaaagctgctggaacagaattaaaagctggaactgggcacagtggctcattcctgtaatcccagcacttgggaggccaagatgggcaagatagcttgagctcaggagttcaagaccagcctgggcaacatggcgagaccccatctctacaaaaaatacaaaaagtagccgggcatggtggtgcacacctgtggtcccagctattcgggaggctgaggtgggaggatcgcttgaccctgggagtttcaggctgcagggagctgagatcacgccactgcactccagcctggcgacagagggagaccctgtctcaaacaaacaaaaataaaagccgctggaggtgcatcacaatgcccgacttggtgggtttactgcagcgactgtgttctggagtggacttggccaattgtaaagcatgggattcgcgttaaggatgggggaaagaaacctttctgcctggaaagactccgccctctgggcctcaggtgcactggagagaggggggctctgaagtggagcagtgagtgagcaacgacccttggcgtctcctcctcggcccctctcagtagattggtatttattgagatattccttccataagcattcactgggcccagggcactggccatcttgcagcccggattgtgtctctgtttataagctccttcctgggaagtgagtgtcagaggggaatgacctgtctgctggtttctccctcgctgtgaaactgccggtagatctgttgaaggagaaggctgacctggtaaagggaggaactggtgtcctcagaggttgccagcttcctgtgttccttctccttggccatgaatctgcacttttcccaggcatgatgggtggcttttccgtggcttctctcctgcccggtgtagagtggcaagactgcatccgtccacacacctgaccgtgcagttgccgccatcttctcgggattctgcttgcctagggcaggcctctggggaagccagcaccccaggctgacctctctctgccccaggcggagaaggacattctggagcagagcctggacgaggcgcgggggagccgacaggagctggtggagcgcatccactcgctgcgggagcgggccgtggctgccgagaggcagcgagagcaggtgccgtgtgagcccttcctcccttgtgactctcctggggcttgtctcaggggtgcggacaggtctgtggggaagccagattccttcatccacgccgagctcacataattttgctgaacgaatctgtcggcctgttcatctgtccctttgtcagcgccaccctaagcaccgactcgcaccccacagctaagaccatggtcaggcagatgcgtgattcaaacgcaggggatttcagggcccaggccccggggagagccagggacttaggtgaggagggaacggggaggaaaggagacggtagaagagaagaggacagggagggaaaattgtttttctgggacattaaaaaagcaaaacacaactatgcatgcaacatcccctcattgttttaattcagacgtaatcagcctaagcaactttctagatgcacctcgaaatctagcacttaagagacgagcgaggccgggcgcggtggcccacgcatgtagtcagcactttggaaggccgaggcaggcggatcacttgaggtcaggagttccagaccagcctggccaatatagtgaaaccctgtctctactaaaaatacaaaaattagctgggcctggtggtgtgtgcctgtaatcccagctactagggagactgaggcacgagaatcgcttgaacccgggaagcagaggttgcagcgagccgagattgcgccattgcactccagccttggcatcgcagcgagtctctgtctcaaaaaaaaaaaaaaagagagagagagagacgagtgagaattgaccttatttcatccctagaactgtctccctccctccacccctgggttccccgacccccttctaaggccagaccctcagagctgctgagcttcacggtccatgtgtcccactctgtccagtactgggaagagaaggaacagaccctgctgcagttccagaagagtaagatggcctgccaactctacagggagaaggtgaatgcgctgcaggcccaggtgtgcgagctgcagaaggagcgagaccaggtacctgagaggccgggcccaccccgccaccccatgcttgcttccccaggtgagggctggttccggggacagtctcgtggctccctgcccttgatggcagctggtcccagatttcagggtctctttcctcggtccacacgaagtttcttcactcctccaggcctgttgtccacatgctgtctctatcatccttcttgctcttattcctggtacatgacactgagaaagtacaccccaaatactgggttttatcaacactgcacatgtgaacacgaattgaaatgaatcttaagtttgcacagctcagcgtgggccatttagtggatgtcagatgagcgcaggctagaaacagggctctccttctctagctgaggctccccggtggtgatggcgcggcctccttactcccgtcgtggcccacaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtggtgagtgttcccggctgacccgagctggaggccaggcaggggctgcggtgacagtgggacagagctgggctccagggtggcccatggaggcactgggaggacaggcagggtcccaggctgggccacacgcggcacctgcagagacggcccagtgtcactgtgatgagcgacacactggctcccatgcgtggatggtgccgtgaaacctcgaaggtgcccagtagacaagtagagtctgcttccatatcatcgaatggggagcttagcggaaggttctggaacctgtggagtgtggtgatggatgtggcaggtggcgtttgaagctgtccacaggcagccatttgcagtgtagatgctgtgttcctgaaatgcttaaaagcccagcgtccaagagtggaaagacagacctacatgtaacggagggagcgtgttcccagaaagccagaattcttagaaagcctctcattctgggctggcaggcagctccagctccaggcccccggggaggcaaaggagctcctccctccgcatgcggaacccacccggcccttccttccttaccccctgcatggcaagcatcccacaccgacggtggaaacacacgtgtgcacgcagagaaaaaccctcccggggcaggcaccaacacgcaggctgtgctcattctgggtgtgagatgacgggtggattttattttcttctctaactggttctacttgccttcctccaattttctgtgtgtgtatgtatgtgtgtgtattatacattattcgtaaaactagtaaatcacacatattctaaaagaaatgaaatgctgtgtgtccagctggtttctttcagtctctttgattggcagcgcctgtgatcctgtgatgggctcggaggacagggacacaattgttttccctggaagctgacgagaggaaactgctggggagggtgaaatgggtggtgctgacctggtagaaactccacgggcctcaaagcggaacctttcccgaattaaccagcctgtctggcctgtctttggcagctcaagcaggaagccaggaccagggagccctgtccacgggagaagcagcggctggtgcggatgcatgccatctgccccagagacgacagcgactgcagcctcgtcagctccacagaggtacggccgctcctcccgcctccctcactgccttgaccctctgggccagcccaggggcctctctgtcaggacgaaagtgagcctccttccaccctgtccccacagggaagaggttggtacgattgtgagagttttattttattttattttttgagacagagtctcctctgtcacccaggctggagtgcagtgatgtgatttcggctcactgcaacctccacctcccaggttcaagcgattctcttgcctcagccacccaagtagctgcattacagacacctgccaccatgcccagctaatttttgtgtttttagtagagagggtttcaacatgttggccaggctggtcttgaactcctgacctcaaatgatctgccagcctcagcctcccaaagtgctgggattacaggcatgagccaccgcacctggccctattgcgagagttttaaacatcagaggttgattctgtcacagtcctggagcccagacatccaaagtcaaagtgctgacagggtacccgtctggaaatcctattcccaaagaaggtcacattcacagcttgcagggtggacatgagtttccaggggaaccgattcaacctggcacagacagtccccagacatgagtttccaggggattcaacctggcacagacagtccccagacatgagtttccaggggacccaattcgacctggcacagacagtccccagacatgagtttccaggggacccgattcgacctggcacagacagtccccagacatgagtttccagggnnnnnnnnnnnnnnnnnnnngtgctgacagggtacccgtctggaaatcctattcccaaagaaggtccgattcaacctggcacagacagtccccagacatgagtttccaggggattcaacctggcacagacagtccccagacatgagtttccaggggacccaattcgccctggcacagacagtccccagacatgagtttccaggggacccgattcaacctggcacagatagtccccagacatgagtttccaggggacccgattcgacctggcacagacagtccccagacatgagtttccaggggacccgattcaacctggcacacatggtccctgggatgccggcctcactgtggtttctggagcctcaggaccctggcatctgtcctcaccctttggcaaagtaaagaggtggtcccaccatagtgggcatgtggcatgaggatgctgggggtcaaagccccagtgccacaggatgccgggagccgggagggagggagggtgagaggcgggcgaggctgacatccctttgccatgccttggggtggacctggtgtttccttcctggaccatcccatcagtggcccaagagcagcaggcccaggctcacctgccccctggccactcagagagctgggggaggccgggatcttccccagaacactgagtgcacacacggggaagatttcacagtcggtgctgggcctccctgggccaggacagtccaaaccttcaactgaatcgactctcgcatctgccttaacaccctctgtgcccccattccccacaggacagaggccagccgtgtttcccttccccaggggtggattgggtcagggagggaagggacctcaggtgctcagaactggctcgccagaacacaccatcctcattcaccagcctcgtgggcaactgaccgatcagctgccctccagccactctcctcctgccccggctttctaatctggctgctctagggggactgcctcctacttcatgggctctctgcgtgccactgctctgttgctctctctgtctggaatgtgccccctgcccccaacacacacacactccacctcactcctctgtccatgccacttcctccagagagtccgccctggcctccctgccctgcccatgtcgcccacagccctggaatgcctcactccacctcactggtccacgggtgcccgttggttcccccaccccaaggacagtccctgtcctcagatgtacatctgacactgtcaaaggacctggcacatagtagctactccaggaatacttattagtgaaagaaggggcgggattcagacctaccccacacatctggtggcctcagcgcctcgcacgtcacatttgtcagtgtgcactctgagtgcggcctcccctccctagtcactaactcaacctctctgggcctcagttgctttgtgcattagttcgttctcatgctggtgatacccacatacctgagactgggtaatttacaaagaaagaagtttaattgactcacagttcacagttcagcatggctggggaggcctcaggaaacttacaatcatggcagaaggcacctcttcgcagagcggcaggagagagaatgagtgctcagcaaagggggaagccctttataaaaccatcagatcttgtgagaactcagtcactctcacgagaacagcatgggggaaacggaccccatgattcagttatctccacctggtcccacctttgacatgtggggattattacaattcaaggcgagatttgagtgggaacacacggccaaactatatcactttacatgtaaaatgggacagcagtgccaccttacagatttatcgtgagaactaagccaagcagctaatagagcctgacatacagcatgtgtcagtgctgtgtgctaattgcatgtgaccccagtgtctggcatacagcaggtgctcagcgcatgtgaccccatgtgtgtccttctttcccctcctgcctcctctccagtcagttctcactgtggctctctctacaccgtgggggagcaagggaggagtctcagggtgtcctcgtgcgtgccccactgacttctgccctccctcctccagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcaggtagagcactggggtccttcctggcactggggtggcactggggtccttcctggcaactcaccagagacaccaacctagacctcagggcatctgggtattgcaggcagcagctcctgccctcgaagccccagagctggcaggtgctgggggccagtgcttggggcgtggggactcagagggagcaggtgatgcagtttgagcctgctgctgcttatgctttgcagcagctgcctggagatcccggagggagacccgggagccctgccgggagctaaggcaggcgacccacacctggattatgagctcctagacacggcaggtgagcacgcccaaccctgaacctccacagcagtccacctcccctgggcagagcagggagctgatgagaaagccggggcctctctccagggaaagggcagatagaagcagagctcaacttctgccctgggccttgaccttggcctcgaccttgcactttgggaaagtcccgcctgccagccagcgtaagccaaaggccggctgcgctctgtctgctggtgtccttgtgtttttccctagagccaggggagttgtgtctgatccacgccctgctcagcacccagccccctgctctgatctgtaacgcttgggcttcccagtggtttcagaaggcagcaggcagggtggcttagtggtgccaggctgaggcgaggcacagcgtgacatctacctgcggggagcatctctcctctcaggcgctggccctgaggcctcgcgcttctcctgtagctcatttctgtttgtgattggaccggccctctctgcttcccaagtccatgggcccgtcatgggtgggtgccttaatcctttccacctcggcgcgaccggctcccagccttgggccttgcacacagtaggtgctttgctccccatttggaattcaccccatggccaccagggggcgcaagtgccctgcgctgcccctgtgccttctgtgggtcgcagaatcagaaatcttcatctttggggactcatacacgtttttatttataatcgtgataaatcgagagagaccacccaaggcatatctaaattagatgtgagatgagaaggggggcttattcctctttatttttcctctgtgaggattctgcgtaatgccctggttgcatatacttttagtggaattgacctcaaatacatccagagtacacagctcatttcattggctttgaatgtgatcccaatgggtttttgcctgtgagccaggcctagggaactctcaggtctctgctggccctggctctgctgtgtggttcacagagtgagacttgcagccgtcgaccctggcaggctgctccctggttcgggggctcacaggctgtacagtaaaatgctagagcttgggagaccctggggagcctctagtcctaggattgacaactcagagacctgccaccaccagctgggaagcagaggagtctggggtaaggagcaggcagctgctggccagtgccagtgattgcggccacacagaaatgcaggcctgtgtggaaatgcaggccagtgtggaaatgcaggccagtgtggaaatgccgtgtagtacagtagtgcaggtctgggtagaaatgcaggtccatgtttgggaggtcaaggtgggcggatcatgagctcaagagatcgagaccatcttggccaacatggtgaaacctcgtctctactaaaaatacaaaagtcagctgggcatggtggcacacacctgtagtcccagttagtcaggaggctgaggcaggagaatcacttgaacctgggaggtggaggttgcagtgagccaagatcgcaccactgcactccagcctggcgacagagcgagactcagtctcaacaacaataacaacaacaacaaaagaaatacagatccatgtagaaaggcaggccagggccgggtgtggtggctcatgcctgtaatcccagcactttgggaggccaaagtgggtggatcatgaggtcaggagttcgagaccagcctggtcaacatggtgaactcccgtatctactaaaaatacaaaaattatctgggcgtggtggcacatgcctctagtcccagctactcaggaggctgaggcagaagaattgcttgaacccgggaggcggaggttgcagtgagctgagatcacggcactgtactccagcctgggcgacagagtgagactctgtctcaaaaaaaaaaaaaagaaagaaagaaagaaagaaagacaggccagtgcagtgcaggcccacgcagacatggaggtcaatgcagtaatgcaggccagtcctgaaatgcaggtccatgcagaaatacaggtcagtgcggaaatgcagccccagggttacagcagatattttttcaagtgaagccagaaatccagattttaggtgaaacctccctgtctttcaaatgttggcaactcattcaaatatcacaaaatagcatgtggtggtcagaccctcccagttgcagctcctcactagttacagtgattttaggaaagatgaaatcaaggtcccaagcattgaggaaggggtggaggaagagaaagttcagcctcagcacaaaggatggaacaggcagtggggcctgaggctgagggagaaggggctgaggttacaggaggttacaggacgccccatcagcagtggggtgaccaagatctgtgaagaaggggctgaggttacaggaggttacaggacgccccatcagcagtggggtgaccaagatctgtgagctcttggcttcctcccagaccttccgcagctggaaagcagcctgcagccagtctcccctggaagccttgatgtctcggagaggtaagcagcaggtgggaatcctccgaggctggctggggaaccagggccagggagtggcagagcagagggtgagtgtcctattaccaatgggaggcaacagcctttccaagcacatggggccatggagggggaggagaattccagaacactggggccagagggaagcaatggggaggtggccttgccggctctcctgctctgggcagtgcacaagccggtcgtctcccggcctgcagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggtgagccgtgcgaggcccctcctgtcccccgggctcctcatggggacagtggcagcgggtggggtgacccaggcagacttcacctcccccagacgatgcagatccactctgggctgggcctctgctctttcctgggctgacgtaaagcgttctgctcatttatagatgagagtcgtgccgtgcagaacccagcatgtcacccgtggtgctgctgccatgcggcgcttctgaccaggggtctttgcatgaggccccttgacagggctgctctgggtggtcactttgggtgtgtacagtaaaatacacgtgacataaaattcactattttaaccactggggcatttcttttctttctttttttttgtttgttgttttgaaacagggtctcactctgtcacccaggctagagtgctgcggtgcgatcacagctcactgcagcctcgacctccccaggctcgattgatcctcccacctcagcctcttaagtagctgggaccagaccacaagcatgcgctaccgtgcccggctaatttggggacattttctaaaacttttttttgttgttgttacgaaacgcacaaaactgctgagaagataaatggacacaaatatacaacctggccaggtgtggtggctcacgcctgtaatcccagcagaaggctgaggcaggcagatcacttgaggtcagaagttcaagaccagcctggccaacacggcgaaaccccgtctctactaaaaatgcaaaaattagccaggtgtggtggtgggcgcctgcatggtcagggggtgactttgatgtggcctaaaagcagaattattaaactttaggaaaaaaaaaaacttctgggcacagtggtacatgcctgtagtcctagctactcagatgcctgagcccaggagattgaggctgcaatgagctaagattgcaccactgcactcgagcctgggtgacagagcaaagccttgtctcaaaaaaaaaaaaaaaaaaaagaaaagaaaaaaaaaggccaggcaccggtgggctttatgcctgtaatcccagcactttgggaggctggagcaggcagatcacctgaggttaggagtttgagaccagcctggacaacatggtgaaaccccgtttctactaaaaatacaaaaaaaaaaaaaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnactggggatgggggctctggggtgggaaggtgagcacagaggcggggagaggatgcgtctgaacccctcagcagggagtgttccatgcacccctcactgcccccttggaacaggctgtccaaatgctgagctcccctagggctccaatgatagcacatggagcacctaattcaagcgtccttcacgtcctccacatgacccgggaagcctttctttacatgtcatttttttttttttttttttttttttttgagacagagtcttgctctgtcgcccaggctggagtgcagtggctcgatcttggcccactgcaacctccaccccctgggttcaagcgattctcttgcctcagcctcccatgtagctgggattacaggtgcccgccaccacacccggctaacttttgtatttttagtagagacagggcttcaccatgttggccaggctgatctcgaactcctgacctcaagtgatccacccacctcagcctcctaaagtgctgggattacaggcatcagccaccatgcccagcccttctttacatttctagttgtcctcttaagcagcagtccccaacctttttggcaccagagaccggcttcatggaagacaacttttccacagaccgggttgtgggggatggttttgggatgattcaagcacgttacattgattgtacactttatttctattattattacactgtaatatgtaatgaaagaatcatacactgaaccataattcagaatcagtgggagccctgagcttgttttcctgcaactagacggtcccatctgggggtgatgggagacggtaacagatcatcaggaattagattctcataaggagcgtgaaacctagatccctcacttgcacagttcacgatagggctcatgctcctctgagaatctactgctgtgctgagctgacaggaggtggagctgaggccgtaatgctcacttgcccaccacgcccctcctgctgtgtgacccgggtcctgatggaccatggaccagtaccagtatgtggcccaggggttggggaaccctgctcttaaggttcccaattatcagctctgaggtagttcaagcaacagagccccttgacgatgttcagggagatagtcccgatatcctaagggggccaattagattctaatggtgttaaaacacatcttaatttttattgtaaaaatatctactctcctaagcttagaacaatattgagaagaaatgaagtggatggtggaagccctggggggtgggccttcacagtggggaaggctgtgggtggagagccagggcatcgggtaggtgaaggccagggatgccactcagcatcctgtagggcccggtatagcccgcagcagcacagaatgatcccaaggctaagaaacctctatctagaatgctcttgaatgttctagaaccgaggttctttcttttcttttcttttctttttcaagacaggaaagtgcttatcacaaagaacccccgatctcgactggggaagggttggcagttgactctctggccagcactatgtgtagcacgcatcactagaggtgtgaaggccccacagaggctctggtgtgtggctttgttttgaccaaggcgtgcaggcagtggtcctacggcagggctggcccgcgcctcgcctcagtgccctcagcgccttctgtcttctggctggattcagagtcccgggggaaagagactgaccttctcgacttgccctcaggttgattacgaagcctcagagcccttgttcaaggcagtcctggaggacacgaccctggaggaggccgtggggcttctcaggagggtggacggcttctgctgcctgtctgtgaaggtcaacacggacggtacacataccactcctctcgtgtgcacagctgcctggccagactccatgacccttaagtccctggtggttcttctgcacgcccagcagccagggacccccagagccaagagaggatcagccaggctgtgccccaggtccccaggaggcccccaagccagctggaaacctcccacccactgactacagtgccagagcagcttctgagactgggagggtccttccttctctcctactttaattttctgcaaccttcctcgcagaggctcgtatctgtggctcatctgtggctcatgtccccttttatcaggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccaggtgagcagctgcctcgagctcggtgcgtccccagagaggcccacagggaaatggcacccagcctgcctcggcttcctcctcctgcccagcaatagagggtgggcgtggtgagacccccctaaggagggaagcctgccaagatcactgctgaagatgttgtttctttgtgatggatgctttatatattgcaaatgaaatgttcattctagaacattctagatctgggtttcttagctctgggtttcttagctttggtaccatggacgtttggggctggatccccgtctgtggtggggccgtcctgggcactgcaggatatagagcagcatccctggccgccctacccaggatgccgggactactcccatgccccagctgtgacaaccagaaatgtctctataggttgccaagggtcccctggttctcctaggactgtcttggtcttagcactgaaagccccacttgcagggaagcccctcggtcctgggcaagcagggacagctggtcaccctccctggggagtgacattgccccctgccttgctccattgaaaaccactgctctaggccgagcatggtggctcacacctgtaatccaaacactttgggaggccgaggcgggtggatcatctgaggtcaggagttcgagaccagcctgggtaacctggtgaaaccctgtctctattaaaaatacaaaaaacttagctgggcgtggtggcaggtgcctgtaatcccagctactcaggaggctgaggcaggagaatcacttgaaccccggaggcagaggttgcagtgagccgggattgagccattgcactccagcctgggcgacagagtgagactctgtctcaaaaaaaaaaaaaagaaaaggaaaccattgttctagatcagcctatgggaggctccaagtttcaagtgcacggaacgcacagtgctagaaagcaggagtgttgagctcagcacccccatcactcattgcaaactcaagtcccctggggatcggagccagcaggtccagggagaggcctggcactctgcatttctaacagctctctcggtgactccaggctgcaggccagggacccaccatgaatattgaggtcctggagtggggccctgtacgctggctgctcaacagcaccccctgggtcccgccccaggacaagtaaatcagcatctccaggggtgggccgaggccctggagtcttttgaaagctctggagactggcatggccgccaggatggagcgctccagcctgcagcaaagggatgtgtggagctctaggtggaggcccttctctcccacccggccatctcccccactctcccctgctcggctctcccctgccctgctcacctggcaggaggcagctgggtcagggcctctgctggtctctgcagggctcagcagcagctcatagccctcatccaggacatgactcagcagtgcaccgtgacccgcaaggtgaggctccagggaggggcctggaccccactggggtgggctggaagaggggctcggtgctggcagggtggcaggaggcactgtgtggagagtgggctgctgattggagggtaaccccacctgtctctcctctgcaccccttcaaaccagggcagggtctgcagcccctgcccagcctgcaggctcttgcacaagtgcagacacacctcaggctgttctcagagcatctgcgcctctgcatcactcccaggtcgccctagtgccaatcatctcccctgaattcccattcctgttgatggcttcaacagctcctcctcatcctttctctgtccctcctttagccatcttctgggggaccacagaagctggtccgcatcgtcagtatggacaaagccaaggccagccctctgcgtttgtcctttgacaggggccagttggaccccagcaggatggagggtgaggcctggtgagctggcacaggggccactggctccaagtgggtgaggggctttgggagctgctgctagttggtcagctggggcagggggatgccactcatttaggccaggatctggtcttcaagaatcatggggctgggtgtggtggcgcacacctgtaatcccagatactcgggaggctgaggcaggagaatcgcctgaacccgggaggcagaggtggcagtgagccgagatggtgccattgcactccagcctgggcaataagagcaaaactctgtctcaggaaaaaaaaaaaatttcaggagaggagtacaggacagagggagggctaggaccctgtgccctggaggatggctgaggagaagggtgccactctcccagatcctttggaaggaagaaaaccctggcttccgccatcctcccttgggcctataggaaacaggattaagttgcaggctgcaaagcagtccctggagagccacagagctgtgtaacccccgtgcaaaggagccgctcagccaggggctatggaactgggagtgagtcctgtgaccgctgagcctgtgcccctggaattctaggtgctggggctgctgcagtgagcaaagcagacccagtccctcccggggcagggtaggctggctgggggctgccgcagcctcacccaccctcaggatcctctcctccacaggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcaggtatgctgttgcctgggaatccctctaccccttccaccttccctccctccctcctccccttcctccctccttcctccccttcctccctcctccttccctcccccaccacgcacattcccacactcacctgctgtgtccagatagttcaggatggaggtgcagggcacagagcggggtgtgcagggtcaggtttgtaaagtggacatcctaagaagagcttctcccagtgctggcagggttcacggggacaggggtgtttaccatgggactcccccagacccccacacagctggtctatgatggccccgtccaatgtcacctgtagagtacttgagccaggaggagtatgaggcctggagccagagaggggacatcatccaggagggagaggtgtccgggggccgctgctgggtgacccgccatgctgtggagtccctcatggaaaaggtgaggtcaagggcggggtgggcaggggagctgtcctgggaagggtttcaggaatgcagaggagggggatgagataaaggtacagggaccgacctgagacctgggtgaccttgtcgccgacctctgggtcccaacagcccagcaggagcccaaaactcatctcagccagttaggatccacgtgactgtgggtgaggtctcccaactccttgaatctcagtttcctcagcttgggggatgtttaatagatatttgttcgagaatgaataaatccgagctaacaacactctccacgtttgaaggcgcaaacgcgtgaaaagcagctccccgtgaaccacagctttgtgtctgcacaggcacgggaagccgagtctggcatctgcgtgcctcctgtaggggctggcggagctccatgccaagttcacctcatccccagagctcacaatttctagattttcccagtgaaaaatcaaagggatggaaactcttaatactgcatagcacacagcctcatttagaaagtggcaaactcagctgggcctggggctcacgcctgtcatcccagcactttgggaacccgaggtgggaggatcgcttgagcccaggagttcaagaccagcctgagcaacacagtgagacccgtctctaaaaaaaattaaaaaataaaaagagaagaaagtagccgggcacagtggctcgcgcctgtaatccccacactttgggaggcctaggcgggaagattgcttgagcccaggaatttgagaccagcctgagcaacacagtgagacacccgtctctacaaaacatttaaaagctaaaaaaattaaaagtgggccgggtgcggtggctcacgcctctaatcccagcactttgggaggccgaggcgggcagatcacctgaggtcaggagatcaagaccatcctggctaacacggtgaaaccctgtctctactaaaaacagaaaaaattagccaggcgtggtggtgggcgcctgtagtcccagctactcgggaggctgagacaggagaatggcatgaacctgggaggcagagcttgcagtgagccgagatcgcgccactgcactccagcctgggcgacagagcgagactccgtctcaaaaaaataaaaaataaaaataaaaaaaagagagaagaaagtggcaagctctattccctcatctcctctacaaaattcagctctgcccagctcctgccctgccctcagcctgtccggagggcccttctgacctgggcgttggctccctttgcttcctctgaggcctgtgatcttgactcacttcttctctccctcccacaaagaacacccatgccctcctggacgtccagctggacagtgtctgcaccctgcacaggatggacatcttccccatcgtcatccacgtctctgtcaacgagaagatggcaaagaagctcaagtaggtgcacgctgggggctgggcaggggcttcgaagcggctcctgggctcccccaaagcccacggcaggtgcctctggagtgtgctctgcggtttgcaggaagctgaggcgctgacagggccgtttccgcacaactttgggacaagggccccgctgattgctcatgagattcccctgattttggccgggcgtggtggctcacgcctgtaatcccagcactttgggaggccagggtgggcagattgcttgaggtcagcagttcgagaccagcctggccaacatggagaaaccctgtctctattaaaaatacaaaaactagccaggtgtggcggcgggcgcctgtaatcccagctactcgggaggctgagacatgataattacttgaactgggaggtggagttgcggtgagccaagatcgcgccactgcactccagcctgggtgacagagcgagactctgtctcaacaaaacaaaacaacaacaacaacaactgctctgatttcacgcttaccaaacaaacttgatttcaaatctggcctctccagaatcttgataccaggatgacggtgccttttacagtgggcaaaagtagcctagtcactggaaaatgacattttataattgaaatttaaagttgtaaattaacaaattggcactccctcccccaagagcagctcagaggaccattgtaaggccagaaccccacccggcctcagctccactgaccctccacttactggtgcttggctagcacaatctaatccttgtcggctaaggacaaaaaaaaaaaaagtaaaaaaattacttggtttcctggggacagaccaagatgtcctgctactgtgccctttctactccaggaagcaaggctgtgttctagacaacctgcctcccaccactggggcctggggcctattttctttacaaggtcccctcaaagcgaggccacctgtgtttaggggtgtttgggtgcatgtcatcactaccctagccagggctcctgggcccttgctctcccctgagcccgccccccccaactctggcctgtgcaggaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtggagacggtactttcagtgggtctgtgccccgtggcccctgtgcctgttcggtgggggtgtcccagagaagcctggcaccagtacccccgtacaaggcccagcggactctgccttcccctgacctggctttgcaccccagcccttcttgggccaaacatctttactccaccttcagggctcggggaggacccaggtccgccagcacctggccttgcccctgcctcctggggctgttgcagactgaatgtcattttgacagcagtgtccaagaatcaggaagctgttctagaattcaggttggtatcatcataaatgagttcagaaaaagaacttctgtatattttactaaaataaaaagcttttacaatagctggcctgtggcctcctccagcccaccccagtatggagtgatagggagggaagggcaaggggagcccacctactcaaggaagcgccctctccttcgaggggtgtccaggccgaggggtgtccaggccgggcttctgctcccgaggtgggtggaggcagggcaggaacggcacattctcccagcaacgccgacgtcatccaagaattaacccaagccagaggacgggcatcgccacccagcaacgccagtgtcaccgaagaattaacccaaggcagaggatgggcattgccacccagcaacgccagtgtcaccgaagaattaacccaagccagaggacgggcatcaccacccagcaatgccagtgtcaccgaagaattaacccaagccagaggacgggcatcgccatgccttcatcttcggacactctcaaaaaagataagcttctgcccagaaacaccacaggttcaagctcatcactcagggagcctgctgccaatcagctgaaacctgcctggggaacagggacttgaccatggggcaaaacagaagaagcagaaacctgcccaaaggtcgctcaaaggcttcctctaggccagacgctggtaagagccaggcgccgtgctcccaggtgagtgtcggtgggacctgcgtactgcccacgcggcaccgaagcccctgcctgctctctgtgaagggttcagaagtatctgtggctgccaaagcctgaagagggcctcaggcctcccatttgcaggtccccaaaccaagccagaaaacaagactcccttgtcatgggctgggggcgctgccctgtccgcagaccacgtatgtctagaattcccgtgctgggacatggttcagacacaaggacaactgtgtcccctgccatgacggcagtgcccctggtggtggaggggctgggcacatgctctggtcacatgctctggtccccctccaggcaatggcaagagtgaccccacaggaaggaagaaccctccttggatgggagtgtggacggaagggctgttgccactactccccaggctggccggccacacggacacgtgtgggatgtgtctgggacatgcctgggatgtgtgcacaggcctcctgggatggtcacagctcattgtggaggggctggcactggggagagagcttctcctccaggacgccgtcgggggcgcacacccaggggtcgtgggtctcccactgccacttggccagctggtcccgaagcatctccagaagctgagcaaagtgcgggtcggtggccaggttctgggtctcgtgggggtcccggctccggtcgtagagctcccagcgcgcccggtagtagtaatgacggaggtccttgtaccagcccgtgggctgaccagctgtggtgcggttcaggaggtcctggaaggtgggtgagacgtagaagtcctggtcgatgggaaagggcatcttgaagttgaggttgtgcacgaggcggaagtgccggtgctgcacggagcgcatggggtaggacatggtgacctcgtggtggctctggctgccaaagacggtggcccagaggggctcggcctccagcgccggcaggagggaccggccagtgaggtggatggtcttcgagccaaagatggcgtagctggggtacgggatcgagaaccaatccaagatggtgggcgtgaggtctggaagggacgcggcatctcagagcagcagagccctcagcacacaggagctgccctcggaagggccgaacctacgccactctgggcggctcccttctccaatccaatcagcagcgggaggtgccttgtcgagccgacacctctcaccgccacgtcatctctctgggcctcagtgccttgaatggtataacaagaggccctgattcggtgacatttaggatccttctaaaatcccatggactggaaaagaagtctcctttttggtagctcgtgtactccagcccctgtggtgggtgtggccacagtgctcctggctcatcatttggggccagagagagatgtgggccccaagagagatgtgggccgcgagctcggagggaaagggaacctgagtttcctgctgtcccgggcccaccccacctggaggctctgccaggcagtgggcaggacacacgagcctctgccctgtgccgaaggggtcaccccgagcccctcacaaagtcttcctgcacccgtgtctttgtctgcacatccataacatgggactagatgtcctaggtctttttaggaatgagcagggtcatgaggtgctttgggtcccccaggaaggcaggatggggtgcacggatgctcagagaggggtccccaggcccacagtatcggcatcacctgggaacttgtcagacatgcaaattcttgagcccgccaagatctacggaatcggacaccctgggatttgcaatttagatattaacaagcatcccaggtgattctgaagctcatcggaggtaggcggggaaaaggcaatggttttgaaagcagcaggatccaagcgagaatcctagcttagtgcttaccagctgtgcaatcctgagcagcttacttcacctctctgagcctcattcttttcctctgtagagtgggagtgacagtcccttcctcacccagatgatatgagagccacattaggtaatgggtgtggagcagcatctgacaggtcatggccccgtcccagatccactcccacacctttcctgacggagacagacaaaggcatacctaggaggctcacgtaggcctcgctgacttggccccagcgttttgggtgctccggggatgacaccagtaagggttcagcagtgcccggccagtacaggttggtcctgccgctggggaaggggatcccgttgtcggacgtgaagatcaccagtgtgtcgttcaggacaccggcgtcacgcagctcctggagcaccagtccaactcctgtggtgaggggccgagaagcagagctcagccgcagacacggagggaggcagcgggtggtgtgtgtagacccacctgctgctgcatccggccgctgggctccagcgctttccggattcgaaagcaccctgtagttcttcccaatggccctggctcttgcccagctcttgcccagctccgcccagctcccattccctgagcaggcctcgaatgggcctccagggactccagccatcccttggcacttctgtgtcacccccaggcagctgctccctggtgcccgccggcttttgagttctccggaatctcgtgtctgtcccatggagcaaatagggcaggggccagaggacgaggcttcctctatactcgctccttcccagctggggccagaggacaaggcttcctctatacccgctccttcccagctcactaagaattaatggcaccaatagggaaatggcaaaggtcctgacctcctgtcgtccctgaccccaaaagacatgtgtgctggaatctgtgaaggggttcttgtttggaaaggggaacttcacgaataaagatcttgggacaaaatcatcctgaagtgctcaggtaggccctaaacccgacggggtccttataagaagcggaaacaggccgggcgcggtgcctcacacctgtaatcccagcactttgggaggctgaggtgggcggatcacgaggtcaggagttcaagaccagcctggccaatgtggtgaaaccccgtctctactaaaaatataaaaattagctgggcgtggtggcgtgcggtgcgattgcagtcctagctactttggaggctgagacagaaaaatcgctcgaacctgggaggtggtggttgtagtgagccgagattgcgccactgcactcccgcgtgggtgacagagcaagactcagtctcaaaaaaaaaaaaaaagaagaagtggagacacaaagaggagacacaggaaaaaaggccatgtgaaggcttcagcggggatgggggcgattctgccgccagcccaggaacgcccagcactggcacagcccccagaagttggaagaggaaaggcagggtctcccctaggccttcaggggagcatggccctgctgacaccttgatttcaaacttctggcctcctgaactgtgggagtacaaattttggttgctgtaagccatcaaccacaaaaaactcacagacctcaagatctccatctgcatatgctaaggaactccaaacccccaaatctgacccaggtcctgtgactggaaatatctgaagtcttcacgcaacctctggggcacccgaaggccccagcccaggagcaggtccacatcagggcagccccggggttgggtcctgatgccacccacaggcccctcctctcaatgtgggctctgccagctgcagcacagggcctgccacactgggaccctcacccacattatgccgtgacctaagagggcgctggcccaggatgggggaccccggccgtggcaccccctccagtgcccggttctgcaagcccaccttggtccatgcggccgacggtggtgtactgagcggccaggtcggctcgggctgccggggtgttggggacgaagtaaggcacctggggcaggcggtggggagccaggcttagaacaggcaccgggggagcggtgtccagccttctccccggggcctcctgcaaatgggttagcccagaacagcctcactccggaccaccccgtctctctacggttctctctgtggccccgaggttgggaacctgaatccgatttggtcagagcctctttcttcatcatctagggccagggctgcaagctcgtaggaggccagggtccccgacccagggctgacgggcgtcctgaaacacgggaggggccgtcctaccagcacgtccagtgggtcgtaggcctggggggtccagtctgggatacgacccatgccgctctctccgttgccaaacttctcacagaaggttccgtactggggctgggagtgcccacagcggtgggggtcgtggaaggcgacgtagaggaagaaaggcctgcacgggaggaggctcattgccaaggctgcggggccactgccacgtggcacaggaagcccctcggctctgcctcctcctctgtatctggaagtcaacctgtgaccctcactgcctcagtttccccatgtcccttctccctctgaccaggctaactcgagtacctggaaccttctcccctgcccccattcgagccacgtgggggcccatgcatcccgccggaagactccgggctgtgctctggtaccggccgccagggggaaggggcaggggccccgactcataccggtcatcctgagtctgcaggaatttccggacgagcagcttaattctagtgatgttccgccccacctggaggacggagccattctcctccgtgtacgcaaagtcaaacgggtacacggtctccggccccacgtgcttcttcccgatgatgcctgggcgggaagagaggcctggccagagtcccttcagcctcccaaccctttctgctcccttctctgcccctctcggccctaagcgcactgtgggttctcgtggacacacagcccagccaggagacccaggcccagatcctttgggacaagagctaagggcaggccacgggggctgagcgtgccttggtacaaggtgccgaacctcctgggctctggcctggcctctgtgcctcaccccacgccctgtcctcggcacggggtcctcacctgtgcgcacaccagcttggctgagcagcagcggcaggctccgcaccttgtcgaaggagttgaagtggtgcacgtcctggtgcagcccgtacatcccattctgatgctgccagcaaaggcgcatgaggtccggggcccccggacagccagagcccgcctgccgcacctgttctcccacggccctcccatccccaggggccttctcggggccctgatttagacttcgagtggccagcacccagagacactggctgtacctcccactccctgcccgataggcccatgggtccctcccgtgaaaggaggacttcgccagaaagaaggggacctgcagggcgtgcaccgacacgagggtggccttgatgttctttttgcgtatccgtacttttgaactcttctgttatgatcacacgttacagagtgaaaaagacagggtcaggccttgttttattacctagttattttatattgtaaaagatgtgtacattttaaaaactcagaccgccggccgggcgtggtggctcacgcctgtaatcccggcactttgggaggccaacgcaggtggatcacgaggtcaggagatggagaccagcctggccaacatggtgaaacctcgtctctactaaaaatacaaaaattagctgggcgtggtggcgggcgcctgtagtcccagctactcgggaggccgaggtaggagaatggcttgaatctgggaggtggaggttgcagtgagccgagatcacaccactgcactccagcctgggcaacagagtgagactaaaagaacaagtgtccttaaacacccatgttcatagcagctttattcacaacagccaaagggtagcagcaacccaagtgcccactgacggatgaatatggagaagcaaaatacggggcccatccatccactggaatatgagtcagccctgaagaggagggaagttctgactcgtgctacagcatatggttaaccctgaggacattgtgctgagtgaagtaaggacacaaaaggggggccgggctcggtggctcacgcctgtaatcccagcactttgggaggtcgaggcgggcagatcacttgaggccaggagttcgaaaccagcctgaccaacatgatgacaccccatctctactaaaaatacaaaaattagacaggcgtggtggcgcgcacctgtaatcccagctactcgggaggctgaggcaggagactcgctggaaccggggaggcagaggctgcagtgagccaagatcgcaccacagcactccagcctgggtgacagagtgagactccaactcaaaaaaaaaaaggactagtcctgtgtgattccactcttatgtggcccctggagcagtcagattcatagagacaggggatggggagggagaatgtggagctggtgtttcatgggacagagcttctgtttgggtagatggaaaagttctggagatggatggtggtgatggctgcataacactgtgaatgcacttaatgccccggaactgtgcgctgaaaaatggctaagatgggaatgttgatgtttgtgcattttaccacagtaaaataggagcatgtgtgccttaacggtgtccgctccctgcaccatggcgttcctgggacactgtggccatggcggttcacgctgagtgagcccaccaggcctcgcactaagtgtttacatacaaagcattagccccgccaatctccataactagagtggcatctcattacacccaccatcttacagatgaggaaactgaggcacaaggaggtaggtgacttgctcaaggccacacacagcagtgcagccagggctggcgggtgagtcggagcccctagtctgcactcacagccataggctgtgcctcctcctggaggtgggagggaaagtgggcaacaccccccgggatcccagggatgggagacgtggcagaggcctgggccccggacgcagcctgtctactccctgcccaccccctcctcccgccccttgcacctcacctggggcaggccagtgaggaggctggcgcggctgggagagcagctgctgaccgaggtgaaggcattgcgaaagaggaggctgcggcgggccaaggcgtccaggtgcggggtggcgatggcgctgttgttgtacgcgccactctcaaagcctccgtcatccgctgcgtgaggtgggagacagagagtgcacggtcggctgcggtcacgagaaacagcactgggagtgagggaggctgggactgtgatgccagaaggcgagacacccaggtgggcatggtactggctcagtgtgaacactcagcgcgaaatgctatcgtgacagagcactccattacctaggaggcatgacacccgagtgggtacatcaggcaagcatggtatcagagggcatgttagcaggtctcatacttggtgggtatgttagcaggcaggcatgtatccagaagaccccatacccactgggtatgttagcaagaaggcatggtacctagtaggcacaatacctggtgggtatatcagcaagcaggcagggtgcccaggcaggcctgatacccagtgggtatgttggcaggtgagcatggtatggaggctggactgattgatagatggtgggtatgttggcaggtgagcatggtatggaggctggactgatagatggtgggtataagcaggtaggcatggtacccaggcaggcctgataccagtgggtatgttagcaggtagactggtatccagcagggatgatgcgtggttggtatgttagcaggcaggcatggtatccaagtgggcatgataagcaggcatcataccacaataagcttgatgataccctaagcaggcatgatacccggtgggtatgttggcaggtgggcatggtacacaggctggactgatagctggtgggtataagcagatgggcatggtacccaggcaagcctggtacctgcataggcatgttagcaggcaggcatggtacccaagtgggcaagatactcatgcaggcatgatgacccaacaagcttgatgataccccagcaggcatgctacctgggtgggcgtgttagccggctaggcatttaggcagacagcggctgagcgcatggccacagaactgctgggcaattctgggctcagcggaaaccgcatggggcagagggcaggagagcctcgcccagggcgcgtctaaagctctatgtgtgtgcgtcccaccgctgcttctcactgatgccatctcaaaggcctagtgaccttgcaggttgtctatttcaaccctttcatcctacacaaagcagctgaggcccagaaaggtgaggtgcagtgcccaaggccacacactgggcagcaggaaacagggacaggccgctgaactcctacaaccacaccaagcttcttccccctgctctggagtagaggacactgggggcaccacaggagaggctggtgggaacccccagaccaacactttccccagctccctcagaggcaatgtggtccatggatggacagaggaggctgggcaccttccagctgggcttccatcctccaccccacagtacccacaggtgtgagcacatggcagccacataaacctggagggagagcgggatgggctgtgctccgtacccgcaggccaggaagaaagctgcccttctccaaacccagagtgtctcggcacttggctgtgggcctgctatggtctgaactgtgtcctcccagaattcatatgctgaagccctaacgccaacatcactgtatctggagacagggtccttaattaagggtaaatgaatcataaggatgagatcctgatctgacaggactgtggacttaaaggaaaagaaagagagggccgggtgcagtgtttcatgcccgtaagcccagcacccgggaggccaaggcaggaagattgcttgagcccaggagttcgagaccagtctgggcaac

SEQ ID NO: 449 - DNA, 3802 bp, Homo sapiens
tctgcccagctccgtcccacccagcagcccgcagagaaaggaggcagctggcaccacactgggctttggagacactgcggggactgtggaccccaccctgctgcacggagctcctgcaaaagcaaacctgagaaccttgggtcctcccagcgcccagccatgggggaactgtgccgcagggactccgcactcacggcactggacgaggagacactgtgggagatgatggagagccaccgccacaggatcgtacgctgcatctgccccagccgcctcaccccctacctgcgccaggccaaggtgctgtgccagctggacgaggaggaggtgctgcacagcccccggctcaccaacagcgccatgcgggccgggcacttgctggatttgctgaagactcgagggaagaacggggccatcgccttcctggagagcctgaagttccacaaccctgacgtctacaccctggtcaccgggctgcagcctgatgttgacttcagtaactttagcggtctcatggagacatccaagctgaccgagtgcctggctggggccatcggcagcctgcaggaggagctgaaccaggaaaaggggcagaaggaggtgctgctgcggcggtgccagcagctgcaggagcacctgggcctggccgagacccgtgccgagggcctgcaccagctggaggctgaccacagccgcatgaagcgtgaggttagcgcacacttccatgaggtgctgaggctgaaggacgagatgctcagcctctcgctgcactatagcaatgcgctgcaggagaaggagctggccgcctcacgctgccgcagcctgcaggaggagctgtatctactgaagcaggagctgcagcgagccaacatggtttcctcctgtgagctggaattgcaagagcagtccctgaggacagccagcgaccaggagtccggggatgaggagctgaaccgcctgaaggaggagaatgagaaactgcgctcgctgactttcagcctggcggagaaggacattctggagcagagcctggacgaggcgcgggggagccgacaggagctggtggagcgcatccactcgctgcgggagcgggccgtggctgccgagaggcagcgagagcagtactgggaagagaaggaacagaccctgctgcagttccagaagagtaagatggcctgccaactctacagggagaaggtgaatgcgctgcaggcccaggtgtgcgagctgcagaaggagcgagaccaggcgtactccgcgagggacagtgctcagagggagatttcccagagcctggtggagaaggactccctccgcaggcaggtgttcgagctgacggaccaggtctgcgagctgcgcacacagcttcgccagctgcaggcagagcctccgggtgtgctcaagcaggaagccaggaccagggagccctgtccacgggagaagcagcggctggtgcggatgcatgccatctgccccagagacgacagcgactgcagcctcgtcagctccacagagtctcagctcttgtcggacctgagtgccacgtccagccgcgagctggtggacagcttccgctccagcagccccgcgccccccagccagcagtccctgtacaagcgggtggccgaggacttcggggaagaaccctggtctttcagcagctgcctggagatcccggagggagacccgggagccctgccgggagctaaggcaggcgacccacacctggattatgagctcctagacacggcagaccttccgcagctggaaagcagcctgcagccagtctcccctggaagccttgatgtctcggagagcggcgtcctcatgcggcggaggccagcccgcaggatcctgagccaggtcaccatgctggcgttccagggggatgcattgctggagcagatcagcgtcatcggcgggaacctcacgggcatcttcatccaccgggtcaccccgggctcggcggcggaccagatggccttgcgcccgggcacccagattgtgatggttgattacgaagcctcagagcccttgttcaaggcagtcctggaggacacgaccctggaggaggccgtggggcttctcaggagggtggacggcttctgctgcctgtctgtgaaggtcaacacggacggttataagaggctactccaggacctggaggccaaagtggcgacctcgggggactcattctacatccgggtcaacctggccatggagggcagggccaaaggggagctgcaggtgcattgcaacgaggtcctgcacgtcaccgacaccatgttccagggctgcggctgctggcatgcccaccgcgtgaactcttacaccatgaaggatactgccgcgcacggcaccatccccaactactccagggctcagcagcagctcatagccctcatccaggacatgactcagcagtgcaccgtgacccgcaagccatcttctgggggaccacagaagctggtccgcatcgtcagtatggacaaagccaaggccagccctctgcgtttgtcctttgacaggggccagttggaccccagcaggatggagggctccagcacgtgcttctgggccgagagctgcctcaccctggtgccctataccctggtgcggccccatcgacccgcccggccccggcctgtgctcctcgtgcccagggcggttgggaagatcctgagcgagaaactgtgcctcctccaagggtttaagaagtgcctggcagagtacttgagccaggaggagtatgaggcctggagccagagaggggacatcatccaggagggagaggtgtccgggggccgctgctgggtgacccgccatgctgtggagtccctcatggaaaagaacacccatgccctcctggacgtccagctggacagtgtctgcaccctgcacaggatggacatcttccccatcgtcatccacgtctctgtcaacgagaagatggcaaagaagctcaagaagggcctacagcggttgggcacctcagaggagcagctcctggaggctgcgaggcaggaggagggagacctggaccgggcgccctgtctatacagcagcctggctcctgacggctggagcgacctggacggcctgctcagctgtgtccgccaggccatcgccgacgagcagaagaaggtggtgtggacggagcagagcccccgatgatgcaccgtgccccttcccgggactgtgggggcttctgtgtgcctgttaatgcagtcctgttcctcagcccaggccctcttggcacagctgtgggctccttggcacatgaggccggctctccccactggctggggtctaaccttgaaccctcaccacgtgcaggtcacacacagtgaagccacttgtaactgcacacttttctgtggaaacatcttcaccctttaccaggcttggcatggtctgaactggaaaccctgagaatgtttctgcagtgggacaggagggacgtcttcccatgccttccctagaaccggaggccccggacttctctggaaaaccgcctgtctgcaggcccgattcaaatctatgggggctgcacttcccttttacattttgatgtgtcaaaggcttttggagtgaccaaaagcacagaggcagcgggtggggcgcctgggtggtccccaaggtcgctgccacccttgcccggggcagaggcagaagcccacatatgctgtgacgctggccaccttttctcagcttctgaggctgcgatgcctcaggaactccagtttacagagaccagtgtgtttacttgtaaataaagcctctgcgtggtggagacggtact

SEQ ID NO: 450 - protein, 1004 aa, Homo sapiens [sequence omitted]

SEQ ID NO: 451 - DNA, 256525 bp, Mus musculus
  misc_feature (1)...(256525): n = A,T,C or G
ttaagctttagtggctggagactctcagctcttcagtggctctcaatgctcacgttggaggctcagtgctccagttaaagattgcaaacagcttggcaacttagcatctttgtaatcctcagcttcttgcagggaatggacagcagcatcaggcagcatcaaatgatgccataacttcccaagttgcaagtcacaagcattagagttgtccacagtcagcaatggtggtcttgtagggttctatgctatttacaatgcccttcatcttcccagagaccacagttgccatccccctacttttaacatgcagatgaaaactgagaactattggtgttctgtccagtgtctgtcatggactaaatcccaggctctgtacacttcaggatgaaggtttcattcttagatttctctctgtagatggacttgccaccactgccatcattattgtgtgtgaagtcacctccctgtcacaggaatcctgggataatcctgtgaaaagaggaactgttatagccaggttctttacattcagtgcttagagcatcaaagttttctgttgcctatggaactttgtgtgcaaacagccagaaagagaagtggcccaggggttcaccatcagccacagtgaagtgcacaatgggaactggagagaggaggcacacacttttaaccccagcgctcaggaggcagaggaaggcgagctcaaggccagcctggtctacagacccagggtagccagggccacacagagaaactctgtctaaggaaagagagagaggaagagggagagagggagagagagaggggaaggaaggaaggaaaggaaaggaaaggaaaggaaaggaaaggaaaaggggaaagaaggggaaagaaagaaggggaaagaaagaaggggaaagggaaagagggaaaggaaagggggaaaggaaaggagaaaaaggaaagggggaaaggaaaggaaaggaaaggaaaaaggaaaaggaaaaggaaaacatagtgggtgaccatggctgccaataagaggttccggggacgatagtgtttgcagtgcctcagcatgtgtagtttttctttgtgtgtcagttaaacaatgaagaggcccataaataataaagtgggtaaaggcctcctacgagactttagttcagtacctggaaaacgtaaaggtgggaagaactgacctctacatgtgctcttaggcatttgcccctgtgtatcacaggctgtccttaaactcaaagagattctcctgcctctgtttcccaagtgctgagatgaaaattgtgtagcattacaaaaagttttgttttgttttgttgttttttaaacgagaaagagctaatgtgactttgaggtacagttttgaagtcgtgttgagacatatgacctggatgaggtgacatgtcctcctctgcacttgggaaggctgcactgaagaacttcctaccccgagctatggaagaattgtcagctctgtcctttgttttggaggctttacccaaagacgctactgtaatgggttgtggctccattacctccttcctgaaaagttcaaaccctcctgtcagcaaggatctcagacagtgagatccaaagacaggcacagcctgggggtatgcagagctgaggaggtgtccacctcagactgtacgcagaaggcaggttatggtctgaacaaggcatgtgtgagctgctctgtaggaacagcattgaccaccctgaaaagggcctgcggctagtagtcttcagtgtttcacataccctgccttgttgtttgtgttgaaatgttcctgaagaatatcgctactgagatttgttttttgtttgaaggtttgaaggcagataaccaatctggatctctctagattcagggcgggggagacctgagtttgattctagcatccatgtacaaaattgaatgtagcaatgtgggtttatattagaatcctagcactgggtaggcagagaccgcagatctctggggcttgctgcaagccatcctagcctaattggtgagctgtaggtcaaggaaagacattgttctgagtgccaacacccctggttatcctctgacctctaaatgcatgtgtgtacactcatctgggcacataaacacatgttcccatgcacccacacacatgagcgcacacttacacactcgccttctatattcccatggatacacacagctctaggtgattttgagacactgaatttttctaaaaaattttactgtctagggaagattgatttctttttcctcccaaagccagggtcttattatatactttggcactggcatagcaatcttcttcctgtctcagcctctaggtgctgggattgcaagtgtgtactatcatgcctggtaggaaacttctttatgaattatttttgtggatccttctggaatgttaggctctatgcttggttgtccttgctagccctgtttgtaagtgaggcatggctgcgttcagatgaggcactgaggtgtggatgaaatacagcctttcaatttgtgtactacatggtcactttgatactagctttgggactagctcttagactggtaagactgttgagaagaaatgcacaggaaaaaggaggctgtggaagtgccttggtgctcaggtgtctcagtcttgactgagggagctgtgtttgttcaattttgggccacagacctgatcgtgtgccatggttttctatgtttggtttagcagtccataatccccaaaggatattcatgtgtgctgtcagctttacctctaggactttgaaggaaactgaactgttgctgctttctatttcctgtttatatttctatttcctgtttccttcccacctttggctctacactgttgttgtttctcacttggaatttcctttgagtaactcaggtgtggggtggtgttctgacaatgttttactgagattcactaagccagtggttttatgtcggtggcaaaaatctacccctacaaggctatatagaaaggactggcttatcaggccttaggaaaaatcttagaagttgcagctcctggaaagccactgaatactgactcctcgggtcctggtggcatgaattcaaaacttggttcctgacccatattgggaggggaagggccccagtcacatatgggatagtcaactatggaagctcagtcatggagtggaagtgtcaccaggaactgcacctccctgcctagagtccccatttggtttctgatggataccctaagtacccaatttgatgatgtcacccctatctattatttgatttttattcttggaagcattacccgaggagacacactgctctgtctgggactctctctatggggaactcccggatggctgcctctgagagttgattcctgttgtttttgagcacatggtttgatgttccactctcctctctcttccccctctctcctccttttgccccctctttccctttggctttggcttgctaattttacttggtcaaaaccaaaagtatgtccatcattttcaagatgcatcccacagaacagtgtgctggctgaagccttcccgctacactctacttcattcttggttgctctctggtgctagttattgtcttctaaaagcatccatcctgccataatatgcaagccccctttcttgcagtctgtgggtactgagaccttggagtcccttctaagttctgttggtccagtcaggatgctgctatggaaacagcctccttggccacctgagatccaaattgtttttctgagtgtgtaccatggatgacataccactggattataatgggcagagggaaacatgtcttgggtaaatgactgacgctgaggatagtgttgctaatcgaatttattagtagttttaaagctgtggataagcattgtatcagaaaaagtaatctgagtaaacttggaaccaatccctgttttgatgggcgctctccttatgaaagacagttttgcttacatggtcacagggccgacattctcaggagagggccccacctctaaaggcatagcatatactaatccaggcttcagccaaacaaattattttctgtgttttcctagtagtaaaaattgtatgtgcatatatgggcacttgtgaagaaagcctttggttactgtggtaaaattattattttttttaaatccctttttcgaagtaacatgtacttagagttggaaatttgacagcagatttcctaagggccaggcacaaagaaggaaaaggggctcatccactttctcttccgaacagcagcgtgtgcccctctctctctctctctctctctctctcccccctctctctctccctccctcnnnnnnnnnnnnnnnnnnnncccccctctctctctccctccctccctccctccctccctccttccctctctctccctctgtgtgtgtgtgtgtgaattaagaaggacattctttagtaggttttaaatagttatgatctctagaataaactgagctatgtttttttaatattttgtatatagttctttatcttgatccttagaaaacaaatatcttaaggtttcttctgttggaagcaaactcagtcagtagtcccctgggtggtgttcttaggaaaagcccaggtgtccctttgaggatgcacagagcttgccactggctaactttgatgttgcaattttccttttgccttctagtagactgttttacagcagtggaagtagctttaaagtcagtgaaatatgaaaagaattaaaaaaaccaaaaaccacatttaaagttaagttagaattctggctcagagtatcaaaccaaacttgtaaatccttctctttgtttccagttcccactgaaggaatggaagactatgaaaaaaccagggctctccccagctgctgctagagagaaaactcagttagatatgtttctttctggccttgttgcttgccttctgctgtccttggatggagttgggggcactggtttctccttgcccccttccttctcctctctttgctgtgtgttctggtttctgactgtctttataaattatgcacctgtgtagcctcagctcagctcaggttttcctgaagttttgaatcctaatgaggactcttgggagtgggtggttcagtcctcagacaagtgggtgaacaatgttctgtgacatcagtgttgaccctcaggctggctttctgcttcacttccatacgctaagctgtttatgcgtgagcaccactcatgcctggaccacacaggtcacacaggtcaggtagctttgcttactcctggtttcttatctgcacatcggtcatctagatgttaggcacggtagcctgtgatgtttcattcaaacgtggcagagttgctggatcagccatgccttccaaacaataggtggctttgtcagtcagctaagaaggaagacatagacaaaacctttgcagtattgtctgcatcctttgaatggcaacagacatcagtatgcttcggccaccatggtggtgctcagtgcacacaggtccttgtttgggggcaagtctatgctgaagtcacttactcagtggggatttcactgtgtgaccattagtgctctctcaaacacatgttcatgtgcgcttgctgtgtcataagatatggggtagagacaaaatttctgatttttaaaaaattttgaattttagaacatatccagcacctcccattttctacagctagaatttaaagtttcctcaaagcttttgattgggatccaatcccaaggacacctccaggatggccagagagacaggtcctgagtagcactttagggcctgggcaccaagagcttgctgaccctcctctcactgttctggacaggcggaagctgatggatgggatgtctgctgcagactcgggtagctactgaacatcttacagtgttccccctccctctttttgatttttgggggtgggggatgacaaggtctttctctagttgtgactgtcctggaactcactctgtagaccaggctgcccttgaatttgcagagatcctcctgtctctgcctcctgagtgctgggatgaaagccgttcacttaacacacctggtttatacagtttcttgaatgatattctttttcttctttgagctagagtttcatgtagtctaagttgttctggaattcactacatactcttaagctggacttgaatttaaggctgttctcctgcctcagcatctcaagtgctgagattgcaggcttgaatcattttccctgaatttcaagtgacattcttttcaaattcaaaattagtctctggaaacataactgtgccatcttttattatattctatccagaagaagtgttttaatgtccacagtggttaatgtatgcaatatttttgtagttttggtacattcaatttggtagcccttattaaaacatttctataattgtattactaaaaattattaatctagattttttttaagaataaggttgccatataaataaaataaaataccaaaaagacattttaggtatagttaaacatgagagtctatacaattatgccaacatggttaaaatttatagactaagatatacttgattggcttaagaatattttgtaataatctgtttttctgattctaaatcagtagcttggcattagaccaaagtccatttttttagtttgtgtgttagtgtatttgagttttttttttaataaaaaaacataattcagagtgttggttaggtatgcatcatctaagtacatttgctggatattagttccttgtgtgtctttgttgacattttctgcccaggccaagtcttgctactgctgctcagttctaggacaggagagaagaaactgagtcttgagtgacggtcagggagtccaggaggcgcactgttgacaagtctgctgggtgttgttacaggactgaagaggggatgttgtgttttcataagtgcttttgtctgaggggctcacatcataagactgtgtgtgtgtgggggggggggcagacatgaatattagacagggagtccctcaatttggctatacaagatgccagtggactgtggaatccttctgcctcagccttcccagggctggggttataggcaggaactgctagcctgacttctgtgtggtagtagggatatgaattcaggtccccgtgcttgtccagtaaataaatgctttaccgattgagctgtctgctagctcttgagttcttttctttttataattaactcagaacatatttactaagaactgcaataaataaataagtcagattgaatgctgcatcgatgttctgaggccccagcagcttagacagcactgagcccttgatgcaccactctcttacttgtgagcacctgttctggagcctttgtaacggaggcacgcggagcgcagcgacagtgaagtaacaacagcagagcagtcctgttgtaaaggccgcctctcctccacagcacccgccccttcctgtgtgtgagtgtggatgtgcgtgccatgccacaagtgtagaggttagctggacagaggtggcactcttctttcagcatgtgggccctggggagcaaacgcaggtccctgggttggcaggcacccttaccagttgagtcacctcaccagtcctcagccttggaagggagggctgctctttggctttcctcgtctgtctggttggtagtttgctcttcctgtgctttggaacattactaaatggacaagcattgcttgcacactggcatcctcacaccaggcaaggctcttaatgggggatatgaaccccaagcacaggatgcataattcccagacagtgcagttagagcttgcaggctgtttatagctggaatttccatgcactgttctctgactgcaggtggttttaagtaaggagtattgagacagggaatcactctttatatttgaggcctgaaccgtgtggatttctgtctgtggagagagaaggcagagatgactgagcaaagccgagtttctgcaggaagtgacttggagcttgatctaagatcttgttccagagtttatggagattttctgggttctatgttataatcccggcggaagagacttaaaactctctcaagcaagatgacagagatgtttgcaataaacctttcattttagacagccttcagattgagtctgcaaaaaattaattgatcggctctgtggtcacttatagattgggaggctaactagaaaatgcagttgattgattttcatctttccctcttacaaagggtaaagagcttgttttcatgttcacagcgagatgattctggacatcctgtggaagatgcttttggaggtgggcatgcagggagacaagaaagatggaaacacacttttcttcttcttcttcttcttcttcttcttcttcttcttcttcttcttcttcttcttcttcttccttcttctttcttctttctttcttctttcttcttcttcttcttcttcttcttcttcttcttcttcttcttcttcttcttcttctttcttcttcttctttcttcttcttcttctttcttcttccttcttcttcttcttcttcttcttcttcttcttttctttttttttggtttttcgagacagggtttctctgtgtagccctggctgtcctggaactcactttgtagaccaggctggcctcgaactcagaaatccgcctgcctctgcccctgccccccaagccccccccccccgcccccgcccgagtgctgggattaaaggagtatgccaccacaactggctttcctgtagacttctaaactctgtgctgaacaacagactctccagaaatgcatggctgtctctggaagaggccactgccatccttttgtgctgctttaggactgtcatcttagaagtttcacacagcacagtaggacttgatatagagacaggaggcatagtctctgagagaggatgaggcacaggcaagtgtgatagggtgtttgcacactcacaggagaaccagcaggaagcccatgtagctacagatttagcaaagtgacctcctccccaacacacgcaaacacacacaagagcaggtggtcagataaaattgtcatgggcagtgagtgtgtcctccagatgttcatgaagaatacaggcatgatcttgacattttgggccttcctggggaaagaggccatagtcttcttcactttatatgtcactgacagaggccaaaggagacttggccatatggggagatattgtgttctgtctgtgaaaggaatgtatgtaaaaatgttgcttcttgttaaatttgattggaatattaatgcagtctagtggaatttaaaaagtgactaaggaactggaggtggactggtgattaaagcattggctgctgtttcagaggattcaggttagagtcccagcacttacgtggtggctaatgactgcctgtaactccagggttaggggttctagtccctctctgcctccttggccggtgcacacaggtagttcaatacatacacgcagacacaacacctatacacataaaaaaataagtgaatgagtgattcgtttgaaaaacaggtgaggattaaatagctatgtaacattatttgaagaaaacctggcctttggttattatgctgggtgcagtggttaatcttcatgatcaacctaaatggatttagaatcaccatggaaacgtacctgtgtagggtatgtctatgaagatatttcctaaaatgtttaaccgagcagtgaggacatatcctttgtgggcagcacaattccctgggctggtttcctagactgaataaagagagaggaagctgggcgctggactgcatttctctgtgtattctgatggatgcagtgtgacctgctgctccatgcttctgctggcagggtggcctgtacccccaagctgtgacccagaataagccttccttaaatggacggtggcaactgtttcatcacagcagaaagcaaaccactcactacaggatgaagataaggtacctgagctgggcccctgaggagtgtgctatgctggccactggatcacttacctcctagcagactttgctactcaaggggtctggagatgagtgaggtcaaggagagtattggatggaattgagcaagtgactgttttttgagggggaaaaattctcatctagtgtcattagtcaaaataatatgataaactaacaggttaaatgtgagacaaaatttaatgctaggatgatctgtgctcatccacttacctggtctgtgccagtctgcacagcagggaggagctgaggcctaaggaccaaggtaagagagtaggcgagactggaaatggtgcgttcccagcaggaattggggtgccccaggtagagaggaccaaggcttagaggtggaggatgtcaggtgacagtgtggctctgccccttgaagagctgagctttaacttgtgtgaagcacagctctgatatgcagcctggatccaggcaggttggctcatgtgttttgttgttgttttctttgtttgtttgtttttcgagacagggtttctttgtgtatccctggctgtcctggaactcactctgtagaccaggctggcctcaaactcagaaatccacctgcctctgcctcccatgtgctggaattaaaggcgtgccaccactgcccggcccacgtgttcttatgcatatgtgcagggtgggatggagcccagtgatggtggtttggagtgcacaccctaacagacatttcaactaggatgcaaagtgggttggggtctgttgagtgtagggtgctggtgccgcttaggaccgtggaggatgaggagggctggtactatgtctgaatgtgtccctatcttaccaacttattttttcaagcccttgctcaaattctcagcccttctgtagtggtggaattgcaggtacagtgcttggtgcaggatctttacctcttaggcttcccaaggtgttcttagcacctatgaacagcggttgcacactgtgtgagcgttgaaggatgtgtgctaagatttgctggctgggtggagctgctgcttaaagttgggtcagtggaaaaggaaggtgggaggaggtgtatcaggtgatgttgctctttcagaaagcagaacataccaggtgtggtggtatatacctttaattccagcactcagaatcaaagtcaggtcagtctctgtgagttctaggacagccaggactagacagagagatcctgcctcaaaaaacaaacaaacaaaataccagacaaataaaacactgaaggtactcagacagcaatcataagcggagaaaaacgtagtaaagtggtgtaatgtggataatgtgagaagtagttaaaaagacaaaccagtgagcaaggggtagcctgaatctgaattaacatggtatgtatgtcccagagtatgcagctacactcataagaactaagtctcttgcccctcacagttggatgcagagaagaaacgtgtgctgagcatttggaggcagtcttttgatcagttgattctgcttctggagattcacgataaggaagctcctgcatgcgatgcttttaaccctctgccctgccctcagacgtgggctaatttgggatataggagcagtgctacaagagtgactgactgggtagggcagtgcaggagcccagtgtccttgggttatgtctggagtccatgttgaaatactgtttctgttgtgcttccagatgaagacggtgagtgtggccttggtcctgtgcctgaatgtgggtgtggatcctccggatgtggtgaagaccacaccctgtgctcggctggaatgctggatcggtaagtgccaggccgtcctacaggcacctgtcttgtaaactgttgttttagataagttaatctttattttgtaatagagaacattttcaaggaaaattaataaaataacaaaaattggtttctgtaattcttcatttaaaatatgttagtgtatggcttgtgtctgtacatgctatagaatggtagctatgaacacttagaaaaattgaatttcttgtttatataataatatttatagaaaaggtaaattgcgatatcttaagcaaagctcatggtatatgttatgatagtagctgcattgtatataatatttaaagaaaaggtaaattgtgctatcttaagcaaagcttatggtgtatgttatagatgatggtagccatattcatgcttgcagtgtactaaggacggcttatcgcagttcccaggtaattaggccatttaatccccactgacgtgccacagcagtgcacatgtggagatcagagtatgacctgtgtgtcctcgtcaggctgggtggcaactgtgtttgcttgcctgttgagccatcttactagcccctgcctggtttttgaagccaaggaaaatgagatacaagtgaggaacttgccctaggcggtcctgtgagtacatggtggagtcaggagacctacatcaagtaaggagactgtgtgcagtttaaaaaaattagagctgtgcggtggggcactcctttaattccagcatttgagaggtagaggcaggtggatctctgttattttgaggcaattctgggctctgtagttaagttctaggccagttatgtacattgtctttagtaaacggtgagaggtgggcagtgaatcatgtgtgcgatgaaattcctgtgttggcattttttagggtacacatagcactgtcaccacagtctcctttaggagcatttaaattacagctgcagatgttgtgtcccctccctcaaccccattccactcttggtctctataaggatttttgtttgaaaaactgatattttgagctggagagatggctcagtggttaagagcactgactgctcttccagaggtcctgagttcaattcccagctaccacatggtggctcaaaaccatctataatgagctctgatgccctcttctggtgtgtctgaagatagtgacaatgtactcacatacataaaataaatgactctttaaaaaaaaagtagcagcaaaataataataataataataataataataataataataataaaagaaaactgatatttttatgtagtccaggctttatctcctgcctccaactcctgagtgttgttaggtcatgggtgggcaccatcacgactggctaatccattagttcagaaggacatccacttttcctaaattgaaaactttgtgtttggattttttactgagatgttggccttgtctgggttcttgtgatatggtaacatgggataaagaaaaacagtgtgaatgactggcttcagctgatgcttggtatccattattctacaatttatttggaaaaagagagaaaaaaaaattaaaaacaattatttgcaagcagagcagtgaatactttcctgactcagtgagtggcttgggaactccgcagtgtggtcaccataggagtctcaatgagatgagatcacagcttgctcttgagaggaggagcctggagattgcccgtcctctgcagcatgtctgccttgagcaaggctcccaatggcaagcccccagcatttggaggtgtcagccctgctcctagtgtccccagaggctggtggaggattgcagaggagagctgctgttctcttgcagtgctcagcgagccctgttaggtggtgtggatgtcattttccctgtccttcatctgttgtgctgtttggccctgagttgacacttgacttgttagcacttgttgctctgttcttaagaaaaggggcttggggaccctggagtccagtgttgtcagccagtgccttggggtttaagccaatcagctgcagggagttagtttaaataagatagggctcttctcaagtcttcagagtggggctgacctccactagagatatggaaaggcatgtcttggtagagaaggctatgtagactagggacttgagtgaccatgtgcttgtcatgaacagtgactagaaggagggagcagaattagaattctggaaatgtggagaggaacatgagtgtgaaaacagaggaagtcagacgaacaagggttggccaagaggctgtacaggttgtgaggcaccttgactagtgtgatggcttgtatatgttctgtccagagggtgccactattagaaggtgtggccctgttggataagttgtgtcactgtggctgtgggctttaagattctcatcctagctgcctggaagccagttttctgctagcagccttcagacgaaggtgtagaactctcagctcctcctgcactgtgcctgcctggatgctgccatgttcccaccttgatgataatggactgaatctctgaacctgtaagccagccccaattaaagtccttataagacttgccttggtcatggtgtctgttcacacagtaaaaccctcactaagacagaaattggaaccagcatagtagggtatttctgtgacaacctgaccatgttttgaggaggactttggagctttgggttagaagatccatttggtgttaagagctctgcgggatgttctgtaggagcttggaagataatgttgaaaacactgccaacaatagaggcctggcttgtgaaatttcagagggaaaattaaagactcttttcagggccattgctgttttgattgtgaagattctgtggttttggttagctggggctgaggaatcagctgtgattaacaagataccagaactactaaagcaaaacctttgcattactgggactattggtgctggttagctggagctaagaaattagcggtgattaagatcactgaggtaaaatcttctgggaagtgttttctgagagcacaaaaaagttatgttccagaggtagccaaggttgtacctcatgatacagcttgactcggtaatgtgtaagagtcacccaggtggtactggttttgaaggcacaaaggggtcatgaagagcagctgatgcttgccactgtgagaggccaggagaggtcattggtgaaggtgcagcctcagttgcagttgatggcccaggactgaaggggccatgcaaaggatttgggacttagcaccatgaagagagcctatgagaggctattggtgaagcctagttgtagaagacagcagtggtttggagatgctagtaccatgagatgaccatcaagaacagcagcagcagtggggcacaggcagccggagcctagaagacaaggtgtgtgccacaaaaggcagagctggaggagtgacccaggctcttggagaagcctagaaggtcgtgagtggatcccagacattgaacagttggagtttgattttgcttttgattgtgactgttccctgatatttttccctcttgaagtaagaaaaatattttagtggagcccatagttaagagatgtcgaactgtagaaagactttgaatttcaaaagtgattgggtattttgaggggattgaaaatttaatatgtaagaatttgcaaagactgtgggacttttaaaattatttagatcttgggatgaataagaaagtaagggttgaggcttaatagtgatgtgtttgtgtgtcaacttgacacagctggagctatcccagagaaaggccagagatccagctggaaggcattttctcaattagtgatcaagcagggagggcccagcccattgtgggtggagccatccctgggctggtggttttataagaaagcaagctgaggcgggctggcgagatgactcagcaggtaagagcactgactcggttcaaatcccagcaaccacatggtggctcacaaccatctgtaatgggatctggtactctcttcttgagtctgaagacagcaacagtcttttttttttttttttttttttttcgagacagggtttctctgtgtagctctggctgtcctggcacttactttgtagaccaggctggcctcaaactcagaaatccacctgcctctgcctcccaagtgctgggattaaaggcgtgcgccaccactgcccagcacaacagtctttaaaaaaaagaaagtaaagcaagctgagcaagtcaggggaaacaagcgtcagctcctgcttcctgccctgcttgagttccagtcctgacttcctttggtgatgaacagcaacgtggaagtgtcagctgaataaaccctttcctccccaacttgcttcttggtcatgatgtttgtgcaggaatacaaaccctgtctaggacagctagtgaggcgatgggaggtggagggctgcttgcagtatccgagcaagtcgcccgtaggactagttgccatcctgtgactgtcatgcatgtgaccatgtagtaggctacagactagtgttacatgccaggtcttagcagtcagagaaccaagatttcattaagaccccggcttcgttcccccaggctcactctgcctgctgggatgctttgagtctctgtcttcctgagaggagctgatagtgccaccttccttatgactcaggggcactgactgggaccctgggatcagctccatgcagagacctggacaggggctttttttgtcatgtctcaacaccctaaaacttctactttgttatgctataattaatactaggtaattagtaaacaacggaaatttacagttcctagttctgtagattgtaaaactcaaggtccacatgtagcagatggtgtgtctcgtttctgcttccaggctgttgccttgaacatcctcacctggtaggacagggcaaaggggctagctagttgtttccagctccaactcccccaccctttaattaatacccctcccccccatttcttggtgtagttctgtctgtcctggaacttgctctgtagaccaggctggtcttgaactcagagagatctgcctgctctgcctccttagtgccaccaccacctaacttgcagcccttttaataaagtctctcttccccgttttaggcacctgctacttagtctcttcctgttccccatcctggcactgtcatgcttggagtttatattccaagataggaatttgtgggacatatttatatcatagatcaactggtactctcccttctacagtaacccccctttcctctcaacacagcagggagccaaggtccacttgtgcccacctgtgtggccgaaggagggatagatacagcaaacgtgcctcatttgatcatgctggcctctgggatggccgtgtgctcagagttgacgtctagcagatgtcagatggtagaattcatggtgttctgacaaattagacctttagtgtgtcagagagttgttgaagcgtagcccagagctgtgctggaagctgtgagtgtgactgtggcctgtgggaaggggagacagagctacctgtgctgagatgaggctgctcagatctcaaagacatggttcaggggcctaaagaataccaggacccctgtgtgccgtttcttgtgtttgcaccacctgagcatgagccagagaacatcccaaggctgcctggagatcatgccagtcagtgcctctgaggagagagtgagaaggcacaggccctgtcacctgttccaggtggtgggacatgagctgtgagtgtcatggagtaaaagcattgttggctggttcccaggaattgtgaactctgggggagcccttgcttttagccacctttatcctcattcctctgccttcaaaatgctgttttgctttctggaaacgactcttgtctcttgtcagaaaagcagggagaggctgtttggttttatggctgacattaaatgctacagtggtaatactaaacacagttcacagaatggggtgccctagtgcttgttggggactgcctgcctgacagcagtgtgcagagccagctgctgagcagagcaagtgggatggggtgtctgttctagctggtagtggtttggctgtcagaagcatggagattctggtaccccagagaatgatttgggacacacttggccctgctgcccagagctctttcgatgaactaagacagtgggtgcatctgctcttggcctggctttgactgcagaacacatgcacagagcctgctactagcaggggaggtgagactggagctccagatcagagccagtaagaggtcacctggagtggcctgggccttggagaacactatggtgaatgtcagatgggcatggctgcagagcagagtagtgaccttgggctggctgaacttggcgctccaggcaggcagtgggattagctgtgaccatggctctttgggcagtggcatagtgctaaaagcagttggagcctctgctttctgggctcttggtttagaatactgcattctctgtcctgttgtgctggtatcttaaggtagtgtccctgttctcctttgagagaggatagcataaccactgtggttccccctcattcctttctagtagacataaatcctgaggctgtattttaggtcaggtattccagccactctccctcccctgtgccaggctgtaaagtattgcagctccaggttttcatcattctgtaggcacgtgggatatgaggcttttggggaggacaaggccagctatggatggtagcttttgtcctaagatctatcccattccagggctgagggtcccaccattagtcagaccctggagtggatctgctcagctctacagagccttgtggccaggctttgctctgaagctcagtcaggagacaggccccacagtgtgtttgccactaattataaaatggagggatgacattatgattaataagatacagtcatcaagagccatccctaatttcaaagttacccttttgctattatgtattttctcaatcaaaaattagccattcaaggttacacaactaattaatggcggaatccttgaaaggcactctgatttacactccatgcagtaggcagtgctcaactaataagtcaattagcgagtgtttacatgtctgctaacacaaggcactgagaactgcaagggttcatggagcctcgagctctgtgtactacccctgttcttgcgtttttactgtggtggccacacacggaggctgcacctgatccaagtgcatgggctgactccgacggcacttctagactcagggcacccatgaaactcttcgcacaacatggaaccagaagcccacattgccagtgcctgtgatggctacttggcagcacatcttatttgattnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcagtgcatcaaaggtgtgtgtgtgtgtgtgtgtgtgtgtgtgtgtgtgtgtgtgtgtaaggtgtgtgtgtgtgtgtaggtgtgtgtgtgtgtgtgtgtgtgtagatgatagttggtaaaggagagagagagagagagagtgagagagcgagagtgagagagcgagcagttctgctgttgctgatgggcagcaccagctgtgcctatgggaccatgggccaggtcagcagacagcttcagtatcccaggctaggggtacttaggcacatgccttctgcatgacgttaagtgtgcaactcagagggtttatgctgaagatctaagataagaaaaacatataggggctggagagatggctcagtggttaagagcactgattgctcttccgtaggtcctgagttcgaatcctagcaaccacatggtggctcactgccacccgtatgtaatgatatctgacaccctcttctggtgtgtctgaaaacagctacagtgtacttacatataataaatctttgggccagagcaagcagggttggagcgagtggggctggagcatgcagaggtcctgaactcaattcccagaaaccacatgatggctcacaactatgtgtacatctacagtgtactcatatacataaaaataagtccttttttttttttttttaaagaaaaacatataaaagccagaagttttacagtgatgccagctacttttccacctctggtgcccacctgcatcactgccatcccagttcactgacactggtggatcacccagtaaatctctgctgatgatgtcagacgatcctttctgttctcttcctttcatggctcttctcccactcattggcatattttttgggaggaaataaaattaattgaccgcagggatttctaggagatcagaagtgacagccatagcctgttatatgactgctttttctgggagatgcagcacgcacatgtgcacacacacacacacacacacacacacacacacagaggaggaggaggaggggggggatgggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgcacaaggagggttgcagttttaatatggtagtagcatagccaggcctttctgacagtctgaacagcagcagaagtgaagagcaggaaagatggccggtgccgcatagtgggaagtggttgccctgctgccttttagtgcgcaagcaggagcagccttcctgggccgtggtatcaggtctgcttctggttaagcacagataaaacaggcgtatctgggtgtgtatcttgtcaaaggggacttccccagcggagagcgtgtgtggttactgagcttctctttgttgcctctacagatcctctgtctatgggccctcagaaagctctggaaaccatcggtgcaaacctacagaagcagtatgagaactggcagccaagggtaagccttctccatttgcccttcctttcagtcatgggttgtgtggtttgaacttgagagagcagtctggcttcatctcagatcatccagtaagagcctgctcctccaggcctctgtcactgtcactgtcagcctttccagtgcagtcagtggagcttgcgtgctgcatccagggttctggttatttggtgtaactttccccaaacttttagaaaaggtgttctttatggtactcttaaatcaaggttttaattttgcatagaaaatgaattttcaataaattttctacagcatctgctagatagagcttttctgccgtaagcgttcacatgtggggaaagagcgcccagcattcaaaagggagacacctattgtgagttcagctttcatacagaaggtgaggttcctcttagactatgtgcctttgttgcttgtctctcagagtttttgcagtgtggggtttaaggtcacactgtccaggagcagtgtgggatggttttcaccgtcacactgtccacgagtgacctgaagcccatgttcctttaccttcctcactaactgctttggtgatttagtaaatttaatgggaaattagaattttgaggtgttgaaataaatgcctgagtgttcacccttgtgtgaagtcaggcagggtgagcaagcaggtgaccccggctgtgtgcctgtgactttgtttgaccccccctcccccccttatgctataagtagaagggaagcaaaggattcttagaccctcaccacttaactcttgcctacccaggaggctgacttgtgaaccgtttatcccctatcaagtccatccaggagtctctcgtacattatttgcattcttcaagtaagagaatagccatgaatcagacacctgctgtgggcttgagcagtgctcttggtagtttatgctgtagtgtttgcctgtgaggtgtcttaagtgttgggggagatttcttgggtctttgtgctttacatttgggcttttcttttgaaggcaggtcctcagggttgttttgacacttgttgtaaagctttgcctttgaaatctgttatttttggggtttacaagaaaattccagagagtgtagtgcatttggcagttgggtggggattggagagttactgagtgtattagtagttgaagatgctggtgttccaaagaaagaatatcttctttgaagtttttgcaggtgcccagtgtgtcagctggtgggctagcactggagggagcatgtgtggagtgacatttcttgcttctgtgatatgcatggagaggacataaatttgactcagctgcgccaacctttgctaggtcttttttatacttttgtttatttgttgagggtacaatgtacattcagatcttccagttgtatgtttatagagtattactgaataataacaaaaagaaataaaaaggaaagaataagtctggtcctggtttttggcaccaaatgaacgtgtaaaagaaatgaaaggaaaaggaaggggacacgattattcctaggtcagtgtagaggaagtttatcataggtaaatgtgcacagagagaggcaggggtgtgggagctcacaggcagagtcagggacagctgggagttcacagtggactcaccagactgagctgtgccgtgtgcagggtgagagagggagagagaaaccaggtgcagctatcaggaggcccaaacgtcacaaagagggcatataaccaaaatggttggattacatggggaagaacagcccaggcctctgggctggagagttcagggtaggggtctaggtatgcctgcctgaagcaggtagagactaagggaggtagagagaacctggtggccaatgtcagctttgatatgtaaaataggcacctcagccatttgtcccaggttagaaacctaagttaccagattgcttcagatttctgacgttctttctcagtgagtcttgtgctgctccatggttgttctcttttagagaattagtctgtgggggagtggtcttcctggttaactttaaagatttcagcacattagtcatgtgtagtgtgtgtgtgtgtgtgtgtgtatctgtctgtctgtctgtctgctttgggttattattcatatagtttggcatgatattaggtgttagctagtgcacactagcagacagtgagcagaatctttcagatcctcaggatcttcttctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccccctcccctcctcctccctctctccctttcccctttctttccttttgagacaggatttctctgtatagccctggctgtcctggaactcactctgtagaccaggctggcctccaactcagagagagccacttgcctctgcctccacttattgatattaaaggaatgtgccaccatacccagcttgtttcttttttcttgaaactattttttgtgtctgggtgttttgcctgcatgtagtcccctttgaagcctgaagatggcagtggattccctgaatcctggttgtgagcagctgtgtgggtgctggggatggaacctcagtcctctggtcttccactgagccagctctctagttcttttaaaatctaaatctctgtcctagagtaaatctgttccacggcattgtgacttaaggcaggtcacatttacatgcagtaaatgacctggacagaatgataatgtgagtctcgtttaggaagaagcagtagaggatccacactggaaaagtgggtgcagtcttccagtggtttcaggtcagggagacttggttagagatagcaagggttagagacaccaaagagtttgaggtgagcacagtttcaagacaataggatgcttaggaaaagatggtataaggtgagagatggggttctggttggctacccccgtacagtggaacttcagcttagcgagaagctgtgtgtcaaacatctttctccatatccaggaagccacactatagccataaatactaatttcttcttgaatgccagaactgatgaattcatttacacgtgctaaaaatgtctcagaatttcctgatatgaaccattagtgggatgtctccattttagaaacaagcctaaggtaacagttgtcaccagtatgcctctgactggctggagaacatgcggggatgtacttactgtaaagagcttggtgtgcatagagcgctttcctgcttagatactctcatatggctgagggcagagtaaggaggcctgatatccatgagagcctcttagtaggtgcagacttcatgctgagaggaaatttgcacagaacagctcagatgtgtgatccccaactgtaaatcaggatcctttgaaacattgcaaagctaaacatgcaccactttattgtcctctacagagctcttgtatttctgcagtaataaagagaggttgatgtgccatctgcaacaaaacaatagggatgttattaaattccaagacctctgatggaaagaccctggattcagttttctcttcctccgtatgctttattgcaccactcacagaggtcgggtagtctgcagtgaggtcattccgttcatgtttgctgaagtcactgtggcctggacattggtgtgggtgggaacaaacagcagtgttaatctccacagcagaaggagcagagacctgactgcaccctaaggagccagggtgcctggcatgctgcccattgcattgcttgtgcccagctgccacattttctcattttctagctgtgattattcaaaatcagatactttgataaaggtgaatttggttcagtaaagaatttagagaagccattgtgattttatttccagaggctgccagactctgtattaggccgtatttccttgcctggctgattgatagtttatcggtttgcactggtggaatgtctgttcctagttacatttaagactttccttattacctttaggtaatagactttagctttgcaggagagcaaagggaaaatgccagccgtggtttctgttgaaaattcaccagtaaagccctcttatgtcatgatgagcctcaagaggaagtcttatgggagctgagagcaaaggcttttgggcttttaggagtttgcctgacagattgaggtgctggcagtttagcacaagatgcaagtttaggagctgaggtagctgacatggagcactcgccaggtctcctttacctaaagcatggagtgggaggcactctgctggggtaggtcccagctctcctgtggctcccaggtaggttctgtgggagtcattaccgtttactgtgggaggtaaggagggttggtgcacctgtaacagttggcagggagctgaggtgaccactgaacgggcctgtttgccaggcaaggggacaggcttttcgctgtgagtgcacataactgtaggagctctttctcatcttggccagcaggaatgaatggcaaaggctctgtgcagtcaccgtggcgtttcagggagctgagtggtcagtaggagccacacactcctgtttcccgaggctgcagtcagcaggtcttaaatcttagctcctctgcagtgcattcttgtatctgtcacagtggatttgtagtcaacgaatgaaacatgtttttatagatcttctcaacaagcagtggacttgggaagtggggtctctctccagcaaagcaaggctcctgggcacactcctcctctgaagagcagccatcttagctttgtgatcgggttgtacacttggactgcacacatgccttgttagctgctttctaggaagtagagctgacgtggccagggacagacacatttctttctgttgggtttacaggcttgtcctgtggggtttaggcacaggtgtttgcagagcctagtgtttatgtgcacgtccgtacttctgggttgcaggggctggacctatgtgcctcctcccttaagcaggctagctgcaggttgttgggaagcctgaggggtcaagcatggagtactgctccagctctctctctccttccctgctgcctacaccctcagagccctcgagaggggcttggggtcctactagcctcttctctggactgctcctggttcctgtgtcagaaggctctacatgcttgctctgctctaagggaggagcggggtgggacggatggtgctagtgctcctcctcaccccaccctagtgttctctatgggatttacagtgggatgtgctgcacaccagtactggtgcaagtcagtgtgctctgccttactcgggagcgcgtcagagttgcatgtggacaacctgaaaagaagcgagtggagctcaggggtggagtgggggtgctcagagatcactgtggagtagcctgccttgaactagtagtggtggctctcagcttgggacaatcacattttgatagaacagtactgcccatctggacacagcactatcatggcatcgatgtcactcctttgtaggctgcccctatgtcatgactgtgctatcctcctgacttcctctgctggcagccttctctttcctccaaaatagctggattctctgtggagccagagcttgggcatgatccacctgtctgtgtttctgtgacaaactgcaagtgagggctcctagccacgggcagaattgtagctgaatgactcatactgacatgattcaaactcttgtgtgatgcgctttgcccctgatctcattaaatttgtaagatggtgtagatgtgtcttgtggcagtcttggggttaaccattgtgttgtgatagtctcccttagctgcttcctgcccagatgttagcaactgtccccaagacaaacattttgcatgtttttctgctctggccataatcttgtaccagcctgtttcccctcctctttcctctcttcttgcctgacagcctttccatgcagcatgttcagggacaattccgatggatgctcttcagccgaaaggcttattagtcagccctgcccacgcacttcctgtcttgccctgtccccaaaggccacggtgttacaacagccctctggatgtggaacttagatctaaaaccagttccaaacttgcaaacctaagctgccattttagctaatgagagcacaaaggagtcgccatctcttgactacccattcttttgaaagcttacacatactttagagaaaggtaggttgtggagatgcgtctgctttcacctgcaggatgtatcatgctgtgtgactagagtgctgtgggactccagctttcttgaaagtggcgttatttgcagtccctgtgtcaaaggctcgctctcagaggcagtgggaagggtgagtggtgcacagagtaggttccagccgtccaccactgctcctcctctccctcccttgctgtgctgcatcaggctctgaggattgccctcggccttgctgtctctgccttggtgagagggcaggtagcttagcggctgtggagagactcttggctttggtctggccagatttaacagtgacattctttagccctttaccctgacttcaagtgctactgcttcattcttctcagactgaaaatggaagttgaagctggggtgggcatggtggtgtagaccttttatcccagtacttgggaggcaaaggcaaggggcatctcttgagttggaacctagcctggtctacagagtgggctgaggacagccagggctgcacagagaaaccctgtttgggaacaaacaaacagacaaacggtaagtggagggctgatgggaataatattgagcaggtcagccccagcacccagagggtccttgatgcccagccttcttcctgagtggtccccaagccacactaggacacacacgctgccactctgaaactttctaccccagagagttccttcatacctaccctcctcatcctgcttgctgtctccctgtctctagtattgtctgaagagcaagcacctctccacctctgctgctcatcttgtaaagggggctcagtcctttcctcatagcctcccaaggatctctctcaccactctgccctcccgatgaggtcagcgtttctgtttgacagattttgacaaagaaaccatgcttgctgaagactgaatctataactcacccagcctctggcacctatgcctttattacttgggtgggctttggaacctgcggctgtgcttgagaatgcctggtcacatggtgctggtacaggtgtcatggtataactggagctgctgacagtcaggaagcagaaggcagggaaggctgagtttgagagtgccaaagggagtccccatatgctcactgcacgccactgtgaaagctgtaaagttattccccagctgaacaagaacttgctgagtgggggagttgtgcagtgattcggagggaatggttctgaacgcttcccatgttatttgacttcactttgtaaaagatccacatgtcacggaggtgcctgcacacctggttggtcaccatagcatcaggacctccttgtgtagttgaattcaatggagacattgaaaataattggaataaaattcacataatatgccgggcagtggtggcgcacacctttaatcccagcacttgggaagcagaggcaggcggatttctgagttcgaggacagccagggctacacagagaaaccctgtctcaaaaaacaaaaaacaaaacaaaacaaaacaaaaacaaaaaaaaaaaaaaagaaaaaagaaaaaaagaaattcacacaacatcaaacccacacttatttattttgatgtgtgtatagatgtcttccttagtcacttttcacttgatatttttatttattttgggacagggtctcttcattgaatttaggaagatggctcagtatataaggtattctctgtgtgagtgtggatgtgattttaaacccctagaacccaagtcaaagctgtgtgtgcttgtgtgtgcctataactttagtactgtaagaagcagggctggagaggccctgcttcaggggaatgaagtagagagtgacagagcaggacacttgacatcctcctctggcatctgtgtgcaacctcacacacatacacacagaggcagagccgcagagccacagagccacagagccacagttacacaggcacacaggcacactcttgcacataatacacaggtatatggacttgtactgctgttcgaatggtgcagtgacctgaaagcactttgccttgccgtgtggcttcactgtcataggctgtagctccacgtatatgtaaacctggaagacatatacatggacatatacgtggatgaagccagcagaacacttcttcacctgcctgagcattctgcttctcctgtgttctgccctatttaggatcatggtcctacaacttgaagatgtttgcttagaactgtttgaaaacttcttgaaagggtctgccccttccgaccttcatctgcctcttcttttttggatctagttggagcttgagagacttcctcatgcccacttgtctcttagatttttgtcgtgactgggcttttgatctgccttctagcatggttccgggctggttgggtgttaagtctgctgcgtgcttggagattgctcctccactggagcacatccatagcccacacagacacttctgagatggagacaccgttcccgttcaccctggctgacactgctgtcgtgttgcatgttatagttagctggccatgaggcctgcctatggaggctgagttctgagtctcagtgtgagctttagaacctgtgactgagaagagactaggccacatagaggacactactccgttcatactgtgcccacggtgcagccatgggtgacaggacacggggagctgttcagtagagtggtggagtggccaggcagcccggggagcttcttctcatttttgtaaggattataaacatctgaatttagctttcattgaatagcttttaatgagtaccaggtagaaagaaatcccacatgagaaggcatctggcaacattagtttccttagccatacataaatcaatgctccttgcacctcagaagtgtcctgcacgacccaaggcaccttagattttgtggaaaaacaacatgtatttcattgaaagaatagtccttcactgggcatggtggctcatgcctttaatcccagcacttgggaggcagaggcaggtggatttctgagttcgaggacagcctggtctatagagtgagttccaggacagccagggctacacagaaaccctgctgtctcaaaaaaccaaaaaaaaaaaaaaaaaaaaaagggaagaaagaatagtcttacccttagagggacagatatgaggacagcatattaaaatgtcctttaggtcttcccagacccctctgtgttacccaggactgacctctgcctccacttcccagtttctttttctgtcactgaacattatagattaatagcttcttggggtagaaagagtagctttggatggtagcaggtgctacaagggacatatgactttgtgtcttggagcatccctaggcaggcagttcccatggttgctcagctggagatggcagagccccagaatgccccttgctcctgccaagtcccagcacagccatctcctcaccctcatgacacctagcttcttcctgtgctgagaagggtgcacattgatagctgtctctcgggcagccttcttcctgtgcaggtccttcgtaaggcagtaagtaaggcctggggctttctcctttggagagcatgggctttgtgtagatttccctgcaggctctgctgctgcttctgggaagggtgcaaccctcaacgcttgttttaattgctgtgtgctaattgctggtactcatagtgttctggttctccagcacagggctatatcctgattagaggtattgctgagcatgctgtggcatctggtctgtgccttgtctggcctgagactcaacccttcacaccagggctcagcgatccacactcagaacattggggctggtggccacagaaagcctattctgtgttcactcttgcatgtgtcacagctctcgaaaatttagctcatctcttttcttgctactctacatgttttcccaccaagtagcttttagatgtcatttacatgcagtaacatgcagagctagagtttttagcttgatgagttttgatggttgtgtgttactgtttaatcagcacttagaacaagcacattaaaacttgcacatctttcttctgccctttgctgttaggttgggaattgaacccaaggccttgcacatggttggctacctctaagccatgctcccagcctcactggcttcctctgtcctccaccatctatcattcgattgtttgacccgtcctgaccttcatgcagtgcagtcgctggcctgcctttgcctctcctctcagtacattcttggtgtcacctgcaccagcagttcattcttctcttctgtctgtgtggaatctgtggatgatcccgaatgcattaatgtcctcaggtggatttggatcagtcccgctgtttggtgttatgaataacgctgctgtttgtggaaatgacttcctgtgggtgtactgtttcatttctctgtgtgaatacctgacatgagcttgcaggccatgggtggttgtatgttgtcatttgtgggttacaagccccatgaaattgacaaaatggcagagattttgtttcccttctacaaagtcaggctgtggggaaggaactgctttctcctgcactctggagacatgagggcagaaacactgagatgctgggctgtctttgaatgaattcttaggtgatgtatggatgttattttcacctcaaataggagtcatcatcacataggaagtaaatgtgggttgtgtttgttagtgtctagatgagggtgtctacaaatggatgcacagttcagaaaagaaacaaattaattgggaactagaagtaactggcattttttaaagctctgctccttctttacagagagaggcagccaccttggccacatgttggttggatgtttctgtgcttcttgcccagtcatgtttagaatttcccctgggcttccttgggttttctggatgtcatgggtctggatggaattccccagtgacagcagaaagtgtggtctgcacagcatagctgtctccaccacagctgaaggcaactttctgtgtcctggtgatggatatcaaggagcaccagctactttaagtggtagcataaggcatccctggtcccttgcgtccctgtgtgaggagggtttgagcagacagtgttgtgcggtattggtgtttcctgtcccagctgctggttcccttggcttcctgagctgctttgctgctttcttcccaccctgcttctctcagaagcacctagtaggacacacaactctggaccttggtggctagggcctgcaggctgtcatgagctgtgtggactagaggatggagtatgtagtataacatgggtggttcatttctgagtgcctatggtacagtcatagctttctgttcagaggatctggacgctttctgacgaggtagaatgtaagttttaagtccagagcagtgaatttcagtcttaacatctcttatttctcctgccttctctgtcgctgtgttgggaagtcttgcctgttctgctgctggcagaggatgcagaggacctgctctctgcctgctctcactcagctgccctttattctctagttctagtcactgagtatctgctggctgctgctctgtagagcccataccgcaggagccacaggtggggctctagaaaactgtcctggaaagtagcaacatctcctgcacatcccagtttgtgatgggcaattgtcatagtaaactggtttacaattttttaaaaaagatttacttgtgtgtgtgtgtgtacacacagatgtgtatgtgtacatgtcatgagagccatcccattgttgaggtgaagagggaagacctatatttcatttctagtgacctccttgagaagagctgtttctcctgcgttgtcttcttgtctgaaaagttctcttcccctgaagttggttgtgaaaatagattgtctttgctctggaattttggggaggcttcctcctctgcatgtaacctgtgggagatgtaaaccatgggaagacttcctccccttggtgtaacctgaaggagatatgaacagcagggaggagaaggatgctggggcaagtcagcagtgtcctgaggacaagcgagaagcccgggtgtgcactggtggaaactaccttcaggagctgctaccgtggtcagaacacattctgccacctcatccaacacagcagaatatccaggactcttagccagagcagctgcttacatgcagagaaccctagcctagggcacttgtacttgcccaagcagaaggtccttcagagttatggtttgtttctgcctctggtagcaaaaccagatgtaatccccccactatagacctgacagaaaacaggctatcagaaccatctggacttatgacaactgagagcagcatttcagacggagagagaggtggcatacagttgccagaaggtcacactgaatcactgtcatgctcctaatcaaatgtttgatggggctctgccttgttcccagggatggcattggcactgctcagatcacatgtgtcatttatacagagtacagagcactgggaactgtttactgtgtgcctcctctgtgtctcccccagctcgtcacctcagagtgttgggatttgtaagctctcccaggtacctgttggtcctcccacagaagataaactggtgctggggagataaaagggaagcagctgctctctgggctggaggaaagggctgcccatgtggttaggatggcagcagggcactgcagcacgtgttgaggaccaggtaaggacaggctcccctttgtatcattgcttttttgaataagagttggtgctgtgcaaacagcagagtaggatgggctggacaggagtcaccttccactacagattacacagcagaagagtccttagttgagttgctgctcttctcacaggagttctagatctgaaggtcctccttaggacttgcctggagctcagaacaggctcttccctgtctggagcacagccttctcactcctcacctttgtagaggcagtctctttggcccaggtgcagctgttgacaagtgaaaggatgcgtgtgttctcttaggaacaacagatgtggagtccttccctggtgtgctagctgctgtttgggcatcatgtctcagaggtgatgtgaaatgcattgagagagcatccgtatgattagttatgactgtaaatataaagcggccatgcttcctttctgcaaagtcattgcaattgtgaacactccacaaaagtgagtctggagccatgggagatttctcacagcgacaacctgctttgttccccagtgcacagtttagactgtgtgggtcagtccaccctggtgatgctgcctctgagagtggaagcagggggaccatgagttcaaggtggtctgggcttccagacagaatctcagataagccaacaaaacaccacactatgcaccaggccagtgttctttgtgcttcccaggcatggcaggcctcacaccatgtgagtggggtgtatgtggtgtgtgcttgtgtttgtgtgttgtgcatgtgtgtatgttgtgtatgtgtgtgtatgtgtgttggctctgtttagaagtgtatggggagaagtgggggtgtaggtgtgtatgagagtgtgtgtagaatgggggtgtttaggagtgtatggggagttggttggggtgcagggtgtatgggagtgtgtgtgagtgtgatgtgtatgaggatgtggtgtggatgtgtagtgtgtgtgcctggggtgtgtgaatgtatgtgggggtaggtattatgggagtgttgggtggaaacatctatggggctgtggatgtgtgaatatggtattgtgtgggtgtgtatgtagggtgtgtaggatatgtgtgtgtgtgttgtctgtctgtccatctgggttggtgctcattattgatgtttctctccatgatcctctgagaacagcactctctctgccctccgccttccttgctccctcggcttcctcttcccttattgcctccatgtggagccagaggttggcccccaagggccacactactttctcctgagtgcttccatttctccctgctagtatcccactttgccttctctgagcgggccctgtgagaccttgctctgactggccctcccctccttcctttcctgtgcctcccctggaacagctccagttttctttgcaaggaagaacgcctcctgattcttagtaatcagatttatgaatgtggggtggcgatgttccttcctgccagcattttggcacgttggtgtgctctctaaatactattggtcttttcttccctttcctcacagctgatgtgtgtgtttgcctttctgtcaatagctctaagtaaagaccagctttaaggggttaggagaaatggatggcggggtcttgctcagataggaagggaactttatagaaagccttgagagcacaaggtggaggtaggacaggggagccctgtgtgcctttgcctgaagctttctgctcaccaccaagctcaccattactgtcccatagtcttcagttttgcctttgcccccagggggtgtcaggcagtggagtgatggtaggcagtgtgcattaaggccctgccaccctgcttcactctcaactgtaggcgtggttgcagagttgctgctgaggtgctaaatggccttggctgagtcccagcattacccatttgtatattgttggatcctttatttttttaaaatacagccattagtaggttgatttattgttcttttaaaaaagggctgataccacagataggcttttgagcagatacttaataactaaggaatctttgttcagattcaggcactgtggaggaaatggggccctgaattttccttcatggctgtgctaagatctcctcatgctccctgtatgaagatggggtttggctgaggcctccagggaagagaatagcattgtaattaaataaaagtctgcttactcacagggagctttccagaggtactcacaggcccgggcctgagatagctcattgggctgggtgtcatggtctgagcctaaaacctcagcactggggtgcagagagaggcttctccctggagcccattgcctagctgcctaacagatcagtgcagtgagagaccctgtctcaaaagcaaaagcaaaagataaagtgtgaaagaggaggacatctgataccaagtgacttctgtactcaggtacagaaacatcacacgtgtgtactccagatacatcacacatgcacactcctatacatgtatatacccccccatacatcgtatgtgtgcaccacagatatataaatactatttttttcagaggaattattatattagctgtttgacaaagtactctggcactgaacagtgattggtacatttcctcaaaataaaagaaaattcctttccattgtaatcaggcagcgtgtgtgtgagactaagacaggcgcctcacctaccttgctctactgtcacgtcccctcctcccatctgtgcagctcaggactcagtgcttgtctcagagggacactgcaaacagaatggggacagaaaatagccatttgtggctcctgctgcttccagccatattccctaatatacaaggttttattcatttatttttcatttactatatttaattgttacataaaatataaaactatatgtatgctgaagtactatataatatccacacacacacacacacacacacacacacacggcacaatgttttgtgttgctgttttttttgcaatagtgactcattattctagtccaagctggccttgaacttaagatcttaatgccacactcatcattcttaagatttaacgtccatcctttgtctgcagaattttaatgtttatatcatggtgtaagacacagtccaactttaaaaggccgagtctcaactgggagctgtaaagtgcaattgagctacagacttctaccatccaagacccagagcaagcagtcacaccagctccaacgagtcctactgagcagtgacaagtcctgctgctctgtgcttggcatctgctcctctgggctctagaaagattgtggaagccccactcttccagctctgcctcctgtaggacacatagcttttgtcttaggcttaagcctgtcctacctcatgtctgtctctctccttggcaatgtccaacagtccttgtgtctctgatattctgggctcttcaatgaagctaagacttcagcttcatataataacctccagggtctgcagggactctgtaggcctctttgtagggactctcaccttgctacactgagcctggcctcagctgctcactgtgacccctaagtcttttgttttccatgtcttcaaaactggtaccatgggatggtgcatgcagtctgctacccactttgatggtgcagtcatatctcccttggccacaactctatcaagcctgtatgacagcccagagaaagcgaccaggattcctttaacactgctgatctcttcagtgggtagagctgctttgtttccactgtctttgtctgaaacatgaaacttgtcacacaccttttcttccatcaaacaaattagttcattaattattgttgagttaagcatcatccaaggaaggtttcaagagacatgcagaatgaagccaggctcatggccacagtgtcatgatggaccccagccaagttcctcagagtctctgttcccctctgcagctctgtgagccaggcctcctccattgcccactgttctctcagcaactctgtcttcctagatgctcttcaagctctgctgatttccagcatggagttctaaactattctgcattcttcacacaaaacagtcccaaaggcctgagagccacatggacagatctagatctgtcacagcagggacttcactttgtaccaatctctctcttagtgtcacttcccatggtttagataaaacattgctttctgctcttgcctgtggatgtgatgtgacagacagctgcctcttctctgtgacaactctttttcccatggatccttttcagggtttaatcacagtaaaagacacgggattaaaagtcatgttctgtttccccttccctgtccccgctcctgtcccctatcattccagttgcataattgtagcaaggttctttgcttttatgtgctttttctttaaccccagctgcagcctttcttttgcttattgactgattttgattgattggagaaagggacttatgatgttgcccaagttgtcctggaacccgggagctcaaatgctcttcttagttggaccttctgagtagctgtcctgcagccacatcctgtcacagcagctgattggtgatcgcataatctctaacatttgtcatttctttatggagagtgtggtggtttgaatatgaattgcctctatagagtcatgtgtttgtgtgcctggtcaccaggaagtgacaccgtttgaaaggcttagaaggatgaagaggtattccctttttggaggaagtgtgtcagggatgggggaagaggggctttgagattttaaaatctcattctaggcccagtgtttttctctctgctatgtatggaccatgatgtagctctcagctacttctccagcaccatgcctgcctttcactgcctgcctgctatgatggtcatggacttaccctctgaaactgtaagcaatcaccaattaaatgttttctttggtaagagttgccttggtcatggtgtctcttcacagcaatagagcaggcactaagactgcaagtgaagtcctttttttgtttctgagatcatggcgctaggcagtggtaaggatgttacaccccatcactagggtataggtcattgctgtctgtgtttgccctgctgtgcacaacccacaggacatctcactctcgtctgacctaacaacattcagtgcttttctgattaatgcctggtaaatgtgccagggatgtggggtggggtaggagggtgtctagaggttcacactgtccaaaagaaaatgagacacacagcactcgggtccacgtcatcactactaggttagtagtgagacacccagcacttgggtcctcgtcatcgctacgaggttagttctcctcagggagttaggaggtttgggccacagtgcaattccatgtctgaaatggttactgtttgcggacagtttattaggttagaaccaaggactttatgacaactatggcaaatggtccactgccgtgttagccctcagccccatcactaaacacagactttctggaaacttaaaggttttcataatttgctgccaaaacttatgtagaatcaaaggcagcctcaaagggcccaaagctattttagaataataggaaaaagctggctacaccactatgataccacacacctgtggtcccagtgatcggagagaagtgtgtctctgtgttagcctaggctatgtagtgagattctgtcttgaaaagccagctcatgtgatcagtcatagttttatgtataaaaattttcatgtgtttttgtttatttacagtcactattatctgaaaataaaatttcaaatgttagagcctactgggtgttgtaagcctgctgtccagagtcaccccctcttccaggctgggcccagcaggagcagctgagctgggcacggtctgctgtgcttgagacaggtgtatggtagctgtgaaaacaggtgtcttgtagcacgaggaggcaggcagcccagcactgtcttggcttttccgttttgttttaaagttgatgttgtagatttgcttggttgttttgcacttcaccattcctttcccagttgccatttcagtgtgtccattcatgatttttggatttatgatagtaagtggtagctctaagatccagtctgctgcaggtatttctgggagtttcgggttcagtgagtgaggttggtgtgggaggcagaggagcttgtggcacctgtggaagcctgcagcctcccgccctgctgtgttggtgctctaagtgggcattaggacataaagggcctccgtaagggtgaggagggagtggcataccttgactttaacgatgtctgagggttgtaagttcccatgaacatacaatccttaacacagttgatgcaaacagcagctggaaacagcgttgaggcaaagagcaagcagtctcttgtttaaggagctgcagccagtagcagtggtcagcaggaccccaggtgaccatattatcagcgtctctggttggctttgagtggaaacagcatttggaaggttggcagggtagctaaggaatcttccacaaagttgaatttgaagagagtggaggtagcttagtgtaagaggatagggagtggttcactggcaaggtgatactctcaactccagctgcctccagggcactggggccaaggccttcctctgtaagggctttgtcagcctctggttcaatctcttgtgatgaatggaggctcaaggagctatgagctcttgtccacagtcagggcagagctaggaacagatgatgacctggtttgcacagttcttcgcatcttctgaggtgtgggtcagcacataggtggaactgagaaactgtagtatgcagagaccgcaggctcacacggaagctggctgcacactcacttgaaagttgggaggtgctgtgcactgtgagtgcatgcttattttgttgagaatgactttcctgtcttagcatggtgtactgtcctttgcagtcacactgtctgccttaccctgtgctttgagtgccaggagtcagtactttgcaagctcgtggacacttctctccacttttgatatatgacaaagtaaccttaaaactgtgtggttcattctaaccatgacatgtcttcccactctgaggacattgtgggttttactttagtggactcttggtcagctcaaagcattttaatggctttttcttggtcctagtacaaagtctcaactcttccagtgagcacaaaacttcctttttatctggttctgttccctgctcctgcatggtttctcacaattcccccagactcagcctgactttgaattttctagtgctcttgacctttccactagcgttgctgtgctggtctctactgcctcttgacagctgttcacacttcgaatctcacctttgatgacatttcctttggaagctgttcctgaaactttaatcctaactacaaaaaaaacccaaaacaatacaacaacaacaacaaaacaacaacacctactcaagctaggtttgatgggcacatgcctttaatcccactgttgaagaactcaagaggcagaggtctctctgagtttgaggacaaccagggttacagagtgagttctaggacatccaggattacacagagaaacccttgtctcagaaaacttaaagaaaagaaaaaggaaatagaaaaacacctgagtaagccctaggaaccacgctgctgctttgttcccatagctgctgttcttgcttttttattattatctattatatctttattattgctgtgaatatgcaattaccaaggtaacatataaaagaaagcattgggggcttgtttacagtttcacagggtgagtctatgacatcatggtgggaagcagtgctgcaggcagtcatggtgctaaccgcattagctaagagcttatatgctgatcagagagagaagactgggcctgaaatcccaaaggccaacctcagtgacacacctcctccaacaaggccacacctcctaatccttcccaaacagtaccaccagctaaggagggcctggggacattctcattcaaactgtcatacactagcctagaactcactgtgcagactaggctggccttaaactctttaaagatctcctgtgccaccttgctccactccactgtatttttagagtcaaggtctctgactgaaccaggatctcagtgagtcatcaaaacttgctgctcaccgagccccaggggtcctcttgtctttacctccaagctctagaattgtaggcatgagacaccacaccttgctttacaaaaataacacgtgagttctaaggatgtgaactgaggttccccagcatgttcagcaagcactttactgactgaaccccagccaggtgatgccccttgtaaatgtgcatcctccaggaggtgatggagtgggcgaattccactctggaatctggacataaaagtaagggtgagggacatggctctgagtgaaagtgcttacacaggagtgagcgcctgaatgtggatccccagaaccctcttcaaaggcagggcgtgtcaccataggcctgacttcccattgctgtaagacaaaggccttcctggctagctagtctagctgtcagtgagctcaggagtagcgagagacccatgtgagtgaaaccaaggtggagagtgatgaagaaagatcacagtgccaaccaagtatgtatagagtgaaaatagagggacagcaagtggggctgtgcctgtcacaaggctgaatggagggggtggggcccttgtgctgttgagcctgtgaggacacatgagcagacagagtcaccacaggattaggtggtcgtctgttttgccagtttcttcctctgcttgggttagactcttccagagatgtttcctgttttttgagctgttgctgttttctgctccttgctcttaagtaatgttttttgtggtggcatctggtgaggtgactctggggtgctgtgtctagcagtggttttgtcctccttgaccactcacaggcccctggtgattacccttcttcctatatttttcctctggttgacagatttttcactgtggactggaatgtactttctggaggccagaggcaggagcatgccggtcactgtcactgttctctctatgtccaattccacctgatataaagcattcacagaggcagctgccatgctcctgtcggctttgttctgcctcctgttagtgcagatgttaagatttccattgctgtgaggaaacgccatcaaagcaacttggggaagaaagagttcatcattaaagaaagtcaggataggaactcaagatggcaggaaactggaggcaggagctgatgcagaggccgtggccagtgctgcttgctagcttgctcaacatgccttgctcagcttgcttttctatagaacccaggaccaccagcctaaggatggctccatccatacttacctccttacctcccatcaatcactaattaagaaaacaccccacagtcttgcctattacctgatcttatacagccatttttttacttgagtccccccccccccccctttggcatcaagttgacaaaaccagtccacacagtgtctttgtagatattcagaatttaagatttctatcacagtttcttttgtttctagtttattgctttagtctgaacattactaattttcactatggtaaaaatgacatacttactaactatatcccattttaaggccagctgggttaaaggctgttgtaagtgattggaactgtggaagcagaggagccctcagagtggattgttgtttctctgaagtttgccatctccctccacacatgcagtgtggtggccagctcaccgtcactcccagcatttagtgtgggcccaggcagagtggtagcaaacttagggcagccctgactgtttggtgtccagcgagggaaggagcccaggtggtgctgggatatgactcctggttctgccccgttctctcactctcttctcactgaatagtgatggcctgagtttggctgaaggctctggtttcctagcatcattgtagttgtgctttttactccagctatgtttcagatttgtagtaaattatctccttcaaaccttgtctcgtaacttgatccttcctccctccctgagatattcttgacatgttctgtttgctgagtttagcatttctgtactagttcatggctgcattcttggtctttttgcttcttctcacaaatgtctgttctttggcttcttgccctccctgcacatagtctccctaacctgaaacgtttctgatcccctggactcctgtgaccgcctgatggagcttccatcagtgagtgagagccatgcctcccgtgggagtccacccagatgcccatcactagctctgctctggacacatggcaccagatttctctctgttgccatagctgtagcccctctcatctgctgtctcagtgaatcctggcgtagtaagcaagcatttggtgagggagtgcccacctcacgtggccacttggccaccaactgagatgcaggaaagaatgtggtcatgctctcttctaataaataaacacttgaatactgcctgtaaaaccgcagacgctcaggtgacaatatatctgttggatatattgttgaattatctggtgcatgtcattgttctttattgtatgtcacatcccaggggatttagtgactgagcaaagaccagatttttctgtgagtgtatgtgtcaacctgaagacttgtaagatccagtgtcacacatataaagtgaggtgacagtggccatcactatgcacaggaaatactgctcacaacctagcaagagaggtaagtggtctcctcagagctacaacatttgggttttaacttagttccccttagtacaacaaaaagggaggctactcagaaacgaaaggctaagcagtatgcttgaccttgctgtgcccagagggctggttgtttatatagtacctctatatagtgctctgttgcatgcagtggcctgacctgctagagttgagccccacaggggctaggttggtactttctttgttgtgcctgctatgctttgtaaaggaccagttaaatggcagtcagtaaaatgaggttcacagtcatcagcaacgagtagctggttttgcttttgatttagaatcaatagttctttaggagaagagcatcattaagagttttctcaaagcaagtaataagcagagtgcctatgccatggagacaacagttggtttggcctggggttccgagggtctcacctgctaagctcactcagtgtatacccttatctagtggtttctttatcctgtacgtgaccagttgcaatcccagacaggagagagtggacagtgagcacatgggtgagctctgctcagacagcgcttctgctaaaagcagactgtggaacagctgctgtgccatgcaggtgagggcagtggcatgtagctgagaaaccagctcttaataaagatcaatactggggctggagacacggcccagcggttagagcatcctctactcttccaaagctcctgagttcaattcccagcaaccacatggtggctcacagtcatccttagtgtgacccgataccctcttctggtgtgtttgaagatagctacagtatactcatataaataaaataaatcttaaaaaaaaaatcaatactgcataggcttgctatacctttgtgaggttcaattttatttcattcactttattgggtattgagttgactattagatattaagaaaaaatgtagggatagtctttcctgttatatgaactttaggggttactaagctgacacaactgatggctgttcattaaatatcagtgactgagtcccatcctacatcacatctgatgaacctagcagatatttaggtgtatgaagtaggagacctgactggcccagacatgctcagacctcacccttggagcctgggcgtgtcacctgtggcaaaaggtggactgagctgtggttcttgagaagtgcatactaggctcagtcccgtggattctcatgctttgtacactgacttggtacaggctgagttctgactgcatcctgtgcctctgtgggtccacacttggcctggcttcagcctgcatttaggattatcttctggcaggactagagtattggctatagtttccaaccttggatgctaattagcagggtgtgaggcatcattgggagggtgtgctaggaaagggattggagagagggtcttactctgtggcctatgcagaccaaagctcttgggaatttctgtctcagtctgcagagtactaggattcaggtgtgatccatgcagagtactaggattccggtgtgattcatgcctggcatgagtcatttgtttgcttttgcattccagcttgtgcctccccaccttattttaattacttttttttttgtagaattgggatggtaccccgggccctgggcttgctggatacacatgataccattggactgtatccccaatcaaattgtatattttgaatttataaaacattaatagagatttatgcatcaaaagtgttcaaaaagttatgcacagaattgtgttattccatccctatccacatctgccccgtgtctaattgctgtagctatagctatctttcttatgcttctttagtcgtttttctttggatcatttttacacagacatcatactgcacatactcctgggagccactcacaccacttctggggaccttagtactcatttagcactggacactccaccagtatcagccactgttgctcacaggccctcagcatgctgggaacattccacactctggtccgttgttaaggctgtgtctctgaggtgaaccatagtatcactgggccaccaaggtacactgcaggtgtttttgttgttgttgtttggttatagttaagttttttccaagatagcatcccctgtcattttgtattctcatagtagcacatagagagcctccttgcagaacccagagtttccgagtactacaggccagtacatgtgtctgttttttaatcttaattctcatttttagtataaaatgaggttgactgtttctttatagctaagggctactgccatagttttactgtgagttgttatttcatgtttgcacccctcaccccatttgtcttgataattccatttccattctttgagttcctgttgatagctcagatctcctgatcttcctgtgttcctggctgcctctggttatggacacttttctaggagtaagagagcaaccacccgagttaccctgagaacagagttggggatccaaggggtgggagtggggcttgcattttctctcaggataatggagtctgccttgtgaggttctctgggacagatacaggccaaacgtcccttaagagtgactaaagcctttacacttctcatgacatcggctcaggcaagtgctctatatgtctgagaccacataactcagtgagttgaagcagtgccacccttaatcccagcagtgcctcagtgtggcaggggcaggtggtcctaagagtccaggccagtcaacaaaagacaatgaaacaaaaccaccacaaaattccccaaaacagcaacaacaacaacaacaacaacaacaaaaatgtagctaacagagatgagatttagctcagttgtattctgagtgtcttctgcctagatgtgaggtcagtccttgctacttaagaagagcacattcttagagcgacccctggagctggcctctgagggtcacactgtgcctctgagtttgaaggttagggctggtgtaagcgtgtgctatgccatggagtttcgagagtagggactgggtccacactctggcttcatttgtgctgcggagtctgacttccctgaggcccatctcctggaaagcatccttcctggctaggccagactgacttcagctgaatgagcgtagcctgctaaacttggtttctgcagaaccagacaacagcagttgagacttagactgttctactttggacccttaaatggaatttattttgagtcttgaatgaaatttattttaactttaaaagcggggccgtgaggactaaaatcacatggcttattggacctgccaattatagttagttctgatggctgctcttttgttctttagctcagtaaaaagaaacgagcaacctctgagcctctgtcacctaagttgcttctatattagcagtggctgatgagacagggcgtatggtagtcttctcctgaaggcctgaggacaggcactgcctctgcttctggaataggtttaggggagggagcgtcaaggccaagtgtcagctcctgccttggatcttcagtccagccttccttcacacagcctcacagaggtcccttcagcctttgctttcctcttcccattcattctttcagtatggtgactctgtcactccctgagagtccattccttcatcctgcaggctcaatctgaggcacagtgttgtctgtactgctttctgtagagctgagtttcacctatgctgtgttcctttgtgcatgtcttgcattttcttgcattttgttactcttgttctctacactagcagtagttcttctagggcagtagcataaatggactgttgagtccttagccagctcaagtgcatatgtggaaacccacgtcagctgatgctctcagtcatgctataatgggcagtgggtatgcatgcggtaaacatgacttcatgtccccagccatgctatagtgaatagtgggtatgcatgaggtaaacatgacttcatatgtccccagtcatgctatagtgggcagtgggtatgtgtggggtaaacatgatctcatatgtccccagtcatgctatagtgggcagtgggtatgcatggggtaaacacgacctcatatgtccccagtcatgctgtagtgcatcctgggtatgcgtggtgtaaacatgacctcatgatgctaaaaacctataacctttatgcttctcacctattgtagataaattaggtactttgtattttggaaatggcctggcctaaaaatagcacttacagtgtttgcaaatatttatcaagtgtctccatgtgcagagagcatgtctgcataatgtttaaggccatagatgaccttatgagtcagaaaatattcttctgtcctctgacagctgcagctgggcaggaacacatgcacttttatgtccccgttggcaacattattctaagagaagctagatgcaccaccaccctgccccggagtctgtgataagtgatttatgtactcacaagacagtgcaatcctgaatggagagtgctctgctctggagcagtagccaatatgccatcttgtctaccaagccactggaacatcccagggtgaacagaggaggcctactctttctagagcaatggaggagatgatgtgctgttctaagccctagagttgcccttcattggtcaggagctgctggtttccaggatcccacctgcctttcaggtattggtgttttccatgtttgctgtgcagagaaatcaaagatgcctctttgccgctggctgatttcccgaatacacttgacactttcttctagtgtttggagatgattgttaagcaccccaattgctactggggtaataaatgtgggttttgggggggggatatgataatccttcacattattggcatgtctgtgtcttaggtttctattactgtgataaaaccttgcccaaaaagcaaccttgggaggaaaggtttatttcatcttataactctcatcactaggaatgccaggctagatattcaaggcaggaagatgagagaggggcaggaactaaagcagaagctgtggaggcatgctgcctactggcttgctcatcatggcttgctcagcctgctttcttagacagttcaggaccacgttcccagtgtggcaccactcacggtctgggcttcctatatcagtcattaattgagaaaatgatagacccaggcctgtctggttggggcatttctcatttgaggttctgtctttttaaactattctctaccttgtgtcaataaagcctgcacagcctgcttttgataaataaaagttctgtaaagattttttacctatctgggctcttccttaaaatctctgatcatcctttgggaagtgcttcatgtgagcacatttagtctggccatgtgttgtccccattactcaggcacagaagcagagaaatggcttaaatgtctgcacatttgcctgtttgtgtctgtagctttgtgtgtgtgtgtatttgtaaacttactctcatgggcactttccctgtgtcctcagctttctgtcacccacctgtttcccatcttctcatctggctcaatttggagcccgttccatgtgtcatgctgctccattcatttctaaagagaacagattctttaagcgtgcagtctatgtgcgtaggtcacagatgagggcatcattgatcgaattatctaccctgctgatccataggcatgctctattactcacttcctttctgaagctcattccctgttctgtctgttttcgtttttcccccttaaatgaactgattaaagaaatgagtttctctgcatcctgtggaatttaatgtttctgtggtttgttgactcctaccccagtagcaaaccacactggcatttgtccttggaattcctctgtatggcaggtgaacctagaggcttataaagattctggtgctcaggggtgcttcagaagtggttctgcaagcttctttttatgtgtacagaactcttggttttcttctgcctggctccactcgctgggcttatgggagaatggtgcaacagtgcccctggcatcccttcttgctggttaactgggttgtttatccacacttcctctccacttattggatagcttgaagtcactacatttagaaagaccagagttgatatactgtcctttatatgcctgttttaaagtagtaggtttctcataggtaaccagtaaaggatgtgggcatgtgtgtggccaagctcttcggtgcattctgcattggtaatcattgatattcactgtattttggcaatggcaaatggaactattcctgctggctcctgggtctttgatgcaggcccaggagtgtgtgattgcctctattctttgaggtttgacaagtcagggtattctgtgttcgttccatgcatcctccaccccaagtcctatctctgaggagtccctggtttttgtttttgttttgttttgtttttttttgcttgtttatttattcctgggatggcatatttagagaggttaaatcctagccacaggagtgcacatcggccacacccagcccttttccgctgtgagcacttgctgactcaggtgtaaggctccagggtttctctttgatcctgtggtgatgggtgatggtgctgctccttttcttcatcgcccttgtcttcctcctcttcctcttttcctcttcttcttcttcctcctcctcctcctcctcctctttgagttcaggtggctcatggtgggacgtttcagcttccatttaaccctgcactatactcaacagtggtctttgagagttgtctttgggtgtctgcttttcctctgatgacaggcttaggtgtgggcactttaccctatgtcatggtccctgggaagaattctgtctgtcttttcaatagccacctgggtgtgtaatcaaatccatttgtttgattttgcttacaatttaaaaattatttaggggctggagaggctgctcagtggttaagtttacctgctgctcttgctgcagaggacctgagtttggttcccagcacccacatggcagctcacaaccatctaaccccagttacaggagacctgatgcgatcttctgacctctgtgggtgccagacgtgtaccaaaaaattatgcataattatttttaaattaaaatttcctttttctttttgttttaacgttatgtacatgaacatctgagtgtatttcagtgcctacagaggtcacaagagtgcttcagatcccctggaactggacttggggtggaggatgaatggaatgagcacagaataccctgacttgtcaaacctcacagttaactcagaaccaaacgtaggtcctctgcaagagcagccagtgatgtactacttagccatctctccagctccttcttatgtcttctaaggtcttataaaacaaaattagttttgctttgtaattatgtaaaacttaattcctgattcgaagttaaatgcagtgaaggatgtgagggcaatctggctgctagtcctgtttcctcagcacccttgcccccttgggcagcacttaagtgtttcattaatgggtggtatacacacgcaagactgggttttcttctttcttgtatgaatggtggacgttatgcacatgattttcttcctaatgtttctcatactatatcagattagaacacaaggtccccattagagttaaagctctgttcttttctcaaactcagagctattttatgttgggccattgatttgtcatggaggtgagcatgcttctacattttgtgagaattaattgcaggatggctttacctttcagctggcaattgtgacaaccaagcaagcatgccacagatgctaccgaaaccaaaggggaagtgctccagctaagaacagtgcttcctttgtggggcctcgtaagcaggactggggaagtgaagagaatcctttattttaggagtggagtagcctgatctatacgtcagagtttctattttgggctcttacctctttttcaaatcaaggaaggaggaactgttgaataatgcatgagagaaagagacagttttacaaacctcatgtgaagctgctctcaggcagctccatggtggagcccttctcacgctcttctgcatcattgttgctgttgctcacctcctgtatgtccctacaaggctcctgaaacagagaccttcagtgtggccccacacatggatgttcctgttctttcttgtggtagaaatccaggctgttctgggtgtcagttggagggcagtgtagacatttggctagggctagtgcagtactccaaagcatgtccgagactgtgcggctgaactggtgaactcaagccccagcatgggtcccgagatgctgagagcagagtgctgctggcaagacaggggctgtctagaattatctctgctcctcagtagcccattatgccagtctgtactcaatttctaggttctacatgattgttttgaaaggtgagcgagcagaattatggaggatgcatctgtgtacctcatgagtgaagtttgtgactacagaccccgtgaagatggctcctgatacctgagcagatacactatagacacttagcactcagggatgctacatctggcatgggagtggtaaaggtggaggctatcactttttctcacaagcccttatggtctgctgtttgtttttttttgcatgctctccaagcttggtctttcatggtggcgtacagttccagaggtgctgctctgctcttctgctgtaatgcatgccattttttgtgtagcatgaggccttgagaggtatggcctgcctcttaacatttggtcagtgtcacagatgctatggcctttgcgatcttcaaggcattctgtgacaacatgagccatggctgaatgacagacatcgtcaggagctgttgtgaacaggtcttagccggcctggtatctagtgaatggtgctggttctcggggccagagtgcaggctctgcccatccattccattgcccacattgagatctccagtttcccttttctgtcctcctggctggctagcacatggagtgttccagataaccaacaactgttgattatacttggagaaggttggggcacagatctcattccagagggagtgtgatagaggttggaagccctggtgaagcttgtgccagtgagtgacaagtgttgctgactaagagctttgagaaagcattgtagtcttgggattctctgcaccagaaaacaggtctgagaagatagtggggatgttggtttgcttcaggaaagagattgcttttcccttgtaacagagcacagagcacaggggcaactgagtggcagtagatggaccatgagcagctgggcttgccaggcagatgttccttttgttttgtttgttcctgcttgtgcccatttgcacaattcaggaactctgcactactctgctctaatgccaccagggtaatgagctggtaataaggttggagcgtggagcctgcctttaaaattgctctgccatgtgtgtgctgtgtgacttcctatctgtaaaacaagaagtgccagcgttgtctacactgtagtgtggtaacaagagaaaagggaccttaggaagtaaaccctcagaatgtatcctgagagcccatgtggccgctggcagttctcctgcccagagaaaagctctgcctcacgtaggccaggcctgtgttattcaggggtttcgaagagaaaagctggtaggttgcaccatgtataggtcactgcctgagggccaagctaaagccttccatggaagtagctttttgccttgggtgtactgtttctctcccttctaactctccatagaatgcagactgcagtgaagctgtgtgcccagagaaggagctgtcgcattcacacaaaggaagcagaaggggacatctctggtacttttggaaccagggtctttcttagcagtcatttcaaatgaaacacatagctgagtggtggtggtgcaagcctttaatcctagtacctgggaggcagaggcagaggcagaggcagaggcagaggagcagagagagagagagagagagagagagagagagagagagagagagagagagagagagagagagagaggcagacgcagaggcagagaggcagaggcagaggcagatgaagctgtgtgagtttgaggacagtctggtctacagagcaagttctaggacagccaggggtacacagagaaactctgtcttggaaaaaagaaaaaaaaaagattcagatgaagcatatagacagtataggcaacctaaaaaatgatctgatgctagaactggccagagagtgacctgttaactctgaacttagacactctaaaggctcctttggagatcagggactcaggctgcagaggcgtctggccaggcctagcaggtattgggtcagctgaaggggaggtaactcagggatgctgaagatgttgtgtccacttcctgttgccatggtgagttgctttgtttgcaggtttgtccagcatcattttcccacatcccaagatgctgattgagctgtaggaagccggtttgggccttgcctctgtaattcttatccctgtccagcagcctgggttcttcaggtctccaggtgcagctcaggtcattgctcacatagcagagactcaaggggtccatgtacaaaataagagctagtttttgttttcttttctatgaagggattgaagtgggaaaccagtcatgtcttgatggcaccagggaaaaagacatacagaacagcatctccatgggagtctttaaagggaaatgaaatgttgtaatggagtggaatagtgcctgagttacataatacctgccctacattcttcctgataaaagtcagccccatgggctatgttgagacccatgaggactggtagagcactcagctaatggaaggcaaagggctgcaaatgaagtaaaggtggtctagaagtgactcatgtacacatgtgacacgtgtatctagagacaggatctgagggtgtgtgtgtttgtgtgtgtgtgtgtgtgtgtgtgtgtgtgtgtgtgtgagtcgtctgtctgtctgtctgtctgtctgtctgtctttttcccgtggctgttatctccaggtatcaggctacttgagtttgaggttctagattttgtagatgaatctggggtgagacaggaaatacagtggagtggtaagctgcagcaaggcaggaatttggccagagattgcccttggaggcacacctgggagtgcgcactgtgagacgaaatgctaggtgataagaactgcctagactgaggcaggaggaacatagctcagaagctgaggagtagcagctaagagtcagcaggcagctgtgctggtcagatatttgtcatccagaaagatggaacctcagttgagacaatgcttccatctcactggcctaccggcaaatctgtggggtattttcgtgattgctgattgctgtgggaaggtccaacccactatggtattcctgagttgtatggtaaagcaggatgagcaagccagtaagcagcattcctccatgctatctgctatagtgtctgcctccaggtcctggccttgagctccggatctgacatccttcttgatggactgtgagctatgagaagaaacaaacccttttctccatacccatggtgcttatcacagcaacagaatgcaaagtgagacacaggaaagccagatgagggactggtggcacccaagtgccaggtgtggaaccacaggctctgctgtgctgggtcaggaaggccttaggcctgcaagattgggccaagtgctgctatggttaatgaaaacagcctgaagagtggcaaggccacagcaaggagacaggtaatcttgctgtgtattctttctcatttgtgtgtgttggtgtgctccctgaaggagtgctgttactcttcatcttcttgtccgtctgtcagccaaagagaaaggaagagtgagcacagcctcaccagctgggcactctgctgtgctctgccgacacttaactcttgccgtctcttctgttctcctcactttccccttgaagaggtttctacagattatgatctgacatggggttcactgaggcctcagcctcttgtctggaagagacagttattctcatggtttttacccaggtccatgttttacagtagccctcctctgcctgctcactgaaggcttgctttcctggttcttcaccatagacatacagtgtgtttcatacaggaagacatccattactgggtactgctgagggctggagagccaccaatgagatagtagcttgtctgatggctatgtctgactggagtgaactgggtgctttggtacagatgtgggatgtgtttcttaacatgttcttgtccatggcttggatcagaagttagctgtcagggcagtgcatcatctgcagggaacccctaaaacaactctcaacaataaggaaaagtggaggctctgagcccatggtttcaaccttccaagtacaaaggctagtgccactacactgggaggtttatttatataaaaaacaaaattcaaaaaacaaacaaacaaacaaacaaaactggcaaagacaggctccattctcacagtcctggttgaagagggcagtggtgctggaagtcctagagagatagaggacatgttgccactgcttcacagggtttccgagcccagctaggagtttgtcaagaggagactctttctgcatgcagcccttttcctcttcttgtcatggctgtggctctccttgaagcatattactgcaacccaagtttgtgatgggcccacacagctgcctttgtgatgggagcaacaccatcctccagctcggcagcctagccttcttacactgtggtggcctatagtggcctctactgtccctgtgtgagagagagtcagatcagtgaagaacatggcagggactgcagagtcccttctcaggagcccttcctggacctcactagcctaggaagctgtgtgctgtcacccaggcagatgttggctggaggctatcactggaaaggaatggagtccagagcaccaggcttcccttgcaccaagttattcattgttatgttctccttctctgctgcaggctccaaaacccacgtggcctattttattacattgtgagatttagctttttaggaggaatgcctagtgtgatgggtggtgttttggggagttttgttgttttgaatgcccaatgaaaacacccataaatcccccaaactccttgatgtctcacctgctgctgtgcctttcactccacagagccattatccaggcatcctcattttgaaacaaaaccttacgtggtgtggtgacatttaatttagtgtttctcatttcaaagcccttaaaaatattaattaattcctgtcaacccccaggaggcacattattaatatccgaagtgcctttcatgctggtccattaatgtgtcctcccagtgtgataggtaagaaatgaggttgaatctactttttttaaatttaaatttttttttcaatcacacaagataagaccttgctagagctaaggtcagaaataatgaatccctaattttattaagatcttggcatgactccaactctgtgcctttgggtgtgctctggaagaaccacactcctgtgaggtgtagtatctgcaggcagtagatgagttttcaatggagccttacaaatgcagttcgataactatgcagaggtgcagagttcacgaagccactgccacagaaaggaattagtgggagtagagagcagggagctccgggtgtttccatcagagactagcagtgatggcagatgtccatgcagacctcctcagaatagatggctgtggctcctggagggtaggcctgccctcagtctgagtgatctcttctttatttgatgtggcctcttgttgtcatctcccctcccccccattcttttgttccttccatttttgagacagtgtctctctgcgtaatcctagctgtcctggagctcactctgtagacctgggtgacctcagactctcagagatccccggcctctgcagcctctaccaccaggaggcacaggataggcactgaatcgtgttccagctgagctgctggccctgccctcctcactgctctgagagctgaagtcctgcagctgcagttcctgaatttgaagttaatttagatgggagaggtcactgtgcaggaacagagacacacccacccttgtagcagactctggacagggtcagaatctggtttgatccgtgagagatgtgaattggagctgtgaccgtgaggcttgggcctgctctggctcctttgtgagaccgaggaggttgagaacatgcactgtttaggagtgttccaagaacagggtcatgagcagtgatggtgtttgggccttttggaaataaatagggagtgtgcaatacactgactcatagggagtgtgcacacgtactttctcatagggagtgtgcaatacactgactcatagggagtgtgcacatgcactttctcatagggagtgtgcaatacactgactcatagggagtgtgcacacgcactttctcatagggagtgtgcaatatacactgactcatagggagtgtacacacatactgacttatagggaatatgcatatgcactaaggttaattgacttttctcatgttgcccagtaagattctgagggaggaaaaggctgctaatcagtaaggtcagtgctggagggaagccgtggtccccactgctgtcacctaatgagcatagtctgccttctctggagacttcccttccctttccgccttagtcatctcaggtctctggtagggaagcactctaagagccttcaggtacaggtagcatttcttcctggcagtcacttctctcagtccacactctaccttaagtgtttagcctccaaggacagctgagtctttgtttgcattaagtgaagaaggcagctttgctatggagacctggccacctctagggcttgcaaaccatgaagataacttgaatttggtttatgatttccttgttatttctcttggtagtaaatagaaacattttctgctttccttgtgtgttcacaaagagaataaatagccaattttgagccccttttggctcctctttgtcaggtcccaaagaaacctaggacagatagctatttgtggtgcctattagcacaccaaagcacactctggccaccaggctcacttggttctgtgactcctcttagttcttccaactgcactgcctgctcctcatccccagcctcacccagtgcctcgctgcgcttccccatctctcctccatttcagccgtgtgctccctggggtcttctctctctccccgttatctagggcctctgctcctctttatacccacttgccctctcccccacttttctggcctggttcagtgggacccttccaggtgcctctggatgtactctctctcacatatccgataaaaccttccccatgaccattaccttagggtggtcaaaaggatgtcataaccgctcctaggtatggtgttaattccaaagatgggaggagaaagaccaccaacatacaccaccatggccaaattaattaaagcaagctcttttatttgtgtacatgaccaaggtggggttttagaagttacctttgaatgtgtggaagactaggtttttatagctcaggggtagggcgtttccaaatggatttagtggccaaaaataggaggggttataagaacagagcccataagcataacaagttagtcatgaggacctcctggaagaaagacatgactgcaaggtggttgtaacaagaggtagtctaacaagacagcaataacaaacctttgaaataaaggtcaggttgcaagatggttattaactttttgaaacaaagacatgattaacattcctggaacagactgtacagagccatttgtaggtaaggttacaggtggaacatagctcagtccttaaggtttaatcatacaggaatgggtatagtttctctctactatgagataggttttaagcctaagatggaggcaggctggttcttcaatggctgaggaggagaaaggtttttttgtagatatgagggagaatattgccagagtttatctggaagagcccagagcagggagggaaagtagtagactgaatcaggccatgaaaggagagagagaatggaagagtgagagagaaaagaggagagaaggccagagaggagcccaggaccaagagaacagtttgtgttctttctttgggacctaacactcttcgtaacatgttttgaggcttgcctttccatatccacattctctgcttttgtcatctaagagccttcttggaagtaggaaatatccatcttgactcttgagtgtatccccccaacccaagccccagtcttgcaacctctgatggagtctgggatggccttgtccctctgactctgttcaggctgtagatctgaggtgaagtgttccgtacctcttgctcctgtctactcagctgtgatgcacacttgaatgcagtcctatgtagatggagagggctttactttaattacagacggccaggagaagggtctgctaaaatggggtgtggtgtggtgctttatctggccaaaatagcaacagtgactcaggaaactccaagtttgagctcatttgggtcttagcacagagtcccttgcccagtgctccatgtttgtgtagcaagtgagtcacacctgtgaggagaggtgaccttgtattggtgaggcagtctcccagggctgccgtttgaagtggtctaacaggtcacttcacacttcctctggagttcagaatacattcactttcttgtctgggtgtgattttggagggcatgtagccagcaccattaaaatgataaatcctgagggagagacagctcaggagatagagaactggcggctcttccagatgacccagcgtcagttctcagcacccacatggcaacttgaaaccatcgaggattccagttctgggtgaccgacactctcttctggcctctgtaggtactgtatgtatatagtacacagacatacatgcaaacagaggactcaaaaacatttaaaaaaaaaaaaaaagaacagtctactgtgctggtgcatgccgctcagcagggagaggcatgcagatctgttgagtttgaggccagcttaatctacagtgagaccctgtctcacaaacaaaacaaaacaaaaacaaacaacaacaacaaaagtagttttattttctcagaattatattacatctttacatcttcctatcctcttaaaactgtttattaggtttgtctgtcttatttcacatgtatgagtgttttcttgcatgaatgtctttgcaccatgtgtatgtggtaggtattggagtaaggtgaagacatcggaactgtaggtacaaacatcatgtggtgctggggactcaagcctgggccctctgacagagaaaccaatgctcttaactgccaagccatctctgcagccccatgccccactttgagacagggtcttcctaggtagcccatgctacctcaaccagttggttgccgggattatagacatatgaagtggaacttaagggttctttggaaagtcagttgtgttggatggtgttttgttagggcaaacatatgaaggagtgttttcctgaagtggacacaggtgaaagactaagacggatgcgtgaaggaacagacacaggggagaggatgtcctgctaaagtgagcatgtgaagggacatgtgatgaaggactctttgttaaacgacactcatgcattggtctgccttacattgcgtagctgagctgcatttgttaggacttcattgagagaaacgcaccaaaaaccttctggtggtgtgctgcagtttccatccccttctgggactcaggctgattggcagagtggtatcagctgagacagacatgtgtgctaaggcaagacccgtggaggacacgtgatatttgaagggaatataaaaaggacttgatgggcagtgatggaggctgggcttagacttgcttatagagctagctgtgcaatgatttttggtcttgagtcgtcactgatcttcaatttgctgagagagacacagctgagaacttttcctagcgtccctccgggttcctcctgctgacttatgtcaaggctgaggcttggctgtctctgctaggtcatgccacagctgctgattcgtgtttgctatcccgaccctactaaactggattgttgaagtgttagcgagtggatctagctgtagctgctgatctgtttctgacaacacagatgggatttgctcaaaagaacctttctaaacaggtccatttttcctgtatcctttcttttccactacctctggtgggtggtgggctagaagcgagatgaaagcattaaaaaacccttattaaaattaaggattgaaaaaacattaaagtttcagacatgtactgccacacctgtttcacagctgcatttgtggggttgagcaggatcccggtgttgagaatacttagtctgagtcctgagcagcatctctcaagacacagagaaacttctgagattggaggctgtgcatgccaaacacccaccggctctgccattattctccagccccttcctgggatgtcatgtgcaggcttgctgccaggcaccgtaaaggcctgatggacactgcagtgcacagtacccaactgccattcccatagtgctttgcagggttgtgctgacattcacttgtgtcaccatgatgtcagatggcattttatcattttgatttgctctttactaattgttataattaatgtcactaacaatctggtgtcactcaacaagctagctgctattagcatgtcatctagatctagagaggacaaggacgcaccctgtactgaagggcatacacaaagttgtaagcagtgatggccccttatagtctgtagtttcatttagacatctgtacacaagtggatagcgagcagtgtgacgttcccctgccatcacccctctgcacagaggctcaggaaagggccaggcctcaggcaggctattccaaacacacacaagagatgtggctgaaggtcactcaggcagtgatacccacctgcctaggcctacatcagcatccttgcccccatactgtgtttctcttcccacagacacttcctctccatgactttaatgtgctttgctcacgggtgcaggggacttagggaacctggaggaccttctaagtctaaagccttcatgcactggcacggactaccatgggctagcagccagacttgtcagtttgtttatttctctttttagcagcggattaagtcagtttattaaaatagctaacttagtcatcagcaatagtgattttagcctccattgtggctctgtactgaacaaagtggtctgcttaacattcttggaaggactgcacaagtcggggtggtgctaacagattctcctctgggaaacttgaaggtacttttcctgcagtgattctcatcctcggcttgcagagcggccctgtccctttcaggtgctttttctttgtgcctccgttcaagtccacacactcctccagtgacttcacattatggctgcagaagaaagtcacatttggttccacaaacatctttccactgtctttaaaggcgcggctgcaacttgttgcttggatggagcagattaagcagagttccacagtgcctacaactatagcccagaaggtcatttatttcttaatttgtggtcctcacatatgtcgatagaagaggccaaaaatgggtatcagtgtgcgtgtatgtgggggagtggggtttactccattttctgctgtttctccttcacatgtaaccttttcttgtcaaaggctaagtgacctttggccctgctttctgtgctgacctcctgtcctctagtctctgaacagtttgagtggatgctggctgaccctggctcacagacaggtcctggtccacaaaggcctgggatacatttgtgattcccttgactgtttatattctagacacttgctgtatcttcctcaagtaatattaaggcacactttttattttgtttgtatattttcatatttattttgaaataggatcttgtagtatagcacaggctgaccttgaacttgaagttccttatgttacctaagcttcttgagtgctaggatcaaggagtgaaccagaatgcacaacttatatcattatattcatatatgtgttctgatcagatctccctgccaccattccttccnnnnnnnnnnnnnnnnnnnnnnnnnnnnnnnnnnnnnnnnnnnnnnnnnnnnnnnnnnnnnnnnnnncctcccccaatacctactgagtccagttgctgtaacttatatgtgcatcggtttgggaccatttcctggagagtgggtatcctctcctagcagccatcagttgctcatagccctctcagataggggaggggcttactgatctcctccccgttcacggtgggactttggctggcctgatctcacaggtcttgtactacaagtcccaacccctgtgagcttacacacgcatcttcattgtcgcgactagcccatacaatttgcttcagatatcaatcatttcttccttttaatactttatcctcaatggccctgagccctgagtggatggctgtggtgtagatgacctatctggggctgagcacgccacagtcttactctctgactgagtctgggtctctgctgttgtcggctgcaaaaggagtatctctgacagcagtgggccattcactaatgtatgatgtaaaggtaagcgctcagagaagttcattactatgttctttagcagaatcataccattaggctcttaattagagcctataatctggacagccatgtggtttgtcccaatttatgataccaaacatgatttctgtcttgtaggagggtggtggttgtcgtcctcttccccgtccccgtccctgtcccctcctcctccccctcccttcctcctttcctcctcctccttttcctcttctgttttatgttttgtttgtttgtttgtttcagtttttcagataagattcctttatatatccctggctgttttggaacttactctgtagaccagactggccttgaacttagaaatctgtctgcctttgctaggattaaaggtgagcaccaccacctggctgtagagtggattttcaatccagtcagagatgcagcactcaaacctagcattgatgacactattataccactgtgcagtcttgcccgacagttgctcctgtagcagacaggctcacagctgcaggcgctgctgctgatctttcttgctatttagtgtgcatggcgcctgtctactgtggtttctaggtagtagggatggagcaaccagtttgatttctccatgtgttttatcttcatatgggtcttacctgtaacttctggaaggtaaccaagagggacagatgagcatacgttcagcaaagtagtaggatacaaaactaacagataaaactcagtggccttcctgtataccaagaacaaacacagtgggaaagaaatcaagaaaagaatctcattcactgctacacagagaaactctgtctcgaaaaaaaccaaaaaaaaaaccaaaaaaaaaaaaaaaaagaatctcattcactatagaatttttaaaaacaaaacaaacaaacaaaccttggactccatttaaccaaggaaatgaaagactcatacaatgagaactgtcaaacactaaagaaagaaattgaagaatttgctagagaatagaaagatctctcatactgatggattagtgggattaatattgtgaaaatggccatcccgccaaaagatgaaatctatggatttcagtgcaatccccatcaaaattctaaagcaattcttcacaggaattgaaaagtcaatttcaaaattcatatggaaacaccaagcccaggataagcaaaacttatcctagacaataaaaatgtcactggaggtgttagccttcattacttcattcctttttaaacgttaagtgtaactttaccgatctgcattcattctgtggaacatatacgttacttttagaggacagatcataatgtccacttatataggcagaaactttcactggttttctagtaggttctgcatagttttagagaacatggccctggtgcctggaattctttgctgtgccctagtgttacgatgatcctctgccacactgggctctgtctttacattctgtactgaaattttgctattatacgtgagccagagaccctcatccctgtcataggcttcagcattcatgggacattaccaggcttatctctgccctgtcccccaacttattccacttgctcattgcaagtgagcccaggttttttgttttgttttttgttttttgttttttgtttttctgagacagggtttctctgtgtagccctggctgtcctggaactcactctgtagaccaggctggcctcgaactcagaaatccacctgcctctgcctcttgagtgctgggattaaaggtgtggggcaccaagcccggcttagcccaagttttaacaaatgagctttcagaatattttaacaacagctctgctcctgggaagcccttgtgtgtggctctgcctctggtgtcttttgtgttgcattattttaattagattccctgtaggatttggggtatctgaaggctttccacagtaactgttggttttcccttttctgtgctttctttgttttgttttgttttgcatgtctcccccagcccccttttcttttcctctgtgtgggtttccaaaacagtttatttcatttcataatatagcttgctagatgtttattggagttggcctggctagggagagctgagtgtctgctgaagtaagctgtgagcctgttcaggtcctgtgtttctgtgtttccttgctataccggccactttgcacagtgaagtccacacagctcttcctgagctgcctctcaccagctaacaagttttgttttgttattggggttttctttgccatctctgtttgttgtgtgtttaaaaaccctgttgttcatttcaggaccccatcctcaggtgttgcaatgtcccgcacaagagggcaatgtgccgaacagtgggttctcccttctcttctgtattactctgctgttgctgcagcgtatgctgtgggctctcatttgagcaaattctttatgctccatgttctaagaagttcgtcagggcagtcccttctgtctgactcatgctactgtgtgacaggctgtccttattcatgtcccatgttatagttgtcctcggtgaaaacatactgcatgaccacattctcctctagcttggggccacttgtgcaaggccccacagctgttccctgtagattagtgtacatgaggaggagggtcctctctggcccttccctgtttgtgacaaatatctcctttctcttttcactacaggctcggtacaagcagagcctcgaccctactgtggatgaagtcaagaaactttgcacatctctgcgccggaacgccaaggaggaacgggtccttttccactacaatggccacggggtgcccaggcctacagtgaatggagaggtctgggtcttcaacaaggtgggctagccctcagcttctactctccttccccaaaaggcctgtgagcttgggtatcccctgagacctcctgcctgtagcttttgctgaaccctgggtgcttcatgcactctcagcctttgaagaacagcaaatgacaaatgagttgctcccagctggcagccgggcctgctgaggacgaacaggcagaggagctatttcttttggagggtgtgttgacaaaggcattctaaggctgtgtgtgtagacattctgtcctcagcaagatgctcacaggtatggatggatctcacatgcactggctttccagtgtgagcagccacagtagttctctgtcctgagtgtcagggatccagccttctcatagaaaatcaaagtattctgagtattctaaaaagcccagcaccatttggttgccacctcggtctttctgatgggcagcacttccagcctctagtggtgctgtgagttcgattagatggtgagaggaagagtgactcggccccctggctgaggagtgcatttcaagcattctacagggacatacttgtactgtgtagctgtacatgacaggtacagcctctccagcatgtgttgtggcccttgagtgcttgagctttgatttggggctccatagaaggtgaacttagatttcagtcaagtcccactctagtgttaggagtagacaaactgaacctctttggcctgtttccttgtggtagaaacagcctcattgtgtcctgcagataaaaacatacacaaagtttgtcaccagccactcccatgctttctgagaacgagcttcctgatgtccgtcatcctgtcaccttgtcatccttgtgcagttagctggtgagcccacagaggggcctagcagttggttttaggatctttccccagaggtgtagtgaacagaaccctgaagctaaaggactccctgctcctagttagttccctctgcaggaatactaatacagtgctctgccttctgtatatggtctaggtgccacctgtaatgtcctcttttcatttctattcatagattgcatttatattatatattctaagtattatgtgtgggtgggttacacacatgccacagcattaaagcattaatgcgaggccagagaacagcttttgggagtcagtctctctctctatcatgtgggtacttagaactgaactcacgtcaccaggcagcctgctaagctatcttgctatctgttaagaaagaggtagaatttaaaggaatatggtgtcatggaccaccaggaactcaccgtccctttcaggaaaggaagctgtggagccatgtgtgccctcttcagtctcacgccttctcactctatctttttacatactgacatgagggcacagaggaatccaagcttcttactctctgcctatctcatctcatctcatctcatcaggcagaatcatttcaggaagaaagggtttattttagcttgcacatacacatatacacacacacacacaaacttttgtgagtatgtatgtaagtaagtatgtatgcttaaatggtcttatgttacatacatgtagaagttagtatgtggctattgcccgagcttttgttccgccggcaagaacacgctcaggacaaccggaatcttcttcagcaaaagctttattgcttacttcttcaggagcaagagggagaatggcaaaacccgtcccttttaaggagaattatcctccgcctaggacgtgtcgctccctgattggctgcagcccattggccgagttgtcgtcacggggaaggcagagcacatggagtggagaactaccctggcacatgcgcagattatttgtttactacttaggacataggatgtcagcgccatcttgtagtggcgaatgtgagggcggctccccacatgtggcgtcttcttcagtcatcttccctcttattttttgagccagggtcttttctgaatccagagatctctgttaaatctctgctatattacccggccagcaagccttccaatcctcagtatctcctcacagtgctgggattagagacacacaccactacatccggtttttacgtgggtgtcaggaacttgagcatagctatacatgtttgtgcaatgtagagctcctggcagggagacatggcaacaggtgactttatggtggctgatgcagccgtttgttacgtagtgccacctagaagcagaagctaggaccagaagtggcaccgagctctaatcctcaagcctaccccagtgaccataagtcactcaaatagtccctatgtctacagctttttaaatcatctctactggtagtggaccacatgagctgctgagggacgtttcaaaatcaaaccataacgccgtttccagtggttttaagttgatgtgttgcgaccatcctgtgggtgaaggtacaggtcttggttcttcctcttggtagatcaggactccctcaggtgcagacactggtgtggactttggtggattaggattgagtgcagacgcagggtcctagtgtttcttctcggttggctgggacttccctgcatagacttctctgtatgcttttgtttgtttccactctattggccgtacttagaaaaagtccatttgttccatcgtagatttctctggaacctgttgagtctgagtcctggtgattgacagctggccacacagctgttcttgggttgtctcctgttgatcctgatggaattctttatattctagacagaaactcttcatcatcctgtgaactgtggctgtcttttctaaatttatgacttgctttctattctgtttgcagtgtcctttaaaggacaggagtttttatgctgaacaggtcacactcagtgttctctctaggggcaactgcacctgacctagccaaccatagttaggcctgtgatggacccttttcatatatagcgtgagatggaatctgcttttgtgtttatagctcactgtaaattatttatttattttatatgtgtataaaagacactaaaacccagtacttaatttataagctgtaacactgaatcgagcaggttcctactatattcaaaccatttgccccttgtcacctgctgtttgaggcccacctgggctgcttttccattagcctgtcctcagggtccacttttcctggccataggctcgtgattcatccagcctcatggtaacttcctcttctttctgtcttctccctgctactccggcatctctcctgagtcacctcactcaatcctcaagtcccgccttcctttctctactgcccaatcacatgctctagccttttattaactaatcaactttaaaatgggagcaaggtttacacacgaagaccgttgtctatgaaaatgtactctggactgcaactagatcttgggttgagaatttagggtttgtatgcatagctcactgctacctccccatcgatgccagctttggcatgagtcatctctgtcctgggccaatcagcagtcttggttttcagtgtcttagtttgaggagacataggtaccctttgttcttcttatttgatgtttcggttaatcttggctttttgctctaataagaaaatactaagccaggcatggaggcgcacgcctttaatcccagcatttaggaggcagaggcaggtggatttctgagtttgaggccagcctggtctacaaagtgagttccaggacagccagggctacacagagaaaccctgtctcgaaaaaaaaacaaaaacaaaaacaaaaaccaaaaaaaaaaagaaaagaaaaattactgaatacagtcatctgtttccgtaagactttggggctggatggcccagcagttagagcacttgctgtgcttccagaggacctggttcagttcccagtgtctatattgtggttcataatcacctgtagcattagcatcagggtttagcatcagcacctacatacatgtgacatacatacattctgtctctgtctctgtctgtctctctccctctccccctccctgccccctcacacacacacacaaataagtaaataaacaggtaagaataaaagtagttcttaagaagaaaaggcgtacttgttggaatatgctgtgtctttggctacaggtgatcaggcagatcctagaagatcattacagatgatcttttagactgtgatcatttaaaatgcctgtcaggatatgatagctttcttgataaaagtgtaagtttcttaattttcttacttgagtattcgggaaggacgttctccagactcttgtggattctaatagttcctcagggtgtaaagttgcttctcatttgcagacgagcattttcgtttcttcttttctcgcttgtgccttgtatgtgttgttcttgttttccactgctggcctttaagagaaggaaacagtaactgggcccccttgtctcttttgtggcttcctgaggaatactcagtcctgtggagtctgcaggaggctttttgtgaggagggggaggatggaaacaattatttatcaaattaagaactgttcctgctttatatcagagaatcatgatgaggtactggccttctaaagcctttgtttcgttgtgtgttagatctgttactgcttgtttttgtttgtatgttaaaattatgagtagatgttgacttttctaaagtccttggtttgatgtatttctgttaagatggtagaatccctattctcccttaacttataagggacggcatgatatcctgtgactctgtattaaatgccacacacctgttcttgagatggcttatttatctctgtgtatcgtctgtttcacacatggtttaattcagctggctggctggttttgtttgtttgtttgtttgtttgtttgtttgttttaaaatctgtgttccctgttgagattttcctggatttttctctgttccaagtaatcaatattctgtggcttgagaaaacgagtagggaatttccttcttgtcataggctctcaagtggtatttataagactcgaagcattggattgcccagggcagggcagactgttgtgtgaggtctctgactgctggtttagggtctttcttgggtagaagtaggtgttcatttttttctgaccttttgaagatttcaataaaggttttgaaattgttgatacctgttgttcaaaatacctcccttgccaccatgtgagtctagggaatggtagcagtatatattgttcttggagttgagcacacaggccttctttgttttcttagttattacagtgaggggtatgtgtgccttttatcagtcttgtcaggactccagctttgatctttgaggtccttcaaaaggtaggcaggacagtgacacataacatatgctgtgagtgctctgtgcagcagtgtgccccttacacgatgctgggagcaagggtgttttctagctaaacacagtattgttaaattgccaggggtgtcaccctcctgttccacagactggtttatacagagcctacactcacacatcgctccagccatcccacagaatctgcccaagctcactcctgtgcgcactccctagtctgactcgccgctcagtgtgtgctgctagcattctggtccccaggttctccttgactctggctgctttaaagtgaagttttaacttactcatttctgttggtgagttagaccagtttggatcagtctttaaaggcattagtaggccttcttttgtggaatgctttattaactatacagacagtgagcagtctagagccttctgctggattggctcttgtctcgaattgccaggattgatgagccattatggtgtgctcttgctagccatgtcctgctttatgctccttcctgttggtgttgtgtagtctggttcccaccgatgtgtctcacagatgtgcttccccagcgctggtgtcattcagagctcaatcactgcctctccactgatgttcttcctttcttcttccctcccttcttttctttttagctttatctttcccagaatgcactgtagttggtgtcatctataaatatcctttcagagcgacctcgcttgcctggccagttggactcaaggctctttctccacggctagacagctaggtctccacgtgtactattaagcctcctgattctctcctcagttatgaacagtgctgttcacacattttgagacaggttttcacacagcccaagctggccttgaacttgtggctctttatgtctctgacttgggattctttaggttgctggtgcacatggtcagaacgtaattagctttgtaagaattgccgacctttgttatgagctgtctgtgtggtttgcatttccaccagtgctccctgtgttggcaggatcagcattctggactatagtcactctgcaaaaggtgtcaaaaatgtgtcgtcttgtcttgttgccagtgagtttacaatttaatagtctgacctgtgacagagtagtgctcagcatatcttcatatcctggctctggtccactgtctatcttgctaacgtgtctgcttgggtctgttttactctgctaggcagaagcacagcctgtgtgctgagccacatcccggctcacctgccctcttgaagatgaagcttccttccttgttgagcgttaataatcctgtggaccttttagaccttggtcctgtgtcagatatgtgttttgtagatatttgaacttgtggcttgtcgtcttcggtaatagtggacatggtttttatcactggaaagctcagaccaatcactctctacatgcccaggttctgatttaggttccttgcttctttgtgagtttatgtctgaattaagaaagcagattgaagtctgccttacacagaggtgcagctataactgaaggctggtccaggtgacggtggttcgttcactgcagattcacatagaacgcatgtgactgtgttaacaggcaccatgagcagaagaaccctggggatgtgtgtccacacctcatatcagtttgaaagtacagcagaacgggcagaggggaagggggaaacaaatctcccccttgctggatgtctgacgtctgtctttccaggagtcactaagttagagcgaatgctgaagattgatagttaaacttttcaaaaggaaaaactccagggagagcatagtttttcctgttttagtggaaaggatctgcgcagtgtcattggccaccctgatatcttaaacagtgctacaacatttacccaacaagtgtcaaccacagtcaaaggggaacatgggctggacatgtgaactctctactctggaagctggaacaagaggattgagtttgaggccaggctggactacatagcaaggtcatgactcaaagcctttactccaaccccagtcacagtagcactgtggtggcccgcatgtagaagtggacatggagggtgtggctgaccctaacctagccaggtgtcattttgtcagtcacagactttctgatccttgagtgtacccaaagccagctccttctcctcctgagtcctctgtagctttcctgtggtctctgtgttgtgtctggttctctgtggcagcaatgtcattgtgttctgagtcctagacaattactagtctgtctctggtggacagtcatacgaaaatagtaaatctatggaaaaaaaatcaaatcaacaggacaatgaagtgggggaaattaagacaagacaaaagagatttctgcatctgagactggcttcacaggtgctgcggcttgggggttcagagcacagtgacattgctgtaagcagagccggcctttgaaggctgaggttcagtctaaatgtaaacaaataaaaggactaaaattgctctgaactaaaatgtaaagccgagaaactcacactcagtgcatcaagagaggcaagctgagatgaagcctgctcttctaggtgaagtgggtccagctatacaggcaagaaagtcacttggctctgtgctgggtgcacaagcaaagatcaaaaatagcttctgtcgtgctggactctgtagaacacaggaaaaggctcgctgagtggaaaaacccttctctgccagaaatgccttcaaatgctggacctgcttgctctcttcagtgtctgtctcacccagtatctctctcagagtttgactgctctggacataaggagataaagcctcatggagaccacactaaaagtaaagattagattgtttcctgttaggtgctgttttaaatcaagttaaagagaaacctgctgattgtgtagtgacaagtgaagtgatgcaggaaagatggactgaccctttaagagtggaccagcagcgagctcccttccttcccagggaccccccctgcaggagtcaagtcagcaccaagtggagccttccactgagggagatgggagactgtgtctacactaaggtttaaaggggacagaaaacaaggtggtgtgctggaggaaggagtgtggccaggtggcttctaggatccctccccctctgttgcctgagagatggatttgagaagacagcaagaaagccagcataaggtaaaaatggtgatatactaaacactgccaccaaggtgagcttgcatgttgaggccgtcagtggagggcaaggtgatggactgaggacagatggacagagcagctgaggcctggagcgtgaccgggatgaagcgacaggaagaaggggctgatgtcacctgctggcctgggctgtgagtgtgtgcctgtgagaagcgtgagaagtggtattgggtccccagcttatgatgactaggcctgaagaaagcgtgaggtctgggagccagagcaaggcccccggaggtgctagtgggtctttggaacataagtaaagatgggccctgttgtgagtcgtcgtctctgcttctacctgacctgtcttgtggttaaataaccatgagctccacaaacaacttacagatactgttcttatgactacacatataagcacatgcacacacatacacagcacatgtagtttttgtttttcacaggtatctagatgctacctacctctttgtctggtatggaacagacagctgctgcttctattgaaaggcagattgtttaggttttaaaacatgcacttggtggaaaacattgtgactttcataattgcattattctcaccgatatcgtttgttgaaattgttactttgggggagtccaggaaacgacaaaagccttcatttcactgtgaacttgaccctctctttttagaatttctagcgtcttacatttgcttatagtagttgaaggccatcagcaaaaatgctgtttctttagagaaagcctggaaaccttaggctacttcttttctttataaatttataaagaaattcctcggtgctgaaaggtatagttaccttcacccacattttgaactttttaataaaatgtttctagagccactaaaaattcaacatttgtaaaacagtcgatgtagcattcttctgattgcatgagaaggggtctaggaactgggtagctgctgtgtgggattaagctccctcagtgccccctcccccatgttctctcagcagaccctcactttccccacctcttccgagttggttccccatcctgctctctggtctgaagctgtggcctttcctgctcgttttggctcgtttggttcaccttcacgggcttagctgacagcctcacccatctcctttggcccttccctcactgctggccttcctggctgggtatcttggtcatgtgagacctttgtggatgctgtggtctgttattcttcacgcctgatttgttgttttttaagtgaatgatatcactgttcatatcttaaatagcttgctttcccattccttctgaatgtcccaagcttcagtttccaggtatttgagtgtttattagccaggtgtatagctactgcatggtaatggtgtgttttatgtatttaatactgatttcacatgggatcattataacattgattgttcttggaattcttgggtatgtggttagaaacattctaattcttctttggttcccttagagccacaacagctgcaaatcccagccgtgttgaatgtagaacatgtgtttacatggaacagtacataggaaaaggtcacctgacacttgggagttactgtcctagctttgtatctgtggcaggcacctgagacaatcagcttgcttgcttggttctgtgccagaatacaccaatacagcatggcaggaccattgacagagagatccatgcccaggaatgaaaaaggagctcaggaccgcacactctcccactggcccaagaccaaggaacattctagatccaaactctagtactttgagcatggtaaaacctgtgaacttgctccccatctctctctctctctctctctctctctctctctctctctctctctctctctgtgtgtgtgtgtgtgtgttcggaggtttatttcctgagcaaactgtctcttgaaccacatttctcattgttccgatcttagaaaattattttggcacagacaaggtcttgtattttgccggcttgtctcaaatccgctgttcccctgtgttattctcaaatcccagtgttacagtgaagaactccctgcctcactggttacagtgaagaactccctgcctcactggttacagtgaagaactccctgcctcactggttacagtgaagggtgccctgcctcactgattacagtgttttgtgtagttttgagtttatataagcgttatcaagagtggtccagctgacctttttattcaggtttgtgtttctgttgcggttgattctgtcaggctgagagtcgacttgaaatgctctatggctcaatgatccttttccctgttgctgacacctgtattgtttctagttttcttctctttataaagaatctttctctcactatatttgtgctgaatgtttaaaaaaaaagtctaagaggaggatagaaaaaagaacatgtattttatgtcagtccatggtggctttgctgtactgtctcagctgaactagactctggcccaccatcctggcaatttgtaggctgtctaactcatgtttccagcacatgccaaagcaggctttgggaactacacaagagtgtactgcttagaaattagggctttttgaggctagagagatggctcactggttaagaatatgggctgctctttcagaaaacaaaggtttgagtcccagcacctaacaatggtttgtaactccattttcagggggaatctgctgcctttttctactctgagtactgcatacacacagctgtgcgtgtagacaggacacctttacatgtaaaaataaaatcaaaatagttctcaaaaaaaagaaagaaggaaagacagaccagagctttctatagagccaggaattttctttaagtaagtattgtgtgttttaagaaatgtttgtctttgcatgcggatggtagcactcacagtttctgtagcaaattggcattttccaccttacggatgctgtagaaatgtgacagtctcgagctgaatcaggagagataagatcgggtcaaggctggtgtgagcctactgatggagaagggtctgccttcagctgtaagctcacagtgagctgactgaactcagtggtacttctttatcatgtttaggggagggagagcctctgctgccttgtgtcagtcaggggagcatcattctagctgctgtagaaccccagctctgacagcctggtgcttcccagttgaaagctgtagagaagtgtctgtaacactgtggtccctttcaaggcattggacagcctcgttgacaagtagtgtttagggtctgctggaaattgggcagtaagttggtcctaatatgaggtaggtggaggtcacggatgtgcggcaggaactgagtaaactccctgaaagttcagggaggaggggaccgcccagagacagaagccctgtcctgggccacagggtgtcaaagagcagcctgatatctgaacggcacagagggatcagagcctcatggtcccactcagatgttgaagctaaaagattgccctggaagaagcagaaagaagtgctaccactatagcatgagctgggggtggggagatgggaggagctagaggatggggaggggaggagaggaggagtgggaggacatcagacagcaagcagagagggtttcaatgtttctcacataaggagaggtgtcatctgcggtgatgctcgagccagtttaatgactgacaactacacaccacatacatgctgcactgtgccccacgagcacatgtattggtgagtgtgcttgtggccccctgtgagaacccgagatgggcccctgggactgacacggtaggctagaactgacaccgaaggttgttctggctgatggtgttcactgttgctagtggtgctacctaatggcttggccagttgctgctttggtctctttctggtcatcagtggataccccagagacactttgaagccatgcacaagctgcacgcccttagacagtctcttgttcctcttctgcactccagtaggggcaccactggtttctccagctattagatggattcatctgcttttcattttccttacagttggttagtattgagcccatgcttattttggtgtttgtgttatggtctaataataggatttttctattgtaaaaagtattccgttttgggcccaaacttggataactggtaagacctgtcaccacattgtattgtgctgtgtctattgtgtctgtcatgtcgttatcctcctcatcctcacattatagcacatacacctctttgatgtgtccaccattctttgagccttctttacagctcttcaagaggccgcaagttcctacagtatttcctctagagtcaaccctgatgtgagccatttccatacagatgctaggtccacccaagaaccttacttagaaacaaagatgtgagctcttggcatgttcattgtctttgtggtggatacagttgggcatgttttttcaagggctaacctgtgctatgtgggtctgtatttgtgcatttgtgtgttgtagagaactcagacgatgatcaagtggggagtgagagacttggggctagactaggactgaagttgttaagatttcagatttctgtggatgttcttgaataggctacactctttatactgtagtgagtctacagcagataaaggaaggtgggattgcaggaagctgtcaggtgatgagtgctttctgtgtcaggaggaggcaactctgcttgtagatagttcagagagacagaggatgacattagtggatgaatcatgagaaaggggatgatgtaggaaaatcgtgtctgctgagagcaagacccaaggaaccctgctttctctgagatgtgggaaagaaggaagggggaagaaagggaatgagggaagaggtaaacagaggttgctgctggtggcatgtgcatcagctgctgtctgagcttatgtctacatgagaaagcaggctgagcccccagaggcacaggaggcagaacatcagcatgccccccccccataactgctgtgacgttaggatgctgtatgttgagaacaccaccaccgcagagtgctgacagggttaggagatcagtggcagcaattgtgatggtgtttctgtgagcttatcgcaatggccaagcctgggagaggctctgtagagcctcatgtcatcctctgcatgcctactgtccacagatacacctggaagaggaagtttgagtttctcagaaactcgtaggccaatggcatctatggcctcagcactccctaggagacttgatgccactcctttgctggacatcaaagtgactgttccatgtgtccaggtttgcctgtctagggtgcatctatgggggtgccactgtgcacttgacaaagctagatccctcttccccaccatccactccactgcagctctgtctggccctccctgggggtggcctgttgatcatctttgcctttctctctgctcattgttgtggcagtaccaggcgtaggagttgcatggcattgccatctgctccatagttgaaatcagagcttagcttcactcttcccagaagtcttagtggtgcagtgcatgtgttcctgggatccgacccttccaagagattgacctggtaaaagaccaggtattcctgcactgttgtgggctgggctttttccaaccatagctgctgttacagttgacacagcctgcagtgacagtctgataaagcaagtggtgtttcccccttgtgtttaacgggatctgtcagagaaagtgaattttaatgaatacattctataaaacccatttctagctctttgattagggcttccctgctctctcagtctaggcaggcctgaagccagccctctgctcacagcccctctctgttccccagtctctgcttgccagggtttctgaatgctgggtggggcctctgcccatcagggagtactcaggtacagggccgggttcccaaaggacatgtggcttcttttgttcctgctgcactgggtgttgatcccctgtgtgccaaggccgtgcttgcagctgcacttggctggctcgtaggaccttaattctggcctggagcttgacaaaccctcggcagtccttttgagatgggttctgggagccaatgagcttgttagtgaagcttagctctcaaaggccattctcttcctggtggtttaatagagtggattttgttgtcccagaggatcacagcctgtcaagtttgtcctcactaaactacacagctaatggttttggtgagactgtcccccttttcagtcagttttccttaaggagcatttgacgacatttggagatcctttggatggtcagggctaactggctctggccttggttggttacagccagggatgctgctgttcgtggcacagtgcacagttctgtgcagtgtatggacatggagaaatgtcactgtgggaacagatcatcaaggaatctgctcctagtcaggtgtcagatgtgttgatgtatttaagccatctacaatgggaggcacctgcgtggatgggagtcagtacaagtccttcataactaaaggcacagggccaataaataccagtgttcggttctagggtttgttcagtgttgccttatgggtgggtaccagctcttaggacctgggtgttgccctgtaccttgctattaatgcattgtggaagatggaagttgttaaaggtttccctaatatatctggccttcattattttaataaatcaatactaagtaacttgatgatttagagatttaaatgtaactttgcatttgggcaaatgtaaatagcagacttaattcatgcttgtttgctgtttgtgggacctgtgggcttgcatctggaacacaatatagatgacagtgtctctggtcatcagcagctacacagaccccgagagctgcattcattcctcttggggcctacagtgtgtgagacgtatgaactgactcaggttgcagtggtcctcactgctgttgttgtgctctgcacactacaaggttacttttagtctctaggcatcgagagctggagagacttttccagtgtcattgatgaagaacatttctccacattcatatacttacagcggcttgggagggacatggaagcctatcactgggcatgcccacttgctcccttgcagtggtctgtgtgcatcctgtcttgtagattcttacagaacatatacataaaaggagtacctgtgatgtgtcctcctgaatacagagcttgtcacagatggaggcctagccttcatgcatcagctcgtttgtgagcatgtagctacttagttgtctgagtgtgcaaagcaacactgacatggcaaggtgacctgcctcacatctgcaactctctttgacacgcatgcttgtgtgtgtgtatgtgtgtgtgtgtgtgtgtgtgtgaatgatgttctgaagttcacattttacaatcattaagaagccacccatacctccttttcatgtggctctttataaagacaagttctgcttgtcaggggcacagcactcactagagtcaggaaggatgagctccctctgcctctcagatcagctgggtttcttagtgtttgttaggcaactaggtcttaatgtgctggctagcctcagctcatgcagtcctctgcctcagtctctcatatagctaggaccgcaggctctgcctccctgtccagcttgctcattgattctcttgtatgagctttgtgaggattcaggtgggctgtaggttaagggtctttatttagggcctaggcttctcagcctgtaagactggccaggatgcaggtcccaaggtgagcactaagaacacttagggttgggatgtggaatgttgaactgtagtcacgtgtcactggccaggttcaaaggaaacatgttgtgtcctcaaccagagctctcctgtgtagaagggcagaaaacagacaccaggccacagtgggtcacagttttactagaacaaacatcttcagtgtcctttgtacaaatgccagagtttctgtagagacatgtggaagctgacaaatgggatagacttgttttgttttgttttgttttaggttttttgagataaggtttctctgtgtagccctggctgtcctggaacccactctgtagaccaggctggcctcgaacttagagatctgcctgcctctgcctcccaagtgctggattaaagggtcaccacgacccatggttagagattttaaaacttgatcagtactgacaaatcatcttccagaatcttttttgttaatttctacatccatcagcactaagttcaaccaccttggtcattatgaagcattatttattttttatcttttttttttattctgctgaagaaaatcagatggaattgtgtaggtgggtggatagattgactctcactttcccactatcatctgacagactggtgcacagcccttcctaaccactaccattcatgtctgctgtgcgtgctcctgttctgagctttgctggccagagcgggaggggctcgcacacacctctaagcatgaaactggtgtcggctctatcgccttcctttagaagctaccagtcataaatgtgtgtttatatctcgtttcttttagacttttagattttgtgagtggtttaagaaggtttttttcttcatctaagtaaataaaaatattgtgtttatacattgtaaattctgggtttttgtttgtttggttggtttttttgtttttgggttttttggtacattgtctgtgaggcaatatcaaatggttagttagactttctagcatcacccactgagtcattcatccgttctttactgatttaaaatgccgtttcatcacagttatgtatgtgggtctatttctgggcctttcctctgttgatttgtttgtctcgccctcaataataccagcctgtaattacataaatttatagcctttctaatatctggtagtgcgaatctctgttcattattctttattaaattttctttttttctaattttgtgatttctcttctgtacttattttagaatcagcttgtcaaattccattagaggaaaaccccctcgggcatcttgatgggactggcgttgctgtatagagctgttatccgggaactggtgtctttagaatccttctgggagtgtttatttaaagagagcatttccaggtgttctgtctctgagtactgtgattgtaaacaatctgccaaatgagacaacagcgtgacagtagtaagagccagagcttggctagagtgtggtcctcatcagagctagaggtggccagaccctcctcgtggcagcgtcttgcattgtccttaggtgatgactgcacctgactgctggccacctggacgctccctttcttcagtccttgtttggccttcttcctcccttgagctataggcaccccagagtcagtgtttgtggttgagctgcctactgtcctggtcagcacttacactgctgatgtccaggcaagggtgagtgtgtgcagggtggccttttctcattgttgtgttgatttgtctttgttttggaataattgctttaaaacattgaattaaaagaggattttaggcatttctttagactcagattttctctcctgttacctaccagcaatcaggtaggcagaacagtgtgtcaagaaagcgtatccgtccgttacctagtgctaatacctccctgttcagtgatcagcataaacactgtgcagagccagtcccacttacagagaactctggaactgaagcagcagcgaggaaagcttgtgaatctgaactcagctccttagcgcccatctgtgtcatacagcagagccgccacagaaaggggatctggggcggatgtacatgccatggctgggggtgaaaggagggccctctaaagtggactgttttggggtgcggggagcacttgaatccagtgtaaataggctgctgacgtgagcttgaacagctccttccctgtgacattgctggaagaaggtgtcacagcaggagagggtaagctcggtgtgtggttttctatggctagtgaggaatctccgcctacaagcagatactgggccctaccttctgcagtgtgcaggtgctcgtcaacctgcaggttcctgacatgtgtgtataacccatgcaacctgtgcttgttttccagaactacactcagtacatccctctgtccatatacgacctgcagacgtggatgggcagcccatccatctttgtctacgactgttccaatggctggcctcatcgtcaagtccttcaaacagtttgcactgcagagggagcaggaactagaggtgaggtgctggaaagccagcagcgttgcatgcgtgcgtgtgtgcatgtgtgagtaagatgctgcagggagattaggaaacagatctctgtgtgatgagagattttgtgtgtttaggccatgctgtgatgtttgatgaaagctatggaggtacccccccacccccacccccaccccagacaagtacatcccattgtacttggtgttattttcaatctgagcattggatagtggcatcagtaggcaggttgggggggggggggcagtcctgccctctgtgtaatgttaaattgttgcagacacatgggtttaaggaaatgggcttgttgtttccattctagtctttgtttccatgggtgtcttttgttattgttctattttgttcttttaagtttgtgttttttaactcaaactaccaagctaaatggtaaaaatgaaaacagctgctaggtcggtccattgtcaggaatgggagagactgggagctgcttggataatgaagtggtagtttgcccggttgttttaattaatatttgatggttaaattaaacagtgagttctaaagagaaattgaagaggcagtttcaattaagaggcctccatccagtgggctgcacagaagcactagtggaaatactctgtggcctctaggggctcatgaatcctgattggttgcagcacaggaaattctcaatccaagaacaaaaaatggccttcagtgtgtttccgagagcctctctgagtctgctcagctttaatgtttgttacgttttcacattccatcagaagagagcactgaaggggccagcagcaaaacctgagattctttttagtagaacttaaagttaacatgcctactgtttaatatttcatagtataactttagccctatgtgtggaacctgcaggagagtgactaataaatataacacctttgccccttaagagatgaactgggtaccacagcattgctcactggcctcttcattttgtatttggcaagaatttgtgtttgtgtttccagcctaatgccgtactctcagccacttcatctgggtttgcccatggtgggccaaattatcagctgtaaataccccaagtgccaagaggtaatttctgtttcctgacatcaagtaataaatattgggccatgcggtggtggtgcacacctttaatcccagcgtttgggagggcagaggcaggcggatttctgagtttgaaaccggcttgatctacagagtaggtttcaggacagccagggctacacagagaaaccctgtctttaaaaacaaaaacaaacaacaaaacaaaaaaatctccccatttataatgttaataaatgtaccaaagaatcctgcccaactctcacagcctgttcctgagctgtggagaggtgagggaagcaggccatcaggccatcaggctagttaattaaaccgcactggggagggacctgtccctttccagcagaggcacaattacagctcaagcatcttattaaatgcctgcttcccatcactgtggcgctgctctcagaccacgtgtgttctctgtgtgttaccaaggattaatcagccacaaacactattcgtttcattaagtacaacagatgatttacatacaatcgtttttcagaagaaggggaaaacagcttagtgggcttattcatcatgaaggagcggtgccttatgagtttcaccaagtgtttcttacgaagctcagctcttcattctctgtggctacagtgcagactgagcttgtgtttctctcgcacacttacatcagggctcactgctcattcagtctcttgcctaaaaaagcggaaattacaatcaatcatagagggttgttttcttaagatttatttatttatttattatatgtaagtgcactgtagctgtcttcagacacaccagaagagggcgtcaggtctcattacagatggttgtgaaccatcatgtggttgctgggatttgaactcatgaccttcggaagagtagttggtgctcttaaccactgagccatctctccagccccaatcacagagttttataaaattggctcccagctatgacattagtgctcatcggtcatttcaccctcctgtgtaactgcccggcttacccgcttagtctgatcttccctggggacacacatcttatgatcccagcactgcactcaggagatgcaggctggaggacagagggcgtctgctaggtggtatgggatctgttctcaataggtaaagacctaacctaacccagccccggccagtttctttgtaaattggcaatatagtcagatcgttgtgcactgtgtgaactgatggaaactgtcagtaattggtttatggcaggcttggaatgaagcacttcactgctgttctgcttttccctcggaggggatgacaacatccctgtgcctcttgcctgtccttgtggcggccaagatccaattggggaatagatttgtagtgtgtgggggagggcaggagagagggaaaatgattaaatataacagcagaaagtggctggttggactgcaagcccccaaataataagtgtaagcatgcacatgagtgacataaatttttaagggttgattatctgctttcattttctggtggtggagtgcttgcctgggaccctggggtgtggttgctgtgtgcttctctcgcagagtaacactgtaggtaaaggagacagcagcttcataacagcaggcacgaactactgcacaagattggagcctcctcagagccaggaaatgtgtagctgtcactcacgagtctaacttaggggttttgttggtttgtttgttttttttctttttaatatcatatcattttgtaatttggagattaaagaaaaacttcaagtatctctgctttcactgttcttttaaaattaagtgttttaattttgactgaagtactatgttgtttgtgatgactaacgtgatcctcggcaccgccttcctggcagggacactgtcagaaaggcgccttccccacctctggtctggagggctgtagctcccgtctctttcttggaacacctgtttaggttgtctgtgcacgagcttcttattcttacacaaaccagaagcagagttgccggtgggggttctctgtaaggattactggactctacaggggcatggcgagtttaagacctgcctggactacatggtgggttcagagccagcctgggagcttagtgagatccctgttgcaaagaaaaggtaaatgttcttgcaggtagctcagtgggtgtgatgggttttatatccttggaccagggagtggcaccatctgaaggtgtggccttgttgcaataggtgtgacctggtcgtaatgggtgtgtcattgtgggtgtgggtttaagatcctcaccctagttgcctggaagtcagtcttccactagcagcctttgggtgaagacgtagaactctcagctctgcctgtgccatgacagcctggatgctgccatgctcccactttgatgataatgggctgaacctctgaacctgtaagccagccctaattaaatgttgtttttttataagacttgccttggtcatggtgtctgttcacagcagtaaaaccccaacaaagacagtgggtaaaggtttgctaccaaacctgacaacctgtgtttgagctccagaacccacatggttggaaggagtgaatcaggaacctgatggaagcttgataagtgaagagacccattgctggtagttgtaattaatgttcatttgaatctgaatgtgcaagagaaacctcttagctaatggagggatctgtgtcctggcttcctcttccctcgtctctgctgctcagttgtagtgctatatctgatttctctgttttgtgactttgctgtattttttaatattaatttttattaatcctttgtgaatgccatataatgttttttgtttttattatattcattaccccagctcctctcctaacttttctcagatcaagcagtccctttcccgtctccgttgtcttaaatatcccactgaatccagtttgtgttgctcaaatactccagagtgtggagccacacttacgatccctaccaggggccgtacttttaaagaaaatggactctcacagcctggagccaccgactgtcagtgcctcttcatttaggggtaagaccttgtcatccctgcctgctccatgctaaacggttgacggctttgattttgtgcaggtcttgctgctgtgtggtcatgagggcactggtcctccctgacctgtggctaggacggggtctgggtggtggaggagtaatgtagacgccccgtttacagccaagcaccccactggcgtgggctgctgtttgcactttgatcacttgtgcatttctggtactgtctctgatgaggcctgagaattgctctaatctgtgggtgcacagaggtaacttagaagccattggaaggattatagtagcagccttgttgcattaatgatatccttagcaggtccacaccgaccatgaccaaggctctgagcacctggctttttcctttacttcttgtctcccaactattatttctgtcatccatgatttttcttataattttcccctgcccaagatgtagtcaagtctctgtgcttggtgtatggagattctgaaagatgacaaacattgccaagcacagagctgagcatggcccaactgagttccagtctgctcttcctagagatagcttcctttccctctgcactagccttcctcctgctgctgactgcctgcaggctgccttcaactgcccatagctgtctgcggctccaggcactcctaagttctagactcacctcttctccaagagcaacccaggcccgtgccaagcaagcccaggaggattcacggcagcagtcgtccttgggccccaaacatttgcatttggaaagcagatgcaatgaaaactcaaaattggattttagacagattacagtttatctttttcactaataagatctctaaggcgaataatttactccttgagcgctgcctccgggaagcagctacttcctcctctctgccctctgttgctgctctctactcctgaccaccacagctccaggcggttcttctttgtctccaggaggaaggggcgtgaggggggaagcagtgctttctcctgcctnnnnnnnnnnnnnnnnnnnntatctcacaagataacagccacgctttgtgcacaggtctttgttcttcctctttagcccctgctataagctgtctttacctctaactccactctccctacctcagtggagatgttcctgaaaatttggccacatcgtagccatgtcaggaacccatgacagggactcctgccatcatctggatagaactcagggaaggaatgtgttcaggatgtgcaccttggactgactgcaagctacagagaccactgcactcagctttgtcccaggaggacaccatcctgaacaccttcagggtgggttcagggccagcacacaggcagtccttggtgtgcttggctggagtttgaggataaagagaagcactgtcgtgatggaggaagagccttatgctagtttagccccggttctgatgttttctccttggctgctgacacattgggaggctttttccattcagcttcccgagtgctgtgctcctttctgacgttgccacgaggtctaaccctgcagcacatgagctctctcctggcagagagagatgttgtcagcttttgcaacatcatttggtgtagttgacctatcttctttgctttccacttgggcatcttgtttgtgaactgaagtatatgttctcagatcttggtcactgtaactaggaatttggacaaaaataattgatgtcacggtcatcacagtgttctcaaagtatatattacacagactgagaagttcatgatttgaaatgtcagactcctttgctaaaaagccgcagcatggccagtgtggggcctggagcccaggcagttcaccgtgttcatggctgttattccatatgtcacctgagggttctttttcttttccaaatggtttagcccaggctggcctctcacccattgtaatccgactgcctcagttccctaggtgctggtttcaggtggtaatactttgactgagtgccacagattcaaccttaagttacctttcaaaggcaggtttcttgttggctgtgtcctctgggcacttgccctgtgacagtcgtggatcagcccagggatctgtgggtctggtgctatgtaacactgacatcctgcctgtctctgtcctgcaagttagacttcaggtcctccgttctttctctctgctaccataactaatcatttatagacagcagggaaatgagccagcgtctgttatgtgctgtctttattttctcctttaattgtcaagtaatgttaatttgtgggttttaacaaggtactatccatgtcctccagtatggttattttattttggttcactttgatttttctcttttggcttgtgaacttatgagaagagatgaacttggctattgtgtgttcagggtaggaagtattcgctagggacctgatctgtggaagacaactgggctgctgctgcttgacatacagttactgcatagaggcacactggggaaccactggcggctaggagcagagagcagtgtgccatccgacataatgcctgacctgtgataggcacccagctaaaatgtgctagctaacaaggaaaatatcactccagtggctgtgtgtggctctgtctaggtgctgagcagagctgacagtgacatcagtccaggtggccatgtctgcaggtgatggtgcttggacttagtagtagcagttgtggttttgtgcacctctgattctggaagcaaaacacagtttgcttatgagttaggtgtaagagataagaaacaaagagaattagaggtgagggctggcgccatatctcagtggtagagtgcttcccagttagcaggaggctctaggtctagtctcttctacagtgtgaatagagggagaagaagtggtgtgaggagaacttgttgagcaagggagaagggcagagccatcctttgagtggagtagactatagtgctgaagtttgcatggagatgtgtgagcaagagttctgcattagattatggagttctaagcctctttctcaggagactcagatggctctggaagtgtaggaaaatctttgagtcgaccaaagctgccgagtgatcgatgctgaaaaagtgaggccaggacaccgtaaggttctctgtgatgtcagcctagaagtagaagggtggggtggtaagaaaactaattccaaagtacggtggagagcacttcctgagaatacggatggtttgctgatgctcgctgtgacaggccatgggaggtaaggggtgaggagaccgcccaggctgtgggtcctgcagttagcagggccacttcagtgccagattgagagtggaaaatgcgggccaacgatgtccatgaaggatattcagggagtggaggaaggcagggagcttcgggaggtgtagactggggggaaggggctcatttctttgttggtttttaaatctttatttatatgtgcattcttaccacatgtgcctgtgttgatggaataagccagcagagagaagaacatggagatgttgtttgtgagggtggccctcaagttggtgtgagagggaacagtggccaaaatgtgagggaaaagtgtggaaagagcccactggagagagaaagatatctggtgacagagaagctgcctctggaggaaagtgaaaacagcccagacccacataggaggaacaggtacacacacgtgcacattacacacacatggagagcacacccataatgcactggtgcatgccacccgtgcaggcactttctgtgtgcagcagcgctgctgtgcaggtccttgttcatcttagcagagagcgagtaagtgttctccaagactggccatgttaggctgtcctctgaggagtgaggggagcactccctcacctttagctgtcatgtgtccttcagtgaccccatccctgagttcctgtcactcaatagggttttgccaacgacaacggggagcaagtatccagagcttcacaagatcctctgctgggaagctcaggatgaaggctctactggttcacaaagtgtataaccccttgccaaagaaagatggcctctggctgacagggaaggcaaagcctcctaagttactctaggatacaaggtaacacactgtgctcagaggtgactgtgggttcactcagatcatcagaggacaggtgaagatgctgtgagttgtaaaaagatgactccttaaacccagagtgtagacaaggtctatgtaaagacatggcaaggaggagcttgatgtgaagccaggctctttggatagcctgagacagcaagcatgctgtcagcactggtgatcagcacccactgtcccctggacctacagcctagaacaagtcaccagaaacagacttcagatcagcatgctgttatgtcccaatggccatgccttctggcacatgctctgtgttgtggcctccaggaacccccagctctaaccagaagtcatttatgattgtggatgttatgctgtgtatcacatagaagaaattactgtctactgagtgccactgtacagtatgacaaggctggacagtggcacctgaacaccttccttctcaggggatcgtgaccctgagctgtcctccaaaagctggtaagctcatggtggaatgggtgctcagctgccccttagtgtcttcttatgcacacggctgcagaacctcccgtgtttccttctctttagttgttgattcatttcaagtatggttggagtggaatttgcttatcatttctaattaatgtgttcgctgagttgtagaatggtttgagagcatttagaagctgaaactgtcagcagctaagtggctttaaaataatggacagttcattgggggataagctcagaataatggcgagaaactggctgacccaggctctaggagcctgttggagaccatcactgagttgctgtccaccagaagtggcttctgctccttggccaagatttcagagtctcagagcatacagaccaccactcggttaagttgttattgatgattgggtgcctacagttatgtgacttgtgtgttaacttgtagtgtgccccgggagacctctgaactaacgaaacaggtgagtagcatgagctccacccagctccgccctccgatttccacccggcctatgggacgaggcatagctcaccacagagaagggctgccttaaggtacaactgctcagaatgcctcgtcttaagactcctgaacttagggctatctcaccttgttaaaagttgttcctcattgtgtgtgtgaaaggccaggacagtgctgtttcagtggctcatttaaaaacaagacatgtgggtactgccctgaaaagcggactgtgcccttcagagtggcacatgactgggaggtacccggccttgcttaggaactggagcacccccaccccacaatgccacagtcttggtgatggagcatgtgtcttctctggagctggttgcagtgaattgcatctaaagatggttctggtgctgagaaatgccctggcggaggcgagccttccttccttcaggagctgtggtgcttgtcctgatgcccacactagacccggctgcctggtaacgagcttcatatgcacgctgacttctgaaggattattttgattaaagggccaatatcttagatcaaaaattaaaactaaaataatgcatgggataaaactcatgtgtaaatcaattttttaattcctgtattagcggttctgaaagaattcttcattggttaaatcctttgcctcaattttttttttttttttagaaaagcgtcactgagtttaattttccctgaggcagaactatcatatatagtagatgcagctcatgggtggtgggttcacagagtgcatctgaggctcacttattgtctgctcctaaatgtgattgacctgtgcccaatccaggccttcctttgctcttagagcagctccccataagggctctttgtttgtttggttttgttttttgttttttgttttttcgagacagggtttctctgtgtagccctggctgtcctggaattcactctgtagaccaggctggccttgaactcagaaatccgcctgcctctgcctcccgagtgctgggattaaaggcaagggctctttttgaaaagagaaatggagaggtgaatttagactgtaggtcactggccattccttcctacttacagactctcagagactctgatccaaacttcagcactcttcccttgcctctgctgactcctgggtcctacacaggtgcaggggtcattgcctctgctcccccgagccccttttcaccaggctggctgttggcagccagctctcccttctccccaatgcctgtccgtgaggctgtgatctgacgcctctgcaggctccagggctctcacctggtccgacacgagacctggaaaccagttttctttgcacaactgtctctgcctatctatcttggcttacacagccagaacacagaacagtattttacatgtgatcttgacctccttctctctgccaagaggaaactttggtgatattattcaagccgctgaactctgaagtgtgcatttgaaatagttcccatgtggccagggtatagcttagccagagagtgcttgcccagcgtgtgtgtaatagcctgggcttgattccgactaatgcaaaatattaagtatttaacgtgggatagtttatgttttatagaatttatcacttatttctctaaaaactgatgtttttattaagtgaattatatcattttatagttgtatatatgagtgtctgaagtttgactttgggattaacatttctgcagaaggggttattggtaaaatatgcctttaaagcccaccattcgaggacttgaagatgccacagctgtcttgtggacagtaaaatgttaacattgtatgtccaggagtcagcacagctgtgtgggttagacataaaagatgcagagcaggcagcttcaaacctcagtgtcactggtgcctggctagacacaaggctgcctagagcagtgcttctctacctatgggtcccgacccccctaggggtcgagtattggatatcctgcatgtaaggtgtttatgttaccattcgtaagagtagcaaaattacacttacgaagtagcaacagaattttatggttataacaacatgaggaagtgtatcaaagggtcgcagcattagaaaggtttaaaaccactggtctagaagaaatagtgggacaaaaaaagttctaaaaccagtcagagcaggtgggtagctgcatcatctgtagtccatggttgcattgaacccaaagcactcccccctcctcagcctcttgagtgctaagctcacagtcatggtcttcaaagcttgttttctaattgctggagatgttttaaaatggaggtaaaacttacaagaatagtggaggaatggtttgagagtggtcttagcctagggcttttgccccaccaattttcactaaggaaagtaccaaacatgtaccttctgtgccttagagaagccatgcttaaatcagtcaaaacccctttatctcctttatgaaataagaacacattttttgtagattagagaaatcgggtgtacatgtaaaaccattacataacgcaccttactgtgcacacactctgcatccttccttttgtctctgtgatggtagcaggcacactcttcatgaattctacttgaatctgctatctttttagtactgatgatatatgtatccgctcatcttcccatgcctttaaaccccccaaaataatgtcatgatagattagggactgaatgtttagcctaaataagttaacatgaaagggtgcgcagggcgcagtgagtactgttaccaccatgcgtgttgggggcaacagaagaaagctttgtctggggcagaaccagttttgctggtgccatgttgttgttcttgatgcccagtgttccctccgggagtgtctgctaagccgctgtccttctgtgtcctcctgtaggtagctgcgattaacccaaaccatccacttgcccagatgcccttgcctccctcaatgaaaaactgcatccagttggcagcgtgtgaggcacacgagctgctgcccatgatccctgacctcccagccgacctgttcacatcctgcctcaccactcccatcaagattgctctgcgctggtaagtgtcctgtagtccaggtctccatcccagggacccaaggcattatcctggtcacaacagagtgccctgtgttttgatgtcacaggacctaggtgtttgtctgtgtgtattctgagagtggatggggctctttcccttggatctggtcatatgcagtttattgcttgtggcgtccaaggtcacatctttgttcactaaggagaagtagccaggggtagtgcttagactcaccagcaagtacctttcattggggaggagaaaggcaaatatgaaagaagtcactatagttcttgctagaagtgtactctctgagttccttcctagcagtgagactccttcagcactgcagttctctgagtcctggggagcactccaagggaatgtatgtgggtgccagacgcagcctgcctttgagagtgccatggctgctggcatactcagtagtggtatgtgctcagctagcctttagtacccacttggcctttatgctgacgaagagcctgtgtgcagcagcagcctcacgaccatctagaggatgtgggtgagagctatatagctgtgctgacatactgtaccctttgtgagatgcccaccagggtcatgtcagcttgccagttttcagatcctttcccaaactcagagaggtgtagacctcggattgtgaagcagtgagacctttggatttatcattgtccatctgagtttggtgtctgatcactggaaggtttaggcgtgagtacacacagactgcggtgggcctagcagtcactcccatatacactcgatccacttcctggaagcagtgcatgctactccagctggtcctgagtgaggctaagctgaccattacgggcaggtatgagagagagacctcatcttcctgcatagtagagggtgtgtggccttttaaaagaggctctttatgcaagatagagaaaatatgtatacttgaaggtaattcatgaccaagaactgaatagattcatggtaccagaagctgctgtgtttcagggaacagaggtattccaagtgttcctcggagcagctggcagtggaagtggagtgttacatggcagggattgaggggaacagagagtacccagactggcgtacactgccagaccacccagaagaatgagccggtccactccaccaggctgcagagcttcaggggagggagtcaaggccattgggtgggctttgttaggctgtagagtcacgggatgacttcatcacccaggactgagggatagccctgagtgtgcatgtgtgcaattcctggagaatcgtatttaagaacacgatccaggtaatgacgagcgagtgtggcccgtcagtcctcggtaggcatgatcatatctgtagtacaagcagaaagctattgagtgactgtgtgtcagagctgtcagggtactgtggaccctacagagctggctacatgaccacttccacctctgccttggaactccccagcttttcagagtgctttctgaaaagaatgggccagggcaccagctctgttgtgacactgcatatcctgctgcagactagctcccttatgcagttctctaggcaggtgattagatgtgtaaggagggtgagcagaaatagacacaagcacccacagagcctgacactgtgcctggactcacccatgccttccttcctaacacactgccttagtgcctctgccagacctcagtgcgcctgccctgcactgccctgcactgatctccaactccacacgcgcagggcttatgcctgtaggtctgggcagctctaaggactccacaccccgctgccaagcagaggatgggcttgctctacccaaaaagcatgtcattgcttaggtgcctgaaatcctttttggactgaggacataattaagtttaagtaagcattaagcattagtaggaagtacagtaaaaaccaagttgacacaacttccataacatggactttagcaccattgtgccgcacgcagttggggagaatggtcctcattcacatctagtgcccgaatgctgtcagctcagctctagcgggtagatctgtaatctcagggaggtactgcaatgagtctgatagaaaagggaatatattttttcatttggtaattacccatgtttttagaattagggttttttttttcattgtaaagtcagtttcgtacattttaataaaaactgagtatatcttttcagagaattaatgaaaagtacaaaatgagagggagggagtaaccaacatttttatcttcaaagcacatgtcagcttttcccccatcacctcccatcccactctccatgtgttcacaaactagtctggggctttagggcctagcattgtgaagatggtggtcggtgagttcagagttgctctcacagtatcagaagggtcagttcctgagtaatcccagctctgttgtttcagggaccagatgtgacaggtgggtgtggctgggcttcacaaatgttatttacaaaaataagcactggccaggtgtgatcttaagctgtagtgtgccagttactgttgcagaaacatgaaaccaggattaggctgtgaaatgacagtcacattgaggactgtgaatggcctaggaaagaaagctcaggactttccctccctcctttccttaataatactgaaaactactgtcttcattgtatacgggaggttgcttcagaatgcccgtgcttggcaatcggtccagatgcagctgagctctgtgaatacagagtcagccgtgtctgcggccgtgtgtggatggctcttgtttgatgaagaagcacttgtcagaagacattgtgcagatttttttttttcatttttgcctcaggaaatttgcctctttcttattttcaaaactgacttcagtaattcttaagttaacagttgtaatattctctgtaagtaattgccttgcttcccatatatatcagtatagtgtaagcatccaaaatatatatcgttttcctttagctgtttctatttctttgattgagtggcataataccattttaaatttattatgggcatatgtgtgtgctgctggaagctctgactcagaggtattcagtttgctttgagaccagctgtaaaggagattgatgtctgtcgcaccaggcagcatacagttctgctgtctattaatgaaaatgacagcattattttgggttggagtgaggtcaggaactcctcccctttcagttaagccactgagtctctgggagattaagtgctaactgtgcagtgttgaagatgtttgcaggagcggcagctctgctccctccgcccggccccagcaggatggccccaagcgaacatcctgtgtaaggaaggtgtggggcactttgctatcgtgtctcctttctgctactgtggtaacacttgatgttgtctctggaaggctactaggctcagagtcagtaggagttgcttctgtaaatgcaaggttttatcatttatagtattgagccagagtctttgaagctcagcagctttgctagaggacagacctcctgccccacttcagggctaagatcttgtttaggttctgtgatgtctgattaggaacgaccactacaggctcatctgcagttggtggaactgttagggaaggattagaaggtgtggccttgttagaggagaagtatcactgtgggtgggctctggtttcagaagctcaggccggtcccagttagctcacttgaccatgcagttgtggatcaggatatgagctctcagctactgctccagcaccaaagcctgcctgctttcaccatgctccctaccaggcttatagtctccattggccacgggttcccgggttcctgaaaggaaacatggggttttggatgggaaaggctgcgagagaaataacaagccaagacaaaggtctgatcaaggccaatgtttgcttatgagtctgagcttataaagaggggaacccatcccccactacgccaggatctccttgcttagtctgatagtgtcaggaaaacaggttcagcctcttagcaggtagtagtgtcttggtggaaagctgcagatgtggcaggacaatagactccaccctaggtgggctagccggctgtggcaagccaggtctgagccagtctgctcaaggctagaggaagggcacaatgctggtcatggactccagaaacttgaaccccaaattaaagaagttgccttttattatggtcttttggtcacggcaattgagaattaactaagatagagtgcatctttgtatgtgtgcatgcttgtgtatgcattcctgtgtgtgcactcatgtgtgcgtgtaccagaagccctggtgagatccccttggagctggagtgtcaggaggttgtgagcctcctgacatgggtgctggggttgaacttgggtcctctgggaaaacatggtgtcctctctatagtggagccttctctcctacccacttgtttagatttttttgtttgtttgtttatgagggtttttctgtatagccctggctgccctgaactccaggaccaggatggcctccaactcacggagatcagcatgcttctcagagtgctgagagtaatggcatcaaccaccactctcctgtttttgttaagattcagaggggagggagggagagagagagagagagagaagaaattcttacatgccagaggctgagacagaagaattgctgagtttgaggccagcttagttttatgtaacaagaccctgtttcaaaaaagagagaaaaacaaaaccaaaaaccagaagcacaaacgtaggttcttgtctggctcacctgcctaaggctattgtctggctcacctgccttacagagttgtactagtgccctttgatcttagtgctgaagagtctgaccttcggtcttcctgtgaagaattggcttcaccatctgaaaccagctatcttctggtcccatgcagatcccaaactgcacgattttccatgtacctactcaggatgtttctcccctgctcagctacaccctttgtgtcccaggctccattttcattcagttaagatgaaaatcacaccactctcagagaacagcgtgctatggataccctgattttggtcataagaaaaagatgtaaactattgagagtggccttgcctgctgactccccagtgagtctgaatgtcactggagtttagaaaccacactacgagaagctgcagacagagaccttggaggcggcaagtgtagaatagaggcatgggcagtagagataggcaagggcaggctgagggggctttctgactgactacagccatcccctcctttccctggttgattcaactgcttctctgtgtggcgcagaatgaggttggttgatagggaaagcagcattctgggtaaagttactcagaaaacagagctaggagagtgggaagatgaattaccagtgtagagaaaaggaagaggcaagaagacaggtgggtgaagacctctcccaaggaaagcagatatgtcaccatgctagagatgtccagctctgtgatatgaagctgagaatacagatggaggaaggaaggacaaaaaaaaaaagaaaaaaaagaaaagaaaaaaaaagagaggaatagagtctaggaaatgctctcaggtggcagagtgagctgtggcaagagtgggtggcaattgatccttatgggacgaagacataaaggtgcagccctcatgagctgcaagacagaaacataaaggctgagaagacagcggcagacgccagagtccacgcagagcccagggtggcactgagcaagcaaagcaaagtgctttactgtggaaaaggagcaagagggcaggggaggacggcagccgcagcagtatgacctgacacagtcgtaagctgagaggtgccacctacagtcattcatgcagggggagctgagtcaggagcccggtcagaatgctcctgagagaaagttccagccaaggggtggggttaataataggttaattacccaggtccatcgccgcgcacacacaaccatccatgcaacaaagaatccacatttttgagcatgtatgggccatttatcaaataaactatgtctatactgcaaaggagccatctataataagtccagaggatctccctttttgtcttgtgatctccgaccacacatagtagatggaactcagtcatgagaaggcagggtttagaggaatgctgggagagacataccttgtgctaactttctcaacccatgcctgaaaccctagtttaaaaaattaatgtgtaaaaatgacccagaaagaaaaggttggggattaaagaagaaatactttgtttgattggtttttatttagcttgttattgttgttaatattgagacagagcgttgccaacctcaggaacctgcagtcttgccttggcctcctgcatgctgggctacagcaatgtgccatcatgtcctgcaacttgaagtaacaaatgttcaggctgaattcattgaaagcacatgagcagcaagtgcagctcaggctttagtgagaaatggagatagagaaaaggtcagggaagggtgcagccaataacaaaatctcagccaaagttctgagtgcagagctgcttagcaccccatgctgcctccacagtaacgagttagggtttgcagcccgagggagcctgtctcctggacctcgtgctctctgagactctgctctgctgacggtgtcgtagcactgtagcatctcagcctctgagtcatctccggggcccactgtttcttaagtgtaactgaaggaaaagttaagatttgggtaacaatcacagctgtgatttactgagcatcggttgcacaactgcacgcccagcgtgtgcacagtattcccacaagcctgtgaaggctgtgccaacactagctcttacctgcaggctgctcccaagggaactcgtaggcaggattcaggaactagtgcccggactcagagctgacattctgacctccacctgtgctgcttctgtgggtactggtgacaccctccctggtgtctttgataccagtgacaccctccctggtgtctttggtactggtgacaccctccctggtgtctttggtactggtgacaccctccctggtgtctttgataccagtgacaccctccctggtgtctttggtactggtgacaccctccctggtgtcttttgtactggtgacaccctccctggtgtctttgacaccagtgacaccctccctggtgtctttgataccagtgacaccctccctggtgtctttggtactggtgacaccctccctggtgtcttttgtactggtgacaccctccctggtgtctttgataccagtgacaccctccctggtgtctttggtaccggtgacaccctccctggtgtcttttgtactggtgacaccctccctggtgtctttgataccagtgacaccttccctggtgtctttggtaccggtgacaccctccctggtgtctttggtactggtgacaccctccctggtgtctttgctggtgtgttttcctgctgtcattgcggtggtgctttggaaggagccaagacctctgcttgcttaatccataccttcattgagggcgtggggcctgtgtaacatgtgaggcaaacaccatggtcagtggagaaagcctccatctgcaggtgaagaggcagattgctgtagtctactacaatactggaagcctggccaaccagccagaagaaatggagagaagcagtaagagagacattaagatctgggtgcagcacagtccccttgtctcactgtttcaggatgtacatgtcacctgagtgcctgcaagtccaaagccagttcatttctgtccctggcaacactgttctcctcctcagaagccatagacatggcagagagggcattcggagcctttcctatcggaagagaagcaaacaccattcctggcttgggatttagtggttgcgcaggctgagcccccaaacaggaaaggtgcacatcacaccctattcagaccacactggaaggacagacattgtggaaagctggaagaaaaaaccaaagaaacagtaggcagtcatattgccaaacaggaagccaaagtaatatatgtgggagtatggggaagacagggaagcccctgagactgactgccctctacagcagggcaccggaacctcagagaattgaaatcagaattgttttatttttctaactactaccttgtagccattaagattcagaagtacttgggaataaatataacaaatataataaaatgcatgcaaggcctgagctcacaaatctgaattatcacagagattaaagatgaggcagaaaatggctctgtaaagatggaaagacccagctctatgtgtgtgcctttgtgtgagacaggttaacattggaggttaggcaggctttaagttactggcagtgctcagtgcccaagtgtagagattgcagatatgttcttaccatatccagccaaaattcagtattcttaaacgttaattttctccaacttgatctttgctgtcccagtcaaagtcttggctttaaaccttacatagaagcacagagggcatggtgaggacagtttggactcagcgtaaagccattgtcacaagacagtcatgccgtgtacacactgcacaaaggtgcctaaatggtttcatggggaaggactgtttttcaagaattggtggtagaagctgtatatggagaagaaaaaaaaaaaatcaaagacagagactaccttgcacctcacttacgccttacggaacagttaaccctgttcttcctctgagagccagggagagctagaaggctggatgaaatggggtttccacccttacagcaagttattggtaacagctgctgctggaccaagagcagctgcaccactgcacgctgtgaggatgatggtgggtctccattatattaaactcaggaaggctagccagggaccagaggacgcaaaggtaaggcagccgcagctgtgatgggatcaggcgtgcatgcatgtgttcacacacacactctcagatgtgcacatgcacattcatgctcacacactcatacactacacacacacacacacacacacacgcacaagattgtctccagatgcagtaaggggcaatgggatgtcatctgtgtggactgtggggacgacagaagcttaacagtactgctgcaaactgaagtctcaaactggtttattttatcgtatgcaaattgtatctcattaaagttgatttaagtgtttttaaatgtagaatgttgagtgaaaaaataagaaacagtattagatttatagtgcattactttttattaaacacaaatattgtgcagtactagtcatgtaaatgtatgcatatatatctgagtgaagaaacagcatacaggtcacagacctcacgggaccactggagaggactctctggtttgagactttcagtgtccagaactgagagtcagtgcaggtgtgctggtaggacctggaggtgtctttgagctatgtacacacaggagaggacatggacatttcttctggtcacccatgtaggtgaaacagtagacaggaaagtagcagcatttttaaagcccagcgtctttcacatctactcagctctcacaaggcccagtttggggcccagtagtggaagcagcagtagtagcctccaggccgctgcttctgtagggactgcgctgacgcagctttaggacccgtgtcctttgcagtgtgtgctgtttctccagagatgtgtagtgagtgaatgttttatctacagaacaggtgtctttgacttctgactcctgacttgtggtgattttcttttggctcacactcctctcctatgctaatctaaaatggaacacagtgtgcgggtcattctcggtgagcagtgtagtgcaatggagtcctgtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctccctccccacaccccccccccatcctcctgtctggcttcagacaatggcagaacaacttactgtctgcttaggatacaaaccatcatcaccttgtttcaaattagttccggtgcttgttggaaattgtgccgcaaagcagctaaatgatctcatgcttagggaacagtcgctcctgggctgttacctgccggtgtgtatctttaatgtgcttctgctcgtctgacttatgtgcacgtagtgtgcctaggctgacacctgttatcagcgatattgccgagttccattaaagtacattgatgtttgcagctctgtattcagtcatggacacttgtgtcagtgaatagtcaggggtacttttctggtggtggctgtagaagctgcctcatttcctttcacatacactgcattgaggtgcctctcagatgacatctatggcatgccaggactgtgctgtcacataggacctgtgcagatggtggcacagcaccgctccgttgttttttgttttgttttgtttttgttctgaatgtatcctgcagacaatgatcctctgttttcctgacttcttgctattcatactactgatgcccctgttcgtgacacagaacaggcttaaataggcttcaaaagccacttccatgcaccatgtggctagtgccacagtcacactagcccttgcttttgttagcctttgtctccattatccatgaggtaatgtctctgtgttgcaagtagcctgcagagtatgcaaatgataaggatttatgagtccaagtggttgtctgctgggattggggacttaatggagagggacacgcttctatcagtcctttggcaataagcagggagagagcacagtgtcttctctgttggggcttcctgtgatggagagcttgtcctagaaggggcagttggaggagggtgttctgagtagatgttcctatcctggccatgggcctgaagtcaagcttagaggatagagacaacttagtgcagccggacctttgagtgagggcagacatggtccccacaacccaagaaacagggtgcagcccctgagcatgactaaattatatcacacgtatgcccctgtatgttcacctgccatccctacatacaagagaagctgatttatcaataatagaaatgtattgctgtcagtctggaggcaggaagcccaaggtccaggtgctagcagatgttctctgcagtctagagtgttgaaagctagagatgtagtctagggcggatgagcagtgccctcctcgcacagtgtgggaagcatgcggtgggaaccacggctggtgcagtaggctctgccagagcatgagcagcatgtcgggactgaagaggccagacactgtatggctctttaagaagccatgctgctgtgctgttggctcggagcagctgagataagggggcctctgtccacctcaggctcaaaggagactccttgctgggaaagctgaagaggcaaaaagcatcttagcctctgcttcacaggagtgagcaccacgggctgcttgggcatcacacacagttcaaggcaggaaagcactccattaggagcatgttaccctcatccatatgcactctcctggagtaaagaagctaagcaatgagaaagagaaatagggcaaatgaatgaagtgtaaattaaaagctatctccctggcataaggtagcaggggtgggtgtgtggtgcagaccacacattgcgactgccttgtgaggagtcgctttcacgggagggtctgtttgggactcttcctggtcatttggcataagaactgccagagtaggaacaagatgctcgctcctgggctctctagcatttacctcacaatacttacggaccttaaggagcctgctcaagagtacgtccctagatcctaagccctgagccaaagttggtacctatcaccgattgtttttatgtatgtatccatgtgtgtttgtgtgtatgtgtctttgtctgtgtgtccacatgtgtccacatatatctgtgtctgtgagtgttcgtgagtgtgtgtgtctgtatgttttgaaccctgagcttcatgcatggcagaagtgcagtctaccgctcagctacttcagctcaggatcagctaccagcccctgctgctgattcttaagtaaacataaacccttgccttcagtcctccctcttgccctagtcctggatctccccaaggtctagctggtgacgctgtttggctctggagccatccttcctgccctgacccttctatgggctcttggctctcctccaatggtggacatgcagctcccacctgagtcctctcagcatcacttccttctcctgcgtcattgcccccaggccggaatgtcagccaaagactcaccatctcatttctagctgtctcttcactgatgaggagtgagtgcaggagagaaattaattgtgttgggtttcccttatataccaaattaaggccttttgtttaatcgatataattctggttttaaatatctgttatcttcattttatgggttaaaacagctggatatagccaggcggtggtggcgcacacttttaatctcagcacttgggaggcagaggcaggcggatttctgagttcaaggccagcctagtctacagagtgagttccaggacagccagggctacacagagaaaccctgtctggaaaaaacaaacaaaaaacaaaaaagtcaacaacaacaacaacaacaaaaaaacccagctggatatgagaagttagccactgtgtcctccaattggacagtggcaaagctgggatttgaacccaggactctctggactttcaggactggtcatcatcattactctgctgtaataatttcatctttgcacttggtaacacgccattcctagtagcagaaccctctagcatggtgttatcaggcacagaggatctgtcacagatctctactgtcagagactgtggcattttgagctgtatggggatgaggttacctggctgaaactgggccctattcatggctcctgctgttgcagcttcaccacagtttgtcaccagcacccctcagggggactgctggaggcactttaggtaagaggtgctgcagtccggtctgacttctgcatctctagcaccaggctttagtatgtgtgcttgtggggagcagtatattctgtgagtgcatggagaggcaggcctttcatgggtcgcttttgctttcttacttccatgcctgttgttagcctggaagcttgttggaaagcacctccctttattttgatttatgcctatgcctccctccaaggtaagccaatggggcctctatacactgaggactgatcagaccactaactactactggccagagttggaaccgaacacttagtgctgtggcctctgacaactgggttctgctgtgtggtaggaacttgtgcctttagaattccattgtgcagccgagctctcctcaggctgcccctggtggccagggaaggtagccttccctgcacgatgctgccttgctgtgtatccttccttgcttgtccacctctcctgtgaagggacactgatggtggtctgttagaaggaaccgatgttggtctggctctgggagtctgagtggtctctggtccatttttccccttgggtgagtcagtttctctgcagccctgtaaggatggtgctctcttcccagcagtagaggcagtgcagctgccctggaagtactgtggaagggggctgtgaggtctgtgtcggccagtatgtattaatagtgcaacacactgtaatttacaagggacttcccacatggcttcacatgcacctttgctagtaaccaggaccagtcaaagcagccataactcagggcacatgactgtgtgattgactggggaccaggtgcttaatatgcccagtgttgtagcctgacttatagctgagttcacagcagtccttgacacatgctcataccaaaagtacacattcactcggactccatcagctccttacacgttcattcagaggttcctttgctcccgcaggcttattcctcatcacctgttttcctggcctctgtttctgcttaaggcccctagtttacgtctcaggttccttaagactgcagcagatcacagagaaggtgctctcttcccactgagcctggctccttcctctgcattgtgcacctgagtgccgccagcaaccatggggctatgtgagagagggcagcagcatgcgcgcgcacacatacacacacacacccgaacacaggcacgcactcacacatgcacacacacaccatcaggtaggctccagaagagccttcctttccttccattactgtgtgatattctaatagtgagcggtagggaggaacctctgaaaggaatgagctcagtccctgctattgtctcatggtgtctgtctgtctgtttttccattgtgcagcagagctctcctcaggctgcccctggtgcccacacactacataattcacgtaagcagaatccatacatgttttgaattgtgcttccaggttaaagacagccacttgctattatcacccagccctttattttcaggtttaatattctatccagtgtttctgggggacaaagcccttgtgctgcttctctgagcacagcgcctctccttgttctggacacactcacatgagactagcatgccagagagtggagctcctgacctctgctgttctgaaactgggaagtgagaccgctccatacttatcacacatacaaacgtgtcattttcagcacccccagccttaccttcaaggagaaacagtcccactgcagactgtgataagcagactgtgggctgtgcatgatctgagagttttgtggcctacagtgtgtaaatcgctgtgagaaaggtctgtccttccctaccagtgtgctcaccttcttccagaagcctcaggcacttagtggaggagtacacctgatgctgaagccacggaccaggaacacagcagaggaaccctggcagcctctccgcctgctggaggtggacaagactgtgtaccgcacatgctgcacaactgaatctgcatttaagtttaattggaaactagtctgaccctgcctacttcaagaacatcaggaattggttgctttgtcacagcacttccccacctcccatcccaggactgtttctgctgctgatgataaaagtgagcataaccgcccatgaagagcgcagacctctgtccactgcctacccagccatggctgaagttctcacttgctcaaggaagcttgttctctgataagttccccttgcctctagctggactttcctacagaatcctagacctagtcatgactatcatcatgtccatctgcttttgttaggacagtgtgcttacggccgtgaaacagccagagtgtctggtacctgtcaactgtatggtccattgagaagatgatgttagtgtcagatgtgtcctggaatgggcaggagaggaatgtgtataaagtcagagatggggtcttacctgggccccctcacttagccgtttgctcggttctatagttcctctgagcattgacattctctgctagagtaacaatgacagatgtaaactgccagtcacaaatggcaggccggcaggccagcttctgtactcccaacctaaaggcaccgttgtggaggacactaggatacgccttcatgtagaagacttaggcatagacaccttaagaacggaagatataaacagggtcccttcggggctagaagactccaatgcagactgagaactgacatctgtggttgccctgagctggtggagaagctggcaggtggagaatggatgtttgcttcttgttttagtttatttttaattgagaaatgttttcattaattaactttgaattggcaagtaagaacactgctttgtctttggtcatacatcttgggtcccaccttttgcctctcctctaacacagatcatcttcctctgcttggtttaaatcagattgaactttttcagaaagggccctgcttatagatgggttcatgtgcttgcatgagccaggacctcagcattgtccggcttgttctacacttctggatcctcctatcccaagttctgagcttgatgattctgagacacgcgcacacacacacacacacactctctctctctcacactctccctctcccacactctctccctctccctctccctctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccctctccctctccctctccctctccctctcagaagaggaacgcagaacagctgagaaaaacacttggtgttttctgggagactcgtgtgaagtctatcccaagatggaaatgtgagattagcttagctatgagtggatgaagacttggacagcccacctgactgtcccagcctcagcactcaggattttccttgtagacatcgcccataacattagcagaggaagggagagcatctgtctgcatctcctgccctgatctctgcaagtgcggcccttgctttgtgtgggggagggagtgcatggtccccagcctgcttgcaagtcatcccagccagtttcttttctcactgtactttggatgagagtcaggccttggctttggaccactagtcgtgtggcagtttcagagtgacatcatctcagcccctgtatgagggagcccctcatgccatgctgctcagcagacacaaggccagtctgactctggtccaggcttctcttggctgccactgagtggtaagtggtgtgagcatgtgctgcttggtgcccgctgtctggtttgtccatgtgatctccagccttctgattatgacagtcctagaagaactttgagccatcttaactcagaagagcagatcagatggcaaaaagaaagtgatggactgatcacagcaaattatgttctgagtacttggttctttgggatttaaaagaatcatttttttaaacaagttttagggcccatctgaaactttttccataaagccaccctccctcctagtcagaggtagatgatggcacacccgtctctataaataccaagtgcactatgggatctgggcctgtctgctgtgtcccatcagtgtgcagtcaagagcattgccctaactgaggcgctgtgaggggcagagttccgcagacttctgctcctctgactgtgggtccttcctacacttcctagtctgtgtccacgcacagtgtacacatgctgcatgggacttgctcaccaggtgtaagtcagactgaagagtgaggagcctgaagccgtcacagactcgggggcagttctgccctgccatatcggatcctgtcacgtgggagtgtaccatgaggcgagatgtgttctgcctgtgcgttcaaagtttcctccaagaagaaggtgctttcataggaaggagggttggtttcttccaagacagtagctcttggtagccccagggaaacggcagggaggcaaaggatacacctttgatagtttgcacccttatgatagcactgaaagattttcctcccatcagctgcctgttttgactgtctttttttttaaattgggggacagattttagccatttgaaacagtgtgagagaaagcctgtgacagacagtatggagtctcggaagttgcacccctgctgcttgctccttctcagtctctggctggggctctggcccaggacggagaggtctatgcaggtcagaggagtggctcatctctgtcttctggcttacttgattgtgcagcagagagagcacctgagatagcaagttcttgtgtctaatcctagctgcaggcctagctgtggccaatgggaagccattctgtaaagtcaaaagtaacaggaaaggtttgtgaattagcatcaagggaaaaataagaacagtttaaagatcttacatggtgggtccttggtgacagggtcttactctccaccccaaactgtactcactatgttacctaggctggtattgagctgtcagcctagcttcctgaaagcttgggttacaggagtaatcccctctatccagctggttggcagtgtgtatttgtttatttactgtgtattggtgttttgcctacaaatatgtctagtgcaccacttgcatgcctagtgtccctggatccctgggacttgtaattactgatggttgtaagctaacatgtggatgttgggagtcgaaccctcagcctctggaagaggagcacgttctcttagccatctctccagccaggttttatttttgagtctgtgattaggcgctcagtgtgtgggtccaagacacagctctgctttgccaccctcagcagccttccctgtgacttttaggggacttaggccagtctgaaatttgtagctttgatgctgggaagaatttcaggaccagctagaacaatgatgtagagctggaagttacactaaagacattttaatgtgatcttaagtctgagggtttggagaaaacgaaacacttaagggagaaagaccatacctaagagtgtggctttgagcctctgagaaaataaggcatacccaagttcggctgagctctttaaggaggtgcagatgactaatattggctacacataccagttaagtctctgaggttgctaaggaacctttggtgtcttttgtctagtatttgatatgtgtgactgctctagtaatgccttgaatgggattataatggcggggtgagatctggagccactgggtctgcacaaggtgcttagctcgtgttctttcctcatcatgaggcttctagtgagacttctagcaaatgtcaggtttgcagctggaaggggacttgcctcagcaactgtccaaggtgctggagttcctgctgcactgctgatgagtagtttcaactggacctagagtgagggctccttcccctgctcatgtcccccagatttccctacctttccattttgccccgttttatgaccgcttttctgtaaatggaacagaagagagggttttataggcagaggagagctgcagagagcagaaacaaaaaaacaaaaatgagtcagagttccttgtgaggcaggaaatagaaaaaggattggttagcctcaggtcacctctgctgtaaggattaaagcaggctggaacctgattgttggtggcaggctgcagctggcctgctgtgggaagtgatgtttcctcctgctggttcctagaaggctgggtaaacagctcaggttctgactgttgagcaaggctccattttttgatgcttagcctggtttgggtagctacttggttcaaagcagtggctcccagtaaagctgccacagaggagtcctctcagctggtctctgtgccatccccctacatttgggcttcagcagacttttttttagtttgcatttgtttttctttagaagacaacacatctcacagagcttcctcatcaaagcatttctctatccctttcacctctgccctctgactccagagtcatccacagctgtgttccctatggttcttgatggccacccatctgaagctcagccagtcatctgaagctctatatgccctagaacacttctgccttcacacttatgtggtagtttggctgggtataaaatgcgggttctgagttttctcctgcttaatctgcttatttctttgaaagtggtggttctgaaagcttcctgtttgggtttttgttgttgttgatgatgatgttgatgatgattttgtttgtttgtttgttcattttgtctttgtatgatttagttgttgttgaaactgaccttgctatgctgtccaagctggctttgaattcttggcttacaatctccctgcctcaacctcccagatggcagtcaggagcttcactctgtgttcctcacttacaggtgtcctccatttgtagaacaggcatgcctcttatttcatgctaagaaataaaccctcacctgagacagggcaacaaccagcacacagagagcagggagcagctttcaactatttggttatttcgttttatctaatattttccataggctttcactttgtgtttattttgtttaatattttctacaggcttttgctgtgtaacccatacaggcctggagcttgcaatgacccttctgtctgggctcctaaggctctggtttacaggtgtgagccactgtacctggccagttgtaatgggttatttgagtctttgttttttgttatttgtttgtttgtttgtttgttttaaggcagtgtttctgcatagccctggctgtcctggaatttgttatgcaaaatgggctggcctgtaactcacagagatctgcctgcctccgactcctaggccattgtgcctagcgctgaggcgtttcgtttcttcagtgtctgcctagtcctttgccttcattgtccggaaacaccctcacccagtgtagaaggaaaaaggtgtgccaggtgaggcagctattatttctggagaactgatactgttggtgaaggaactttgtgggttcagtgctgacttaagcatgcttctagtgacccatagcctcattagagttgcccaatggccgtcctttaattccatgtctatgagaactgtgccttttcactattctaaaaatgctaatctcacagtcagtaggcaaattcgttttttataaccgtaaagtgtctctcacttccagagtctgtttcggtatttcctctggcttctaacactgtgccattcattctggaagaaccaatgcaaagcactgcagaggccactcacttgggatgggtgggcggcgtgatgggtaagctcggttgtgggacttgacctcattggctttgttccttgctccagagtcactcttgatcctggaatagggtttgtgtgactaaggcagcacccctctggagcccactgagagccctgggctttatggggccttgctctgctttcttggcgcaagagacactgcattctccaattaatagtttcagcctcacgttgccacagggatcctcagagtcacatcctgcctgtagttggtgagtcagccagcgtgagaggaaggtttggctccctgcagtctaaggttatttcttgcaatttcctggcagccttcagtgctgatctctgatctccaccccagggagacttcagctacaggccccatatgttgtttgaatgtgtagcccaacaggttgtaggccttccagtttctcgtctgtttgctttttggaattaccaagtgatcatttttaatatttttgtctggagtttattattgctattggcaagagaattagtccattacaaatgattctgtcattactggactccagacatcccagtcaataaatccattatggatgagaagaaaaaataatgaggactgtggctcacattaaattcacccaaaatgtgtctcctgttggtcatgcttaaccagcaggagagcttgatttgggcaaagacacctttggagcagtgtgtgtctgtgctgactccaaggatatgccttgagggtaccgagcagagctctctgaaggccagcagaaggatatagttcagagcctagtcacccatttgaccacattcaaccattccaggtccttagtgctgtaaaggggctgtccccactgtcagggaagtgtgaccctcagcttcatttgctttgctctgtgaaccacagaacactggctgtggcaacttactctatagctaactttcccctactgcctgagctgagctttctttcttgagacagagaacatggctaggcagttggagccccttatccatctacatactgtctgtatagtatcttggtgtcttcctgttcctgtgtcttttacttttctgccccctatcccaccgctgactctgtcctccaagcctacccactcataacggtttttatccttctctctcagttgtgtcatgatgttgtactaaacacagtgtctctatggacatgcagtttaaaagtgtcctggggaccccattgtaaggggcagccatctgaactggagaacacacaagctccagactgccttagcttagccccaggctgagagagactggtagagagagcaccattagttttactggcaacgtgggctggctaagagctgccactcaccgttgcctgtatcgcagatgtgtggaccatcgacagtgtcagttgtgggcaaatctctgcagaatgccttggaaactgtgaatggagtcatcctaggttcggagctgacttgtggaggtgtcctgctgcagcttctgacttgtgagaggcgtcctgctgcagcttctgacttgtgagaggcgtcctgctgcagcttctgacttgtgagaggtgtcctgctgcagcttctgacttgtgagaggtgtcctgctgcagcttctgacttgtgagaggtgtcctgctgcagcttctgacttgtgagaggcgtcctgctgcagcttctgacttgtgagaggcgtcctgctgcagcttctgacttgtgagaggcgtcctgctgcagcttctgacttgtgagaggtgtcctgctgcagcttctgacttgtgagaggcgtcctgctgcagcttctgacttgtgagaggcgtcctgctgcagcttctgacttgtgagaggtgtcctgctgcagcttctgacttgtgagaggtgtcctgctgcagcttctgacttgtgagaggcgtcctgctgcagcttctgacttgtgagaggtgtcctgctgcagcttctgaaagaggctactgctcttaattttaaacacagacagttcaagcattttatatttctcccactaaaaacccctagctacttttccctcagtgcttccattgatcctgttctgcagtgtgccaatggctctaacaggaggaaaaaaagatggcttcctgccttctgtcaacacacacaaattagataaagccctgacatttctgttctggcttttgaggttggatctgtccacagatgagaagtctttcatctctggctcctttgacttgggatggttaaagcggtataattgaatctgtgtttcttcatcttcttgaagtggtatttgtgtaccttacaggcaggcatccactccacagcactagtcctccttcctcattttttttttcattatattacttacctacatttcagtcgttaaccccaccccacccccagttttccctcctacagttcctcatcccagaggaagagaggcagagtggggagcccctctcactacagcagttcttaaccggagtgttgctttgaggctcagctctgtgttaatctcaaggacaaggctccattgacttctcgtagtcccttcctcctcttcctggctctgcgctactccacagtcatacagccttggcagggacagtgaggagtgcttcttaaccctgatgctgcaggaccaaggaagcagtgacgtgtctgtgggccccttccccactcttagttcctgttttcagcgctgatgttctcatgtttagtgctctgctcatgcctctcgtggtctctcctgtctctgcaggttttgcatgcagaagtgcgtgagtctggtgcctggagtcacactggatttgatagaaaagtaagtaagctctgggccggtgctctcctggatctggatctgcatcctcagaccctcccaggcgtgggttctctctttcctggggtctgtctctttgttctctgatggaggctctgcttgtgatggttacacaagtgctcgctgttagaggaatggatgtgaggcagtgttggaagagaaatggtaagaagctcaggtcctttgaatgtttaaaatgctgcagactacgctgatgctgaccgagcacagctgcctgctgggcccatctgagactctgaccgaatctccttcgacttaggccctccatgtctgtagccttttgcctccagccatgttactgcctgggtcagacgcattctcgaagcagagtcagggtgtaagcagcgtcagagccccagtccctctcgctccgagcctgctgaggtcactgagaagtctgtccctctcctgttctgaaatagtatctcctgactaaacttggcctgcatttgattccacactgacttgtgtcagaagtatggaaaaacgcagtgatgagggcgtggggtgagactccatatctcccaggttacttgccagataattgttttccaggttgtgatacatgtggtacatgcgaaatgtccaagacctgagtttattaaagaagtaagaaaagcgaacctgccccatgcatctccctagaaaagagccctccctgtgtgttaggaaccaactgaaagcctgtgccaggagcagtgcatttttttgctacatgctcacagtgcagcctgcaggaagagtgcagagctgcacatacatttatggcacccacaccagtgtaagtgaaaaatacacactatgacttattttccattgttgcaaactctgaatataaatgcataaagaagcataaggccctaggattgagggcaggattggggcacacttaatgtctataaatgccctgagtttgattccccagcattgcctaataagtttcagctatatagcaaggaggggcttaaaacaggcaaaggaacaacagcatcaagagattatgacttctctgtgtgcgtgtgcgtgtgtgtgtgtgtgtgtttctgagtgtatacacatgacagaaacttgctatatattacagaaatgtagcatgtaaaatgcatcaatagctcagtctaagagtcatcagaatgtagtgaggacattatagaccatttgatgctagtgtttccttttggactttgaatcactggctaagctccacggttctttcagtcacaaacagggtggatagcatggaaaagtagagactcatcagtgggtggtggctgggcacatggaaggctcagtaattcctctctttgccaagcagggctgtgtcttatccatggttcagaagccacagcatgatccaaagcaggatgggagctggtggacagtggagctgggcaggcgatgcttcagaactaactgttggggaaacgacatcgttttttaaaacaaaaagaaaattgaaacctacagaatattcagaggatgttacatgagtatcagaagtgctatcagcaagaaaagagaagatctctcacacaccagagagctaaatttaagacttggcaacatgggctggaggaagcactggaactaaagggacagaattttataggtcaagataagagacatagagagaggagagcaagaaagaaaagagggagggcaataaaaagaggaggaagccaagatggaacaaaaccccaaatagcaaagggtctcatagctggggaataagtcagtagagtgctggatctgcccagtataatagacacatagcttatcattataataactgaattgtgtggtttttatacagacttattggggttaaaaattcctacaagacacacacacaccacaggtagttgcagaaaccagtcttcaagagtcacattctgaaaaagacagacctatcggataggagaacagattcgtcaagtcaggactgtggtgagtgacctgagggaccagtaagaaggaaatgttctacctgcagccccacagatagacagcttgtatgttaaagccatagagctcacaccaaagtaagtcattttgttatgtaacgggggaaaaaatgaagttaccctaaatgtggaggcaggaagcaagccctaagggtgctggccagaatcactggggatagcagaggcagcatgtgctgtcaacaagccctgggaaactgagggcctaagatgaggagtggtttcttctgcttcatgggcaagtagtttttccttcattattagaactagccagtgaggactgacaaattatagtgggcatccttctgccctggcagaaaagaccagcaccgcatcaagcattgctttccctgatggaccccagcctctgctgcatgcctttcttcctttcctaccctgtcctaccactactgtcttcccagcgggcaagaccagccctttggtgcctggaggtgaattcacacagtcctctttgctccttcttctgtgacaagtggtaatccagagttgggctaaaacactaagtgtgaatttttaaagtttattttaggtgtgcttctttcatgcatatgtgtgcaccacatgtgtgcctagtgctagtgctggcggagtctagaaaatggtgtcatatcccttggaacataagtcacaggcagttcggagttcctatgtgggtacggggaacagaacccaggtcctttgtaagagcagcaagtgctcttaaccactgagccatctctccagtggtcaatttttatttatttgttttttaagttaaagaaaattaatgtattgtcatgagggtagtcgggtttcaaaatccacctagcagagaggagctgtggtgagagaacatgggcatttgtgggttcccccttcctcggaggtcatcagtcagcagcccaaagggtgagggggtagagcagggttcggacagcgtgtacagtggagtaacttctggatcagcttcagtgagacagctcaactttattcgggtaaacaagggctatatagatcttggggagtgggtagggatttccacggtgaggacattattggctagggtggaggtgctgggaatgctgcatttacatgaagagggtcttcttatcaggaatgaggaagttgaacctgtaatctggctatagactatgtggtgactttcctcagagattaggaagggatgattggtcataacacagtacctaactgtcatatggcaggaagggctgaggcggacttatgtgcagtgcttgcaggaagctttatgcagggtcatcctctagataagatcaggcagagaagaggaaggtcctctaagaaaaggagtcctccattttgcaggctgagagggctatctgcacattgtgaccttgatagcagggtcttcagcagacatgcaatgctgagtccacgcgcctggtgactccagctccagttgggaagtttaaagcagagctgggaagacgcatggaagacagagcggacccagcacgccagtctccagtgtacttatgtttaaggtgttgatgggaatctgagccgtggagagcagtccatttcagttgaaacaggcacagatcaacatttgctgttcaaaagaccctgttgctgctattctttgtggcttggcaaaggtttaagttgaatgtgaatgggtgaatcttatttatgtcaagacaaattccaaacttgacaaacagtcctggacgccaccagccacagccactagatcaagttctgaagtgatatgtatttttttcacctttgcagtttgctagagggatgttgccatttaaagaaaaagttatagaattttcccaattgtcccgtaagaaggtttggtttcagagtaggaagcgaacagcaggtccctctgatgattggtcctgtctgccctcttttcatccactctgttattacctggatgtctcctcaaaatgtccccattttggtgtccataaatcccatggcttgcagcctgctgggattgttcctggaggagtctgcgctgcctacctggtgtctccatatgctgcatgtggagtgccgtggggacactgatcggcagcgtgaacctctgcctccgtgcagtcggccttgccgggaggctggtgtcaagatgtagctcaagagcacttgtgctgaggttgcagatatgtggggcagtttacagtaacccagctctgttctgtgtcgtcactgcccaccatagccagcggtgtctctgcagtgcctgtgcttttgtggcagtgtacctctgcaacgtccactccaccctccctggtccgcagccagcggaccacttcatgccagtgatgtgcatttgtattctgccaagtttttacagaacagaagctttgacccagctttccaccaccacagccttagctaccctcactaccatgatgagaggcttcaaagcagagctgtctcttccccagcagggtgtggacagaaccagttttgtttttgttaactcatgtacaggctcacatctgtgttaggccatgtggggtttctgacatacagtatcacagcacttgcccagctggcacagacaaagccctgggctctttactacaacacatgcacacacagtgccaacggagcaggagagagaaataggagaggggttttttttagcttaccattctgcacctccaaggtcatggagcactctctaatgaggtccctggaagagtcccaaggctgtgcatatagcatgttaagacaggggacaagtgtgtgtatggtgattatgtcccctttaaagtccctggaagtcaactgtagggttccacacactgacctcattgactcctagtcccctccagctgtcccttggcctgtgcaccacattggacttcgcagtgtgggctaatgtcaacctttgaaactttggggacacactcaaagcatatccaaaccatagaccatcatgtctttaggatttggaagactagaggaaatgtagcacagagtggagggacatcacagccctgaggcctcagacatgttgtgactgaattgctctcctgcccctgaagatgcagtgctcagagttgagagtctccatgcaattgttttggatccccatgtgcagtcgcccttgcttcatgcatctgtgcacagctgtgcaggcaaagcattaggacttggctgaggatgagtctctccagcaccccaattgcatactagtcacaagcatgcccctgcgacattccctggcacgggagcctacggatacttttctggaagtaggacccgggagccaagttcttttatcccaatgctgatgctctgctgtgcttggagtgttcgctagactgtcagtccacatcccttgccaagcacacaggaaggacaggcttctacatttcattatactatgccagctgagccaagtcacacccagagccccagaactcttaaaaagccttgtaatagtcttatctctttaagaatttcgctgcagtggtgtggtcatagaatagttgcttgttgctctgctgcatggtcagcacttaaactgcttcaggtgtgattgggtgtctaggactgcctgtctccttggagccctcatgccctgggtctgagcagtagattagtctgtgcagtatacccaaggatacatatttaccccagctgccttcctggctgtgctcaaaaccccaaggagcaaaagccctgcctctccatccaggaagcatgagtgttctcttaaaaaatgtatcaaagctgatggttcaagaaccatggaatatttcaaaatatataaatttttgaataggtgagagatttttaataaaaacatttgcacaatattgacaaaagctgtcaggggagttgctgggtgaggtttgtgtaattggctgggtgacatacatggtcacatgaccctgctcactgtggttagtacactttcccagagaggtggcactcttgagttctccagatctcatttgcattacagttgacaggggatccatcatcattttgactccagggcctgcatgaattcctgggtgactatggtgcggactctacccctgtgtcttctccaggtacaatgtggccttcacgtagagatcatgaaaaccttcccgtgcattcctgactgtgctggccttggatccagattgattgggaggacggcctgtctcattacggttatcagagcgaacggcaacgggctgtttgttcagtcctttggtttcagtccatttgctctgtagctgctcattattctgagcagaatcctgagctctgcacattagtgagagagaggctgaggagggaagccctaagcgtcagcaccccgaggcctgactgagccctgggataagtgggaacagggaaccttgtagcagcacatcatcacaacattagcctggccttggttaatctgctattgatttttctggctttctaaggattctgaaaattcatttgcatacatctcaccacatggggtgtcctttctgttaaaaacacctgtgtcacactaggggcatgactggttctggtccacctggccactgtggcaagttgctctgcacagatgggctgagaataggcctctggatgcatgcttttccttatcccagaggggaatggccgtctccccggggcgcctctccctggagcccaccgtaggcagatgcataaggtctgcacatgtgtcctctgcccatgtgccctgcataccactcagactttctcaccaaccatctgtgttgtgcccagggctccagggcctgaatgtttctagatgagagccttggctgtcatggcggcatctcgctgagccttgaactgtggcccctgagaactgtagcaacaactgcacataaaagtcccggaggctccacaggctacttctgtgctcttagaaaactagcttcttctttcagttttgatgttgggggtggaagccaggaccgcaagtatacaaacaggagtgatggcaataaccttctagagctcacctgtggccacctgggttttttctccaccttcataacaattggatgtgacaacacctcttccgctctgtcagaaatccaccctgaagttgtgttgtttctgtttttgccatcactggggaaggcattgagttccacactgcagacctgccaggtggagatggtggagacctggggtccatttccagaggttgcctgtcttagtcagggtttctattcctgcacaaaacattataactaagaaacaagttggagaggaaagggtttgttcatcttatacttcaacattgctgatcatcactaaaggaagtcaggacaggaactcacacagggcaggaacttggaggcaggagatgatacagaggccatggatgtgtgctgcttactggcttgcttcccctggcttgctcggcctgctctcttattgaacccagggctaccagtccagggatggcaccatccacaaggggccgttcccccttaatcactaattgagaaaatgccttacagctggatctcatggaggcatttcctcaagggaggctcctttctctgtgataactccagcttgtgtcaacttgatacacaaaaccagccagtacattgccttattactgtgctccaaacattgttcctcaggatcccagggtggctgcactgtagccttagcagttacctgcagattccacaaggcccataagagtgttccaccaactttagtggccttaaagctaaggcatgttttcagctaagctgccgtgtctggaaggaaggaagagtgaacctgtttgagccccctccactgcttctaattatctgtgttcacctattgcctgatgaataagcctgatggtgctgcagcgcatatttatattccgaatcctttgagagaatggcaataagatccatgcttgcaaattaagggacatttttcagccctgaaacaaagtaatgaaacgcttaaacagtgctagaaatattagggttctcagaaagctccagggatcccacggatgctgaacctgatcccgggaggctgttagttagtattctgatcactagaggcacagagtgtacaaaaattattcatgattaacatcgattgtgtaaacacatcctaaagagcagcggctgtgtctggagcagccagctgccgttgtgcccctcctgctgcttcaaaggcttcagggccacttacccttcaggtgcccactgcctcgagctgggcagcctccaggtgtccactgccccaagctgggcagcctccaggtgcccactgccccgaggtgggcttggttctgggtttgaaactgcttggtttttttaatagcctttcaagataacatttgcagatgtgtccaaataagggctttctgtatatctcctttctaaagggacctgtgaaggtaagtattgtcatctacctttgaagagctagggaaatgaaaatgcagggtgggtgagtcatctgagtgggtcactagaacaggcagcacactgcagtgagatctcatctgagtcatgctgtgcctttccctcggataccctcactcaggaaggtattaggccttctctgtcacaggcatagggaccatggttgtaaatcactttgctgtccagatagagaaacaatgtagactagtttttatattaatcattaaaaaataaaggcttggtttttaaagtatgcttctttccagttcaactgtaatagctgtttgtggtttaaaaaaaaaaagtatgcacagatcagcaatccctccctccaagaaatcaacagttgatcaacatgctcaggccatcatcttactctggtgatgactcactgatagcagtgtagggtggactaaatggaacagatgcccagggcctgagcagtgcagaagaagccaggagctagagggagtgttgggacacaaaaatacggaaggccggatctctgcttgccacctagaggctttccccacccagtttcctgtgtcttcacctcacctccaagtgggtcattcctgcccaggcaaccttacacaagtcctgtaaaggcagaggacaggtgaaaggtgccagtctccccagtgcttgacacaccactcctgcaaggagtgccatccatgttttgttctcatgcacactgcagagactcggcactgagtgatgtcacagctgaggactggaaaaaggatggggggtgggggtggggggacctgcacacagcaggaattgcttccatttccttcacagtggcatcaaaacaaaggtctgcaggccccagcatggtgcatatcagcctctctcaatggcacaggcttcatttctacccagctcaggggtttggtcctaaggaaccaagtgtgttgtgagaggcagaatgcagtgcctcctcaacgaatacagctgcctggcagagcacagtaggacacagtgaagcagagtgtgtgcctcacccagaacccttggccagccttcctggtgacagcttctatttaataagagttagctccggagcatagctgtttcctgtcactgcagtcaccttgctgggaaaactagtcccttctcaactcttgcctggacctgttacatacactatatatacactatatatacactacacatcactattgtctgtatgtggtgctgttaccctccagagctagcattcattaacattaaccacacactcataccttctgatgaccctcgttctttcctgaacctcagagctcccatctgagctctttttttttttttttagcctttcctgcggatctggggtgaaaacaggtctcctgtttgaaatgccatggttgccctgtttttgttttcatggtgttagagcagcattatcaggagacagtaaacctcaagttaactgatttgataaggttcagcgggtatatggtctcctggaaccaccgctccccacccccacagggcagggctgcagtgttcttacttcacccaccccactaaccctccagacccccaagcccaggccattttggatctgcctttccatatactagagttgctttttcagaatttcatggacgtagagctcttgtgtgtgcgggtttgatcaacgtagcctttcagcttcacccaggcttggcttggcgcattgatgctttgttcttttactgcaagtcacatcctattctttgttgatttgcttcacctgctgtgaagcactgcttgtttcactacagccagtcacatggagaaatggggtttgtttcacctgggtatacctggggggtggggggctggctgggcgtgtggtaggtgtgcatttaattcctacctgttctttatcatggtggactatccttgcaggcgtgtgaatgtgctacggccctcagtctgtgttcactttcagtgtcctgcaattttagggtcagcagttccagaggacatttgagcttaaatccactgtatgccaggacgtccttgtgtctcactgctgttaatttatgttctttcctaaaaatggggtgtgttcggtaccatgccagtccttaaattgtgtttgtcttcgggggtgctgtatcttggacgttagcagtcagagctatgtctgtaccttgtgcttttgtctgacatagctttttcttctgttgtgattctgggtcccacacaaaacatctacccaactctcccaggactgttgacttttttttttcctaaaagttgtgcagttttaatttttgttcagttttatgccccatcttaggttattttttgtatattctatgcaacactgcttaaagttctctctcgtcctgtcatcatctcagctgtagaatggacagaaagtcatatttgctccctggtcacatgacaccttggataggaggtttatggaggtaaaactcctctcttctctactgatctgtgtttctgcccttctgcctgtaccactatgtggaccaagataactgaattataaggcttgtttgttgaagcttcaagtatttcataaaattttagcatttaatttatttattattatatttaaatacactgtagctgtcttcagacacaccagaagagggcatcaggtcttattacagatggtgtgagccaccatgtggttgctgggatttgaactcagaacctctggaagggcagtcagtgctcttaaccactgaaccatctctccagccctcatgtcagggtttttaattgtatgttcgcatatagaaatgtgatgcattttgtagagtggccttgtttcctctgaactcactaaacttacttccggattctggtcgttgtattgcaaattccttagatctgtgtttataattatgccctctgcaaatgcatacggttttccaatgtttgcatctcttgtttctttttcttactctattgaactaacacctctggtacagtgttaaatgtaaaccatgaagctgggcagtcagcctctgccgtcgcggatcagtggagggaaagacatcctgtgttttgttgttaggcatagcgtgacctgtgagtgtttcatggctagccaacaccaggtagggagttccctcgttttcactgattggtgctgaaacttgttgtataactctccctgcatctgaccaaggaaagccatggctgctaaggtttgaacatcttcctttcttctgttaatgcgctatgttgctgttaaacattaaaacaaaacttggttcctctgactgacttagcatcagctcacgttgcccttatacaggttgcggtgctccactgaggtctttgaagatctgcacacccactcttcactgacctcagccaggactgcccttccaagtgacttcatgcctgctactcagtgccttggaggccttggctactgtctgccaccaccatgcttgtcggtctgtctttctgtcagtttgtagtttgggggaggaggaggcagctctgacctgtgctgactgtgtggcctttctccccctgcatattttcctttcagtgtttttaaggtttctctcaccagctttgacagttttaccttagtatgtgcatgggcatttttttttttttaaggtattctgctctgtgtctctgtcatctcctggtctggatgctgtgggctgaattatgtgccttaagagttcttagttgaagccctagtatttggagatggggccctagaagataagtaggttttaaatgaattcttgggagtgagaccttggtgaagaggcagacggtaggacggtctttgtggctgctgtgtccttgtctgtctatgtgtgtctgtgtcactactgaaagctgactgccacgcacatcctctcagcacatgcatagcccttctatggactctccaagaagaccgatgtgagtcattcgatagcaccaacccttaggaacatgggaagccataagccctgagacctgtgcattgttcattgcctgactccacgtggcactgtggtaccagctcctcagtgtcggtgtgtttggtagggagggggcggtgctgctacagcactgggaaaccacactcctgagactgtccgtgggtcacggtgtaggccacagattcatgatcacttgacgtctgtgagtgtttagagtgtgtacactttgaggagttcaggcggcatagggtattaataggttgtggaagaaatatcaaggcatgtggtttgtggtctaatttagctaatgaaaaatatttttacaagtctcataaacactcattgtccagcaaattagcttcaggcatcagcactctgccctacaaccctgagtcattagagggaagtgtctgtgcaaccatacgctcgtgcttcagtgcagcctcttactggggctctggatgcatctggacgtgtgcacatgtggactgattgagtagctcctgccttactgaagagccagccatgatgcactgaccctggttttcaaaggaaattgatgggttcacctcccatgctccttgtctcaaagcatttccaaataaggaatcatttgcagtgagtccacagcgctctccacagtcacctcattgtggtcatttgagaagtggcgatccaccacaccctgactgacttagtccgtttacacaggtgcacaatgtgtagcttttaaaggccttccctttttagaaactgcctctcttttatggaaaaaaaaatggatttttttcctttgttatgtaaggactgtgtttttagcagtatatcactaaacacagataagcaaaaaggatttttaaaaacacctgtaatttctgccctgccaagatactcagttaggactggtggatccttcaaactgttttctatatctgtgggcatttatgacaagcatgcagcctgcccttccacggggtctcagtgcgttacacatcgtttgctgctgtgcacactgagccagccaagggatgtgcgccagggttcatagtggattttagatagtaggacttatatcatgttatgactgtcttcttatgtccttactttgtgggaaaagcatgtctctgatatgacagtgccattttcctggaagctggaggtttgttttgtgcacacagagcattgtgatccctcagtagtgattctagcattgaccaaccaagcacacatgggcacatgagcatagtgcattgtgccaagcctgaggccagccaagacactgttgttacagcacagagaatgtactgaaatgtgaaagtgcatgtgggtaagggaataatttggggaagactaacctttgagttagcacccatactgcttggttgtcctgcggtctttttctgttgctatgataaagcaaccaaggggagaaaagatttagtttagctcacagctccagtttagaattcatcatggcaggaaagtcaggacaccgcaggaactggaaacacccaggacccaaattcagggaatggtgccacccacttttaggataagacagtcacctttcaacctcattcacgggccaaccagatctgggcagttaattcctcagtacaactccggtgaatctgtgtatggcaagttgacagctacagctaattatcacaggtggacacacaggcaagctagaatctttttctgtcttgcctagtcactgcagcactcttgggatggccaggttccctttcttccaccttgctcacttcaagagctgagaaagaccctgaggacacagctgaagaatagcgtttaaactgactcctttcctgtccccgtgcacagctgccagctgccataaagagttaggattctatccactgggcgatggggagtcttagcaatgagtgggagttgccgctgttttcaagtagaagttctgtgactcaggtttgtgggctgctgagattatgcagtgtgctcagcactctgccaaaaactataagaagattgatacatatcgaggaacgaaagccattgcccataggaatttattatctagttacagaggagattagcatagaggagcaatggtgaataagtaataaaaagaacacaagcaagggcttcgaggaatgcctgagctcctcagaggtgaatgttgttaaagatttgaaggttatgcaggagcttcactaagctgtcaggcccagggcatcttgagctacacagaatagatggagatcctgctacactgagtgggacctggccccaggggagccagagtctctgacccacgaaggagcgtgggcagcataagcagacagacagaggccagctctgacgtctccagcactgtgatgtgactctgggccagccaggagaagaatggatggagagtggtaacaggtcaaacacactcagccctcagcttgctcggttagtaatggtttcgaggcccagaagggaatcttctgttttcagaagtctttattctgtgcctcagaggcctggatgttcccccctgtgtcgtgtgcccaggtctagctgggacatgctcagcctgctcttctcctgctcatcttgctacagatgcctagcagtccttagagattctaagtggagacactcaagtctgagcagtggggaaacttgctttgctgttggctgccctgtggttttctagctgtgaaggagagagcaagcacaggaggagctctggttcatgtgggtcaacaagacttgggcatcatcagcttgctgtaagcctacctcctgcagccctggtccagttattcctagtcctcagtaccttgtgaggcagatggtaggccaaatgtgtccagttgttctccactttcccccaaggcctccagccccactttgtgagaatgaagagaataccttcctgggaggtggcccgtgtgcagtggcacacatggccgtagtctccagtcagtagtcagcctgtcacaactggtctgagtgtcagtacccagctgaacaataggtttttgtacaggctagctttgtgcagccccatgtgaggattaggtggggaaggctatgctagtgagacacagattggtgtgttgctcataggaatgaatgcatagaacaagaaatgtcttctcactgaggtttggatgaccactgttgtaacaaggcctgtctgtcaactaggtgaagaagggaaatggacagtcttgctgaatgactgcagaggtcatgacaagggccgggggggcgggggggggggtgcgctcgggatgaagagagtatggcccaagatgatgccagatggccattccagaagttgccccaccctgaagttatcatgtgcacagcagtggagacatttaaaagtggtcactctgtggcagttggtagtcagcagcgatagcctgggtgttgaagtcaaggaagatgagccctggcaggaaacagagagctgcagggagcagtgtctgtgggaagatgggaacaagatgggaataagccctcgtgccgacagcaacagcgggaggggaaggagggagggagagctgaggaggcggcatgcccctgccaaggaggtatctggctgccacggcatctgctgtgcaagtgtgacctgttttattttagtcccgtgtgtgtcacacataaggttagtttttgtgactcagagccgagacacaggatgcagaagttgcccagccacagcacagctgggactagaatttggcttctcatctttcaatcctgtgatcattttccacattaagtttgtccttggttagcactgaggagttaaattttaaaagagcccctgtgcttgtcagtggactttgtagggcctagagaagcttcctgaatggggtgaggtctcaggttggatccctctgggtcctactgtagcctgtgatgatccaagataggctcccagtttcccaggcacagaagccacagctccaaagtgaggagtaggctcacttctaccttcgtcatcccaaaaaggacctgtctgcagacgagccagcagccacatcactgctcgcccactagacaggtactcagtcagtcaacatgactgatctgtctgcagcaactgggcagattctttgcctatgtcctcatgacaatctcgggggaaattggtggttgggggtggggggttcaggttgctgtgggatcctaacccagacaacacatgctctgctcacagtggctgtcggggaccgaggctagggtagagaatcttgccagcccacttctcactgccgagaagacagctttggttcacattcccagagactgtccctgagaaaacaaggtgatctgtggtgacttcacttgactccaggcatgtgggctcttcctgttaacagtctaggtctggaggcagaccatgctcaggctctggttcttagaggccctgtacctctccccaaaacactgcccagtgcacaaggcaccagccccatacacgcacacctccatgtggtggtctccacggtaaagagcagtaaggacaaccccatgctcagtggaagggcaagccagtccccaacaccccatgccgagttcctccctgggccttgctttctctttagtagtaaggtacgtaatggtccccatacatgctcagcactaggctgtgtgatagcatgccagcctttggaaataaacctgatgtaaatgtcatgtgtcgtttaccccctctcccacacacccttttctctcctatcactaaaccaccttgaatataaggacatatttttgtttctaaaccaaatggaattcttaacaagaacgagcttactcagtgtagctgtgttaggtaggtagcctggccctgctcccctctgttcctgagtctttgtctttgagttgttcttactgacaataccatcaactaggtgactataatgggaattattaatctgttccaccttataaatagcaaatcacactctagtctctaaaccaaatcactgtgaagattttccttctgggaggaagaaagagtttctagtcagatataattaaacgtgctacctagtgggtaaaattaagcttgctgcagagcagaaagaagcatgcccacaccttagggctttgaactactctggtctccaatggacatatgcttgccacagacatggatgctctgccctgtcaggatgcagagccttctcctgggttagcactcaacacagctttccttcacctccctttccgtcgtggaagtggccactccctccccagtctctcccttgagtgtctgcagtctctgcactgcctggcctttcatgcatgcacatgctgtgtgcttctcatccgtccttcccactggttgtactctagtggaccagctgaatgaccgcgaggtgagtaggctgtgccggggagaactctcttcctcagctcttacagactgaaatgtatggatcccctgacagcacaagatgtgtccctgagccccgttggcttgtgctacgtgtgtggaactgtgcaaccgtgtgttggcagctgttctctgtccacacacacaaaggcaacagaaaaactgtcggtgtgtcttcagtggagagggaaaagtaggaactgctgagggtgagcctgcgtagtttcttgtctccttcaagaagacatgtgggaactgtgggaatgctagggactctaggaggccttcccagccacagccctgcctgctgtctttgagcctgaggctctccctctctgttcccacatctgactccctggcctatttcagtaggcatggcagcactaatgcagtggacatcttgtctaggatccctggccggctgaatgaccggaggacccctctgggagagctgaactggatcttcacagccatcacagataccatcgcctggaatgtgctccctcggggtgagacaccgcaccagtcagagccagtgaggaagctcacagggcctgggagatagcaaggggagcagaccagtctaaggaggctggcaccaccacgtgtgttcaggaccaagggtccaatgctcagtgggtgtcagccttgctctcagctccgtaatgcttccccagcaggctcggggctcagcttcctgaataaatactggcactacctttgaaaccagaatcccagctataaagcgtgtgtgctttgtttatagtttggctgggactggggtatttgttcatatgtaggctgatatgtgcatgtgtgtatatatattaccagtgtgaaatgtgtgtgtcaatctcaacttgtgtgtaatattttttgatgggagagaatttgtggttttggcttccagtcctgggcacaaatcactgaaggttccttgttattttttatctgccctcagatctcttccaaaagcttttccgacaggacctgctcgtggcaagtttgtttagaaattttttattggcagaaagaatcatgaggtcatataactgcaccccagtaagcagcccgcggctccccccgacatacatgcatgccatgtggtaagtgtgtctgtctgacaattcttttgtgcttgggtccttgtttgtatgcctggctgctttgaaatggtgggcttcttggaaccataaaagtaccctgatctggggaagtgtgacaccagcctggagaccggggattctccttcagaaagaaggagactttgaaggttaaaaaggtcaacagccttgggccccacattcctcaactgatggaggtggtttggaaggttgtaaaaccgttacattacagtggagacttgttaaaagagaagagtgattggagaaatgccttgaggttttcctagccagcacccacttcctgtcccttccctttcctgaccatgggcacaatgtaaccagctgactcctgtttctggagccatgccttccccactgaggtggaccccttcttaaactgccagccaaaataagggccttctggcctttttagaatttgtactgagaaagaagttgacccaatttattaagtgaatacaggatttctctaacatttaaagccatcgtgtggcacacgtgcacacacacactcatacacactgtgatctttaatcactgttcattgtggccaaagcctgtgtcagtagtcataacaataaaataatacagtgtaggactggagaaaggggttgaccaacaccatgtggtgtgcacagcacctgtaactctagtccaagggatctaacgaccttccctggcctcttctgacactgcacacacatggtgcacaggcatacatgcaggcaaaacactcatacacataaaattaaaataaaattttaaaaaattattctgaatataaacctacctcaagatatttggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgtctctgcctcccgagtgctggaattaaagatgaacgccccaccatgcctggtttaactttctgttgcttaacagaataacagtcagcttatagggaagaaagttttactgagggttactgcctccaaggtttcaatgcatggtctttggctgccttgtctttgaggcagcactccctggcaggagcacgtgatggagcaaattgttccctcatagccagctagagagcacagaggggaagggaagggtgtgggtcccagcgttcccttccagggcatgccccattaatctaacgtccttccaatcgggccatgggtcctttgtggggcattctacatccaactggctgcgttgtccacatgaacggagggggtagattccaaaatgaagtgacaagtcttcattcacattagtaagagagctgtttaaccataaagacctttgtacaatgttgcaaagacaggttttttaatagacatatatcaattttcacccaccactagaatcctagtgaaatgagaagtttgtaaactcactgcctcttacatattcaaaactaaataaaacctgtagtgtccagtattcatatgtactgtaaacaccaaatgttagaacacaagtctcactggggctagagagatggctcagtggttaagagcactagttcttccagaggtcctgagttcaattcccagcacccacatggtgcctgagaacagtatataatgggatctgatgcccttttccctcatgcagatatacagaaagatatatacataaataaagcaaaaattaagacaaagtccccacatgtctgcatccttttacagcttggttagagaggaagtgggctgctaggaataagtggctgtgcactccagaagggaggagagagccctgtctgagaagcctctctaacatgtaaatgaccgcttggggagtcgatattgtaaacactgcacagagagaacacgtcctccaaatacccgccttccttacatctgttattctgaccaagaatttttgtaaaaagataactataagaagtggaagggggctggggagatggctaggtgtttacagtgcttgccaagcaagcgggaagactgaagttcagaacttggcatgtgaatgtcagggggtgtggagactcagctggaattattcctatgagagatctcactccagagaataatgtagaaaaatacccagggaagatccctgacaccaacctcagacacacacacacacacacacacacagagagagagagagagagagagagagagagagagagagagagagagaagaaaaagaagcagcagcaaatgggggcagctcttgttgggaagcatagaagaaaaagtccagtcccatagcagttttcgcaacactggctccacccaccctgaggagggaactttacagacaggatgagagacagggctcttaccctttgtgtctccacaaagaaggggccctgggaaccacagctgtctacacacagctgggcaagggaactttatctttcagggaccttccctcaacatgctgggcacttctgtgataagaacttctaaatcctcacactgaaaactctgacccttccagtacctgtcttagcaagttccctgtagatcagaaggcatggctccatttctcccctatgggtttagcatgcaggtttccacagatcttgttccagtgctgctgggtggggctgcattccgtgggaagaatcctgcatctcgttccacagcagtgcctgctcctcagggaaaggagttggattgggtacctccttgccccagcccctagctggacagtcaggtgatgaaagtcaagatggggaaatgtagggtctgcagtggagtgcatatgtgggtcccagcggttcagcctggagctacttctcacagagtagaagcgggccaccttcagtggccagtgctacatcgtgtgtgtgcgctggatccaagcccacactgtgagcataggccattgacagggccaagaaggaaccacttcatcagtcgtgcggcctcagtgtaaagtgtggagctgtcatggcaaaccaggatgccctttacaaataggaagaacagatttgctgaaacaaagattcaccctgaaagaaaatattctgtcatatacagtgtttgcaggcggctccttctcatgctcctgtaagaggctgtttctccaagcatccctacacaaaagtttaggagttggaaaagagctgatttgggtcttcatggccaacagttgcacagtggtactatcactgcttgcttgctgcaagtatcacatatcactatatcagtatatactatgggaacaggtcctctaggcagggtcttcctccaaggctcaagtccactgtaagctagcaagcccagtatctccctaggaggccctgcatggccctcctacaactctcccagcaaggatgtggaggcgccagctcgatgagcggatgagcatagccccagcagcagcagctgtcactccctattgtactggtcagacttcacagctcctgccacatcccagcggccgggaggaggggaggtgggggggggcatcgggtccactccacgaatggtagtagggaggggtatagggactgctgtttgactctcaactttaaggagagccttgcattttctacctgctgtggctcacactggaggctgggggtgtctgactacagaggggaggattggaggaagcagccaggtcctggctgcctgctgaggctaccggaagggacagtatttctacctcagaagccctgtgcctgttccagatgcccatttctcagccagctccaccctcctgttgggtatgagcccaacatcctttccctccagctggatgttggaagtgaccaggacttggcagtgcctcttctcaaaactgttcaatcatgttggtgcttcaggggagccttgatgcctggcaccagagccgctgacttggggcctcacccctgtcgtaatgctgctgaccatggtctctgatgctgacactgatccctgcccagaccagcttgctcctactcagcgcctcgctgacaccttcctcctacacttgtaacttcctgcagctcttgtaccccaccttcctcttcctgccttcctcgcctgcaccccatccctcacccctccagtctaccttgccctgaagctcgctatgatctgcaggcccagttctataaggagcctagttcagcaggtctaagataaggcactatgagagacaaggcagggcacgcaggaaggctggtggtgtctctgttaacattcctgaccaaagtgcaagctgagcatgccccagccgagcacagaggggtagggggtctctgcctctctgtttctgtctctctcatattgttatataaaatatatgttaaatatcacattaaatgacactgcatgtgtccacagtacaactgctctccatgccacagtctctgtcatacacagaaaaggctgaagagagtcacagcaggcttcagacaggacagcagtgacactcatctcttaaaaactgctggagattcctttgaaattagaggcctctttggagatttcctattcctttgaaacagtaagtgctgggtttttttttaattgaatcattatagttaaggcattatctgtcataaaatgaaacttagaaacaaacctaaggaataacggggcttttctttgcatgataaaagcatagctagcaaattccctaaggtttgtacctagactccatcccatgcaatattttccaaatgatgtggaaaggactcatcagaatcccaagtgtgctgttaattcgcatctgttagacagttttgtatgtagcactgcacagccagtgagccacccagccacaagcagggcttccctgtgaggacagctgcagatccactgcacatcagtgattcgagggctgggttcaccctgcagagtctgtggcggtcaggactgtggtgctcactgccttcatggtagtgaatagctgcaaaaaagctagccctccacccagcaaagggacagcaacagggagagccatccagaagacaagttttggggcaagttctggcaggtccttgagctgctccaggctgagcatccattgtaggatgtagactggggtacatctttttcattctcccttggcccatgcgtggctgagccttcagatcctattgggcctccatttccaatctacagatagatgcttgatgttcctctgaatgtcttctgaggtgtcaacttctattttatgttgcttacgttagggattgcagaaatcaaaactggggtgcggggagcctcctgtaaagaccactgtacagtgtctgatagattagaggtagtctagatcaggaggaccagtgtcaagtgactctggtcttacacagtttctgttgacttctgagttcataggggtctaacccaggactttacactggttaagccgtatccagggcattcacttagctccctaaaaggtgagctaaggagaacgcatctgagcttttgaggccagaggaagcagttggataatgagtatggagtgcccctcagaaagcaagcctgcccaggacatgaagcagctgtgcacagtgacaagaaggcgtcatcagtggctctggccagctccctccctcctgagcccatgcagtctgaacagtatctaaaagtcctctccagtttgaaatcttgtctgacatcatggcatcatgacatgcgatgcgccaaataagtacatttgaagggttctagttacagacgccagtgagatgtgattccaggaggagacgtgcatgcctctgacacgtgttctctagggagggtttcagtagtgacagtgctagcgtgagtggagtgaggaagtaaacactagtcaatcccattctgggctgggattccatggtgaggccagcgtagacattagcttccaactctcagagagactgtatagagctggggacaggctgatgcctttactgacagggccagcacagtaaagatgcactgatcagggcttagcagcctcctggatttcatgggggcaaggcagcttcagggcctagaggggtaagcctaaaccaatggagagcaatctcagtagtctctgcttggcccagtgcccacagcccagtgctcccagaggtctccctgctaccaaacccttaaccgcaacctacagagaagctagttggtcatcagtcatcctcttccccagtccttactaactatactaacagtgtaatataatccccttgcctactgcctccattacctagtatggcttgctggccaggctgccttggatgttccttcagtttggaatgctacttgacaaaacttaccaggatatctatcagaagctacatgtacaacaagtcccatttcagaaaagctctccacttcccttggttgtcaggggcattactgtaccacctcgtgcatttctggcctgaggaggtgtgtggcaggaattggggggggtggggggtggcgggcatgggagtgactgttgcttccctcctgcctcctccttgggccctgggcgacttgtatttcccagagactagcctctgtatggcttcacccccagcctgtgtagctgggatggtttctcagcatttgttactaagaaacactgctacttgaggcatctggttgtgagtcttgttccagaatcttcctgtatgctaaactgagctgtccacattccaacatagctctcaccaagtactctccctagaatctgaactgtgaatgagtctagtggactaagcatgagagaaccttctggaagactagaaaaccttatactagcatgacaccattgtggtgggggttgtatgacacggtcatcccacccaagctagagatggacatggaaggtcttgaggcacaagcaccttccccaagggacaagttttccttgtgcttagctttctttgcttagactaaacagagtgagaagccaggccagacagtcacggtcccgggtagaacagacagaaggaagccattcggtcttgacggtgatctttgtttccgttatgagtcattcacagaatacttatgcccacagaagaaaaagacattggtctctggcataagtgcttttactctgtagatctagcatttgtgcccctgagcacctttgtgagacccaccccacatggttggtgggatcatgctctatctgccttcctctggaatgagttgtgtgtccaagcgcccagaatcccacacgcagctttacacactggcctttctcctgtggtttcatgctatagcacaggccagatggtttgtaagccttcttgtcctatagatccaccatctccatagatctccccagctgccagggccacatctcagggcatgggaggccctgtgggacaggctcatcactgcttctgcccctttgacaccaaggcatgtagtcctgtcctcactagcctgacctaacagaaatgctgacccttgaaggagggagggagaaagaaagagatggggagccacagtcacctctataactccgtagctatacctgaggaccaagccactgctgagttgagcttcttgccaggccttagctgggcctcacctctgaagtatgactggtgggttcttctttctgccatctgccaccccaagtgatgaaactcttcccatagtgctcagggcttctgctcccttgtaaatagatggctgtacacacatccccggggaactcacaggaaaggtaggcagaaaagagcctttggaataaataatttaaaatctggttattatatccttgggtggtgatggagaggctgcatttctagtgggggaggggacaaagcctaacaagaacggaggctgaagcacaacaatgtggctgtgcactctgcctgccgggggtggggaggcgatgatgaaatactcagagcacagttcctgtttaatttttgatacaaagccatcagggagtcgttctccttcactctcaatttcaggggtcctgaaaccctgcatttctctgtggtaataacctgtgctttttgctgtgattgatcaatgcagatggagcccacgccagctcagaaggctttcctccagcccactgcctgggtgattgccatcctaagccagtttcctgaaaacccaggctcttcctggtggtgactcaaccagcagctttgaaagtcccccacgccttgctgtttagggagggagtccagttcagatcaggctggccccatcctgtaccctccagcctgcccccatcatttccgtccagccactctctttactcttcccaacctctgttcctcctctgtgacacacagagacctgatgtgagcgccctggtgccatagagagagatggtgtacctgggtgtggcgtactgcaccgatgttatcactgggtttataaactgcttttcctcttgtccgtagctaagaatcccaaattaagactgcaagattggttgaattttagctgagaaaatgcagccagctttactcaactgctgcttctgttcatcagaggacagttgtgctaaggatgagatgattatataattttacagtttgatgggaaatgctgaagtcatgtggtctggcccagagagggtgcccagggtgcccagcatgctctgccttgtggaaatgcctctctccattccacctcagcccagggagctggcccaggactgaggcgcccctgttccaggaattcttagagcttgtctgccagtggccttggatgttcttgatcaggttttcttctctttggtttcttgaagaggctgctgcttctctgtatccctcacagctactctgtactgtcccttcgccataagccgcagcccctttgctggcttgctcatttcaacagtgtctaccaagcctttcacacaagtgaaaaccctggagccgacttactgatgaaggaactgtgtggtggcttcagctctcccagatgtgggacctaggtggggccacagctcagcagaggccatcatgccaaacagggtcaaatgtgtgtaggttggaatgtgtttgcctcaagattgcaatggcgcggcagcatggctgctgagtgctggatgtgtgcacatctcttctctgcttaggcccaaaagtggtcatgctgggctccagctggtcgagtcagccagctgccggatacacttcccacttcccatctccaattcccctcatttctacccttctaactcctgaaatttaaactttaaatttgattaaattcaaaacatctttatagagtttaattgcaataattgactttgcttctgtcccaacaaagagtggatgtctcccctgatgctgccgagcacccgcttgcctgcggtcgggcgtttattgaccatctgggagctatttattgcccaaagttggagccacttttgattatttcctgattgcctcttaatcctgtcagcagggaagggctacatggttgtgtggtctgtgtacagtagggcggggatgggaggatgggatgccaaaggagtaacttttctcatcttaaatctaccctgaaatgtaaatgtttccattcttgtgttggtcctttattgagacataaagaaaatgtgcccgttaaccttctagcccaaagtctcattagtctaagcagcgagaacaggagtctctgcgtttcccaggaaattgcctggaagaagagattgccattccaaaaacagaatctgcctaagatgagagaaattgacatccgtgtggctgtgcccccatgtgtttgtggtgcacagagcttcagcttgggattcatgccaagtgctggcctttacgactgtctactgctcagccaaggccttttccttatctccctgtcccttgggaccccacaggaaggatggcaccactttttacttcctggatagtgaggctggtccctggagagacaagacccacgtagactatagccccagacctactgagtggccatgccaaagaccagcatttgggggaccaccaggctttgttcccttccactggtggaacaagacaggagctttggagcgctgatgacttctgcaaaggcaggtgggatggaatggggtctgttagtgtggctcttgtagccacagagctgccaggggggatctaagagagggtctaggagactgtggagatgcttgggactccagaaactggctgggaagtgtcaggtgtatgtcagacatggctacttgtccagtgatagaaccagagtcaccaaggaagatggtctggttagggcatcactgagggtgagtggagggagctgtgctaaacacacacacacacacacacacacagagagagggggggggggaggataaacagagtagcatggtagccctgggtgctagaagtggagggccaggaagagctggcctgagaggacagttagaagaggtagcatctcctgtgccacacacaaggcattatgacagggaagccgcattccaaagttgtttacacatgtaggcagtggtgcttggaagtgtggccagctacaccagggaatggttaggtaagggacccctgggcctccactgtggccgccttttaatgtgaatgccatgagttgcagataccctcagcagacctctggtctggctaggctgtcctgaagtcccaccccagatcaggccaccctgagctccttgggctcacgtaccctctgctgtggtcctgagccacacaggatctgagttgtctggctccctttgtgcaccctgctcagacctccacccgttgttcctctccctcttccacatggccagctgttgcagatagatggaaaacctcaaactgtgaggctaataaatccctctccctcaaaatgctttttgtcaggtgcttggtcataggataacaaaaggctgtagtggctcagtaaagaggggagaacagcaggttaggtctgttcaagccataggcctactcaacctgcacttcaggtaggccagctctggatcatctcgttgatgcttgcagggaaccagggtgagcctggattcctgaagctgtgcgcagagagactgaaagacccggtcctcatttccagttagtctgcactgggggctgtggcacagtacttcctacaggatcttcctgtgagcatcatgagagagacaggtgtgtagtgaccaagtcatttggggacagcaatggcaccataccagtaaaattcaccctcatggaaatggtgctgctggtctttcctctaagtctgaaaataattaaaaaactgtaagaaatcaataaaattatactccatacatacccaggccaagatcaaaacctgcttttaaattctctagcctgtgtagccccagcccacagcactactgtcctccccaccaccacctaccatcaggtcctttagaagaagcctgggaggaggggcatctggcaaagagccttatgtaagtgcagccagtctgctcccagacaccgagtccccgtgtcccccattatgtaagaggaagcgtttatgaagctgcataaatcatccctgagcttcagagctacagaggaggagtccgaggactggcttgacggagaacagggagtgggcgtgcacctggtggggtcgcagacagggctgtctgctaggcacagatgtgctgtcagagtgctgagtagtacctggtgccctgagaaactgtctgcctgtcctcctttagctcagcgccaccaacacagctttagcctcttgggtcccagcctggtcccaaccatgtgggcagaaggatgctagggcctgaccgtgctagctgcacagggtgtggagcatgttgatcccacctggccttctgcgacagcgggtccacagcaggccaccaccccagcccttctgactgggatgtttccaacaaagtgccttgttctgcccaagctatcccatcagccaccacaggaaccccagatatttggagtaagcaggctgtgtgttagggagggtcatgatggagtcagaccactgtagaggaacgagagttctgtcatcctttctgttctggagagaagtgtgtcacactaggcaggtggactgagccacagcaccaaccacttcctggatggctctgccagctggtcagctctgaagcccctaacacagcccttgccagctgaaggatttgtccccattggccctgaggctcatccctgtgaaggcctcatgctaaggctgcttaactgataatgtgggtgccctctgttctctccccaggcaggcctgggaccttgctgtggacatttgcctctctcagctgccaaccatcatcgaagagggtactgccttcagggtgagtccccacttcagggagacccctccccaggggaccctggtccttctttgtagacacctggtcttcatgtagcactcagaattctgggagtaaaagatttagttcaccaacctggaataaatgatgcagccaacaagagttttcagggttgggtcagcctgagtctcgttaggttctgaggtggctatcctttaaaggctgtttgccctgatgcactgctctcataagccagcgcctctcctccacgacttacctcagcctcagactatgcaggagggagctgagcagctgcacatactgtacctgattcctcttgtggcgtggacaagtgggtggccttcctagcagcctctgaagaactcccttggttttttcctttggggagtattcaggtctgactgagtccttgcccctgacctcaagagcatagctcacagcaccattcatgaagctgagatgacataaggcctagtgtgagactgggactgggctgtcaccagcacaaggtccactcaacactactcaagaagccattggacttcaagaccaagaaagccaggcagtgtgctgtgtgtcccgagacagcctctctgagctttgatttcctcacttgttgtctgagacaggctctttctacatcatcctggctgtcctggttctcatactgtagatcaggctgcccttgaactcagagaccttcctgcctctgcctcctgagtgctggattacaaggcgtgaaccaacacacacagcctggtttccttgtttcaaagggaatctggggaaacccaacttaagggactatgtgatggttgagttagtgtttctcaagtgcttaggacagaagttatacgtgtgatagggtagaagttagtgacatgtgatgggccctcatttgttcttgtacaagtcactgcccagagaatgctggccactgacaagtgagccaagaacagaaaacctgcagactgggggactctgttctccttctgtgtgtgtgaccagcgtctgtcaccatcctgcggcagaatcaagcctgggcctgggtgcacactggcatactgcatgcttggtgtgaataggctatgccagctccccaggtatgcctgaaagataaaatgatggggcaaaaggcttttaannnnnnnnnnnnnnnnnnnnatgtctctgggtgtctatgtctacatctggctggctcattctgtgtgtttatgtgtgtgtttgtttctctctccctctctctctctcactctttgtgtgtgtacacgtgtgtgtgtctttgtttctgtctgtatatctgtgtgtgacttggtgttgatggtggttttggttgtctgtttttttgttttgttttgttttgttttgttttgttttatttttgtcttgtctggtgcatgtagcatccactgctcaacttccaaacaaaaaagcctgtgtgtctgccctccctaaactgtttgatgcagacaccctgtctctaaacgccctctccactccccccaaaaagacttgaatgtttttgtctttggaacctagcttccctctgcttaggagacgagcactcggctgtaggacagcatgctgcgctgtgctgcgctgtgctgtgctgtgctgtgctgtgctgcgctgggctgtgctgtgctgggctgtgctgtgctgtgctgtgctgggctgtgctgtgctgtgctgtgctgtgctgtgctgtgctgcgctgtgctgtgctgcgctgcgctgcgctgtgctgtgctgtgctgtgtgtgctgtgctgtgctgtgtgtgctgtgctgtgctgcactcctttcagtctgagcacttgtgctccatgccaggtgtctttgccaagctctcactgccctatccctgacctcatgaaatcagtacactgcattatgggaacttaaaggtgtagaggcaactgatccagaccatgctggaactttttttattttatctctccccttgttttgaatgtatagaatacgtgtaaaaagtcatatgtctcataaatgtatggcttggtgaatcttcaccactttaacacactctcaaacccagcccacaaatcaagcagctcctccttccctttgcagccttggtctatctgctgccatgcagagagagcgcaccctgtagagaactacagggcgtgtgctgtttgtgtctgactacttccacccaacagtacgcttttgatatggcctataagacctttccacagaagaaagaataatggtgtctgcagactccaaatgttttcctgtgccatgaccagtgtaggttttgagtgtccatttgagatcctcacagtgagtgtggcctggcccagggactgtgcagcttgaggcaaaggggaagttagtcatccagatcagtctaaaatgctgcagtcgtgagggctagtcattcttcctgtgttatactaaggtatttaccttcactgctgagccctctcctgcactgtcctctgacctggctgaccgcgtcctgggtgtgcctgggagcacagtgctgattgctgaggtgctggtagtgtgtttagtaggtgctactagatactatccgcagcggccttggtttgtagcccttgtgctgtacaggatctggttccatgcgcagagtgacatgtgtccccagtgctggcagagtgtggtgtcctgtcttctgtcttatacatcttcctgctgagctggtgtggatctggttgatgttcattgtctcattgtggatgagtgtctctaactctgcagacgacattttcatgttttaccttttcttctagttgagcaaattcctacttagtataacttttctaatgattggggcctttactgccttgtcccttggctttagccccacagttagcagagatatgcttctcttctctggtcaggattaggtgaaggagttggaagtttgtttgtagaaagggtctaacaccctttactgtgtcaccccggccggcctagaacacacggtgtaaacctggccggcatctcctgccttgtctcctctatgctgggagtacaagttcatgctgccgcatatggctgggtcaggaatcaccgtctctttgcttagaatggtcactccacagtgggcaccatgaaaacccatgaacagaagttgactggagagagtgtgtgattctcatttccaggcaagcaccgggatgctgtgggttggagggaaggaggcacttaatgagattttaaaacaattggtgagtgattgctacttgaaaatgagaaaaccacttagggagctgccctccagcttcatggctgccctgagtatgagctcttttgtgtgagctgatggcacagagccctgtgactttctgagtggcaggtaaacttcatggccctcacgtcactgggcctttactgcaggccctgggctctgatgggttctcagaaaaggcatgctgcaggttggaggcgcaggtctttcccctaacgaccaggctcacaggggcgctgctaatggacacagccatctcccctagggaaaagagaaagccctctaccccaaaaaatgtgcatgggaacaagacactgaagcattttgaactgtttggcccgtggaaggcagctctgtggggcagtgtgtttgacgtgcagaatgagaaactgcacaggcgtctgacctcttgcttctcagtcccttccaatcctgttgtctcccttcgtccccaagccacccctttcctgtgagtgtaatgctagcatgggaacagagggatcttggcgactccctcccagcctctccagtgccctctgggactctgacttgatgaacctccatgatgatcaaaaggccccagctcttctccatggccattggctagggtgttggtgctcactgtgtactgcctccgcccctcggctactctgccctcacctacgcagctattcttcatgagtccttagaaactagagcacagtgtgactacagacatggcctcagctcctcttccctctccttgctacccgttcccaccacacttccctcacaggtctgtgtcacgctcccctcagaaacagggcagtaggcaaagtccagcattctcccatccagctcacacagccgggcagctcacacagccgggcagctcacacagccgggcagctcacacagccgggcagctcacacagccgggcagctcacacagccgggcagctcacacagccgggcagctcacacagccgggcagcatgctttgccctgctctgctgcagcgccagccttcccacagtgccctcactccatggtcagtgccccacctagctctctccctcgtctttcatgatgctagcctttcactccatgcccacccctgtctccctctttcgagctgcctccttccatagggtgtctggcctggatcctccaccttctctcttctgtcctgtctcctggtttctgttgtgtgttcgagcttgctgtgctttgctgtatccaagacagtatttaagatggcctctccatctctgaagtaacccacagctgggtcctaatcttcatcttgcttgattcatctcatgtccagtactgctgagtacatcactgacctggcttccaaagccccacatccatatgatcttgctctatcttcacaacgattcccttcaccattttcttggaaggttccacctgtctccttggcctctaatagttagagtcagtcctgggtcccttctctagagctcaaccacaaacaaacaaacaaacaaaaaaaaaaaccaacaacaacaacaaaaaaacaggctaaatatggtgcacacctgcaatctcagctctcaggaagctgaggaaggaagatgaggaaccgcagactggtgtgggtagacagggaaactctctctctctcaaaataatactcacagtgatagtgaagaaatggtggttctggagacatggcctcgtgttcctacaagtcgtatgtgctctcctgcagaggactggggctcagggatgcagtgaccctcatagctacctcttatcacaccctccctgatggttgacaggccacacattcagatttcctctgtctcctgtcaggctgttgacagagcccgtaagccctgcgccctccagctctgtccattgtggtcactgccttgtcaggactgaggggtgagggagggcggtggaaagaaacctgcctccctaaccgactctttggcttttcccacagcacagcccattctttgccgagcagctgacagcattccaggtgtggctcacaatgggtgtggaaaacaggagccccccagagcagctgcccatcgtcctgcaggtcagtcgcttcccacagacctaactgagacacctgttcctcaggaggcgagccgggctgtgcttcaggccaacggtacatcgatgtgttacatctgatctgaagtcagatgcttgcttactcccagcggcctcctcttggcaaagccactgaattccctttttcctctcccaattaaatatagattgggatagatcaccactccctcctcctgcttacatgttaggaactaatgaagtgtcactgccaacgaaccttgctatggtgcagaatcttggcatcaccacctccttctgtttggaaggacacgagataaaagtttgtcctgtgaggaaagggtgaggccaccaagcagatcctaacggggctatgacatcatttcctgaccaataccagagcagcacagacagaccaggtccttgctgtggtcctcagaaaaacaggaccttctctatgtgtcagcaattcatgtgcaaactggtctggttctgggggacccatttactgcctgctgactgaaatgacatggggcagggatatgaatagtggatttgtcatcacagttgggtagataagtcacaaagattgtgtctcattaaatgtgtgtttgtgggagaaactgataagctaggctgtgactaagaaaagaccttttactcgggaaccattgactagatcagatacctaggattggcaacttactgtaaaagccagaaaatactatttatcaagtttccagggcagttgagctcaggcagaagctgtggaaatcatgagggtgtaccacttggaaggttaggaagcctgtatctctggaggagcagagggcaggctcccctctcagtgggaggggcagagcttgccaagggccagggatggggccatcactctccaaagcactcgttataatcagccagacccatggtctgatttccacctgcctaaggacattgcctcgcttctttcaaagaaggccttgtgtttgctcattagggctgctaaccacattgtgtggacaaccctccatcttcactgtgccaaatgctcagagcaactgtagctcaacagtgtctccgcagagcacagtgccctccccaccctaccccatcccccaccagagcctctcccacagcacagccagcctcccaatctcaggaggtgattcacctatcccagaccttgggtttctccctgtctaaagccccggtaatctcagccagcaaaaaataaataatatttttttaaaaaggcaagaaagaagaatgcatgtaacataaagagttaccaatagcctgttcctcttgaagtgggaactttgtagaatggccttaggtcaaagagaggtaatgctatattgttacgtcttttctgaaattataaaaataattatcactgctcctcttacatgtgtctagcatagttttaagaaagttctggaactgcaagaagagctagaaactaaccaaatgtttccacaacaaagcaaaagtaatgacagcaggacaaggcctggggaggcgcaatgcctgcgtgattccagtaaatggcagcaaccctgggtcacctgggtcaccacaccactctctctccaccctgcctattattgaagcagcacagcagagtagcgctggtcctccccacagcagggctccagggccaggcatgttcatccagttctttggggtctggcaatagtccttttgtaaatggcttttatcgactttatttttcatgttccatttacaacccacactctcagggtaggggaagacctctagagccagcctgataccaaacatggagcagtagccatgagagcacacacaccatcttccatgtgctctttcagacagaagtaagcagcaggtcctgtaccacacaaaaggctctgtctcccgggccaggtcccctatgactcaaggggcgagccctgaagaacagacttggggtagacaaagaacgggataggagctagggaatgcagggctctgggaggcccacctggcctcactcaatttgctacttccctggctttgacctgaaagcctttattgtttccagagcctgggccagctctgttagagaaggagagaagatcttaatacagactgcagtgattcctttcaggaaattcccatagtgaactccttgcatccagtaacagaggcgttagccgcagtaagaggctccatcaggctctgttgagttgtagccccatcaaacagtaacatggacctgacctctcccaaccagcttcaggatcctttctgccttttaaaaacaacatcagactgctatgtcctccactttgtgactgctggcatcaagaagcaatctcaaagtgtggctttgtatggttctgcctagaacttgccacgactgccttcccccatcagggcagctggacagaggtacccaaacagaagaagaaagaaagtcaaacaagaaagaccagaatggattcacagggcagagttttctttttctctctctctctctctctctctctctctctctctctctctctctctcttttcgttttgtttttttttttcttcgagacagggtttctctgtgtagccctggctgtcctggaactcactctgtagaccaggctggcctcgaactcagaaatctgccagcctctgcctcccacgtgctgggattaaaggtgtgtgtcaccaccgcctggcagaattattcgcttaacatggatgttgtgtatcacttgtctttcaccaagtgtttgctgttggtgcctcttatttcaaacgtagtctgggcctgaagcacaaggccactgtcaggattcaggacagtgcggatgccaccacagttctgccctacatgccatgatggtgctgcccctcagaagttcctgggtctcctgctggaggtgggagtcctggcccaccagagcctcagtttctcttcatgtctcaggcaaaagcctgagcacagtttatatgatgacgcgagtatgggttaccttagcaggccctgcctggagtgtgctcttcattcctactctccacagacgaggaggagcccaggacctgctcactccctgtcggcagtgagtccctgcatctgtgacagcttggttttcagttgtttattaattttaagaaactgtgtgtgtgtgtgtgtgtgtgtgtgtgtgtgtgcgcgcgcgtgcacatgcatgtgcgcctggatgttttgcctgcatgtatgtctgtgcaacatgttcactgcccacaaagaccagaagaggatatcaagtctatgaacccaggtcctctgtaagagcagccagtactctttcttaactatcaaggcagatcttcagaccccacttcttaattttttgaagtacaaatacacacctaaaaaatccaatctagggctggtgagatggctcagcgggtaagagcactgactgctcttccaaaggtcctgagttcaaatcccagcaaccacatgatggctcaaaaccatccgtaacgagatctgacgccctcttctggagtgtctgaagacagctacagtgtacttacatataataaataactaaataaatctttttaaaaaaaaaacaaaaaaaaatccaatctatgttcttaaagcaatcttaattcatgttggacctcagttttttaaaaggttttaatcaatagaagaaacagaaaatgtgctattggggggaaaaataagcagtactttatattgctcccataggcttcgataatgatccttgtgtttgtattgagtggtgacagtggacagtgctgtcccaggagactctgtgtctgttcctgaggattgtgttgaccttgtactgagcattaataaaccagagacaccgggcactttgtttgcccggtcacatccagcaagtgttatgggtgatgcttcttgttaaaagggtggagtggtctagccaacggctagttcttaattatagatgttacaacctataatttcacttcttcacttcatcctcaggagaagacaattgtgaaaagctgtgcagattaggacatttgtcagagttgtctgtgatgtctagcattagggaaatcatttaaacaagccatgcacatttctacagaggacacactgtgcttccactgggagagagaaatattgtcccaagtgtctagggaggggaacagccctcaccatgtataatctcactgaaaaaggaagtgggatagaccttgctgcacagagagcagagcagcagtgagggcctgctgagcacagtgtgctgctcacactggtacttggtgcgggtggcatagtttacttgggtaatgaagtattttctcagtctgtctaaagcacgaattgacaggcagaagcccagctagaacagaagccgtggggttgtgttgtcagaccctcagggccaccagctcacactggagctttctcggaggggtggtagcagtcaggtgtcctgcttcggtggctccatgtctttctctgttttccaggtgctgctaagccaggtgcaccggctgagagcattggacttgctgggacggtttttggacttgggcccttgggcggtgagcttggtgcgtgtcttctgcctcgcctgggggaagggaagctaagattagactcagtgagacaatttgaactccaaagtcatagtcctgccagcccgtggtggggtgggtggagcagggcatccttgctctatcctgctctggggcttttgtcagtattagatcccctctagtttaggcttctcgaagccttccatggcctttttctcccagacgtctgcaccctcacactgtccacactgtgatttaggctcagttctgaactattcttctgggtcctttttctacagagcagcagtagaaccaagcagtggtccatgttcccaatagataagtcatcaggaaatcagagagaggctcgggaaacctgcagactaaagatgcttagagcttatttagctttgtctgcaagtaaaggtttaaaattggggctaaaaagaagactcacaccaaccagagagtatatatgggctgccccatggccctgctatatgtgtagcagagaactgccttgtgtggcctcagtgggaaaggatgagcttaatcctgtagaaatgtgacgcctcggggaaggaggatgctagtggggcgaggtggcagtaggtgggagaacaaaggggaggggaatctagtctcatcagcaagctccaggcttatttccagaccatcagaaaacaaggagaggaggttggcttcctgtgcacacataagcattccaaaatacaggtgtgcacacatgcacctacatacagaaaattaaataatgaagcttaaaacaatactgttgaaacaattagaaatctttttcatattataaacaggagctgtccactctgtgtgacacacagtgaaatgacctgcatagggtctgtgcagagtgctgtgggctgagcaggctagcactcaccatgttcttaataattggatattgtctgcaaagactgatcgtttgcaggctagcattgaaggaggagggagaaaagcctaaaaataggaaggataacattgaaggaggggagagagaatctaaaagtggacagaagaatccaacagtggttcctccagcttggtcctgcataggaaaggccagtgatgctggcaacttgaggagtgagctaagccagcagcagtggagaggggcctcacacctgtgctgactcttttacctccaggccctgtcggtgggcatcttcccctatgtactgaagctgcttcagagctcagcccgagagcttcggccactccttgtcttcatctgggccaaaatcctcgctgtcgacagtgtgagtaaccaccttcactttcaccccacctgacagtgacccccccaggtgttaggtggggctggccactcctgtgtttcccctgcccttccaaacttgtatgcctgaaatctatggctgtcatcgtttccagagtaaaactctcccccaacatctccctctggttaccaaaccatccttagtctctgccagctatgactagtctgtcttctacgtgtcccctgacacatgcactctgactattccctgatcattcttgagtctgttctctgtgttcctgacaatggcaacaagtgaccctgagccaagcctttcccctcccacaaagctgtgtcctgccatacccttcttttcctgtccctaaatgtgctagtactgggcctgaggcttagcctaccacttgttttgtctttacccatcctgcctgtagccctggagagccttaatggccctctttacagtgacttcccagccccggcactttccagttgttacatctcctgaccctgcagtcatttttctcccccacaaagatagatggtacctatactcatagctttgtgctcaagtctgcaagtggcaaagaggtcctcatccttgaccttaactgccatctagagcacacaggcacggacggctttaaaaaaaaattcaactgggcagtggtggcacacacctttaatcccagcactcgggaggccgaggcaggcggatttctgagttcaaggccagcctggtctacaaagtgagttccaggacagccagggctacacagagaaaccctgtctcgaaaaaaaaaaaaaaaaaaaaaaattcattgaggggccagagtcataccttgcaggagcaggagtcactaccatgagtatgacaaaatgaacagtcaggccaaagatctgtagtgaggtagcgtgtgtaccttgacagcaaggatgggtcaggactgtgacaaagggctagaggctgacgcttcaagcaagcaagggacagtaaaaagatccagagttctgggaggacagcagaggatgaagccttcggctgttgtagcaggctatggggcagagaaccccaagaaataaactctggttctgaaatagctcaatgtaaagtagctgatgggaggaggtgaaggggaagaagctcttctgaatgagagagctgaggtgggtgcagagaggccttcagttcaagcagcagcctggagaggcagcatctcgatcaaaatgcactggtctgcctagggacaaagctgtagcacaagatgggctccctgagtggtcagggtttgacccagctggtggtcatagcctatgaggtccttgtgtgcagatgtggacagcaggtgcagtgtacccaggcagatgtgttggcatcgaagatgaacgttgtggatgacaagggaagggcatgatctcagactgcattccacatggggttagaatcagcttgcagggactgtggggagcagnnnnnnnnnnnnnnnnnnnncaccttagcttttgggcttgcttttgagacagtcgagaatttggggggaaacaatcctttcaaagggtcacatatcagagatcttgcatatcagatatgtatattatagttcgtaacagtagtaaaattatggttatgaagtggcaacaaaaataactttatagttggggtcactacaacatgagggactgtattaagggtcacagcattaggaaggttgagaaccactgatgtaaaagaatcaagtctgtttccagcttggcttcagtgggcttctattcatgtagtcatcatcattgtcgtgtgtgtgtgtgtgtgtgtgtgtgtataggaagagtctatttctacatcagcttcataaaatgattgggactttgcagctcagagaagacaacgcaggcgtgacaagccgtgtttctgactatgacaagcagaggatgatggcctgagctggccctggctctatttgtgagtcaggacagcagtcactgcagttctggggaaagaggtgctagtttggccatgtcacaagatgtttgttccctttctgtgaggcagtggagatgcagagagccttgacttcctgatcctcccactgtctcctcagtgctgagattaagggtgcatgcaaagatgggagcagagcctgggctacagctcatgctacgtaagcattctagccaggaccctagtgcactgctaaacagtgccattctatagacatcctgtgtagctcctgctgggagtcttcttgctgggccatgcctcctgtcttggcttatctggggctgaacttgactcttgctgacctagtgctctgttcctggccaagtgatgaatgttgctcctgtgtgttcagtcactaccagatattacatagttcaaccatttatttgccattctatctgttgaggtaatgttgccacagcagtggatttaggcttaaaggactgaggtgaaccctgcctcacatctgtccagcgccctccctcgccctcagggctctcactggcctctctgcattctggcaacaatgtctgggctttccacctccagcagcaaaattttaaacaccaggaccatgacctggaaagctcttttgtgcatttcaatttaatagagcccctcagagacaccttacctgtgtcattgaaatatgttcttgataaactagaagcctgcttttgtggctcacaaggcccatactttttgatcatttctatgttacccttattcagatacacagaaaggccaacttacattaacaacaggcttttccaaggagttcatttttgaatggcttttcttctaccccattatcttcatcttctatatcagcttcttcagaattggcagcattgcttgatatctggccacgaagccacatggaaagggtcctgggagtctgccaaagagcaaagccaaggcaaaggagcaaaggcagaagtggtcacagagcacgggtctgtgagtgtgggcaacaagcttcaggtctgtggttcagactcttgagtggggcgtggaaccactgtgtctgctggtgctgcgtgaacacacgtgagcgatttagtcatcatgatttgggaatttagttttttgtttgttcagtaggtttggtttcagtatttttgtgcctaaagataggtatgtatacctgtatttgaaatcttaggaagagctggatatggaagcaggaggcatttcctaatagtgcttcaccatgattatgatcactgaagtgactaaagctggccactaagttccactatggtactttgactcctctacattcctgtttatctcctgggcgcactggcttcctgtgcccacggctccacgcagctcagctgtgagcacagaccctacagtgctctgagcacacagccctgctgaagtctgtgtgtgtgataccagtgttcagctggaaaatcccttgcctgcaatgttctcgtaactgcctgcaggcactagggaccattgtctgagttaatttcctaaccagtttgttgcagctgtttatttaacagcagtcatcttgctgagggccactctggaatatttctggttgagcctcgtttcctcatctttccttcttttaatgacttcagacataattctcagaggaaaaaaaattccatgtaggtataagcggcctcccctcccctcctcacatctggccttgacatctagctgcttcactgttcgggtggcatatgtgacctaccaagctcacaatgcccagctgattccaagtctgccactgtgagggttcgtagtacttagtactctacagatgaagtgatttacggtctgttggtacataaagtctacagatgagatgtcctgtggtctagacaaacctgaggtacagtataccgtgcttgttatacagcggccacccggttttctggcatgctctggaagtctgagaagaatggtacctactcaggcgaaattctgccaaaagctcatcaggacccatctctcccaggtatctgaggaacactactgtgtgccgctctcatagggtctcctatagagccagccagcctttaaagtgggtttagacctgaagagatggctgctcttccaaagaacccaagtttttagttcccagctcccacatcaaataattcacaaccacctataactacagcttcaagggatcagccacccacttctggcctccaacattcatatgccaaccatgtgcgtgcacataataaaaatcttaaaaaagaagtatgggcaggccgggtgtggtggcgcacacctttaatcttagcacttggtaggcagaggcaggtagatttctaagtttgatgccagcctgatctacagagtgagttccaggacagccagggctacacagagaaaccctgtctcaaaaaaacaaaacaaaaaacaaaacaaaaaaaagtatgggcaaaagagaagaaaaatatcccggaaagaacaatataaagaatgatgttccctttgactgaggggctttgcatattacagggataccggcctgagacagctgcctcaagacagggacagcgagcctcctcagagtccacttgttccaagtcccagagtcaccccctatgcctcgatattgtacctttaacactgttgttaaatggccaggcatatgacaaaccaggaaataagtctataatgagaagaaattgatccatggaaaactgttcaaagctgttgcagatgccaggtttggcagacaaggaaaggaccctctaccatcagaaaagtcatcagacaggcgtctagaaataaaaacaacagtgtgtgacctgagaaacaagttggggtactcagcagtgagttctgatcacaggagaaagtagtgatgggattgcatgaggagggaaagttctggaaatccaaggagtatcatggagccatacagcagctgcaaagggtcccacgtgttgtatttggctccttgagggacatagaaatatttaaagaagcaatggttaaaagttcttccagtttcattgaaaacagatctagaaagctcagaacattccagccacatgaactgtaaggaagacccactaacacctcatggcccaatggctatcacagtacagtcagtaagaaaaagcaaagtttaggaccttaggagactcatagccaagtcataagaatgcaaaagctgaccacagagcaacatctaagctctgaagaaaagtctgtcaatttggtgtctcaaagatcgaagcaaaccagagatatcaagacataccttgaagatccccaagcatcagactgaagccaccacgtgacagtgggaagcactcggggtgagtgctgtgtgaatggcttggaattttttcttctccttaagggtgaaagctcactttgaatgtttattaaagtgtatcctggaaatgtcagcatatgaagggagaactcatggtaactgtacattgttggggagagagaccaaagcaatccttccttggctcttttactttgaactggtctgtggactgctaatggtgttgaacaggacttgtccagggaacaaggccctgggttctgtttctagcaccccataaagaagaaatagatagcattctttaaataatcctgaagacagaacaggagttaaagacagctgttttggttaagatgactgtaggtgatgaaacaccatcaccaaaagcacaatgaggcaaggggctggatttcattgtctgaacttctacatcttagtgcatcactgaaggaaggcacggcaggaccacaacctggacgcaggagctgatgcagacgccatgaagggatgctgcttactggcttgttcacatagcttgctcagcttgctttcttatagaacccaggaccaccagcctagggatagcaccacccacaatgggctgtgccctccccattaatcactaagaaaatgctctacaggctcacctgaagatcttatgcaagcattttttttaaactgaggctccctcctgtcacataactttagcttgtgtcaagttgacataaaactagccagcacaaagataatatgaacacacatattcgtagtacagtggaaggaagggaagagagtggacaggaatccagggttaggtgaggtagctgtgagctgtgctacatcagtaactgagaagtgcacagctatgtcgcttatcagtttaagtgaattaagtgttatctagagtcagaggtggtgacagttgttaatccagcaccgggaaggcagaggcaagtggatctctgtctgcatatctagttccaggacagccaaggcagtagtgaggcacacccttgactataccttcaaaaatatttctagaaaagattaactggggatgaagggctgccctcaatgtagactacagtgtgcttggtgaggagtcccagatcaaaggaaagggggaggagaaagccagctgggctgtctttcctttgctccagacagcacagccttccaccgagatggaatgcccagccagccaggtacccttcctcccttaggctgcttcatatcaaagcaatagggaaagtgactaatgcaggagggtagttagagtaggtaaagagtgactaatgcaggagggtagttagattagagtaggtgaaagtaactgatgcaggggaatagttagattaggtgacattaactaatgcaggggcgtagttagggtatgagaggagtaaggagacactgtatggtgcctacaaaaagtatttttttttcgataaaaagacacaagcaggttgaaagtaagagctatgaaaggcggtaccatgctgccatagagccagagaaggtgctgggcagaggcatagtcggtgttgtatggtaaagaaagtcctctaatgccatgtgagggcccatggggagaacagatgggttaggagtgtagctccctgacacagccaggctgcagtagagacttgagtgttgccttgataaggaacagaatgtgtcagtaagtgaagaaaagatgtagcgctgtctactgtggatgctccaccagggagggcattcttcccatgtaataggccacctcccaggctgagcatgcactatagccagtcagaggcattgactcacagtgtgccctacagctgcagtggggtggcactctaaaccaacgtgcatgtgtgtgttcatgcatatgtgtatgtgtgtacatacatacatgcagaggccagatgtcaacatggtgtggggttttattttggtttttttttttttttttcaatcactgtcatttctcactaaacctgaaactcaccgattagctgtactggctggccagcaaggcctcaggatcacccagtctctgtccctccctcctcacatacctcgctatatgctgggacacttgtgtgagggcttgagatccgaactcaagtcctcatgcttgtgtagtagcaagcacttgactaagcaggccagctctccattccctaagaaaaccttaaagtagaaaacatgtaagacaagcgtgtaatatacaatactataatcataaataacacattcactaaagtattaaaaatacgtataatttaatagaatgcacataaatataactattaacctttatagaagcttttcaaacaggaagtttggtttgggttttttgttttgtttgttttatggtgggtctcactacagtagccctagttggccatggactgactcactgcatggacaggcaggcctcaaaaagaagaaatgtttcttttctatcaaataaaaactgaatagtgtttggaacacagctaggcagtgcagagggcccctgcctgtgtgtgttaggatcctggcctcagcttctccctgagacgttagtgaaagaacacaggagatgaggagactgaagatgggagagacagaacagggagaaaatggccagcccatggcggctgagccccggctggttaaacacactggtaagtgaggaaccatcacccagactgggaaagaaacatggagagggttctggaacctggaccagcaggtgataccactgatggttttaaaaggatgggaggtaaatattgtgaatgacctcgacagatgttcctcactgacaggggagacttgctgaagagaaaacagatgagctcagtagctctgtatcaaagaacacaagtccggatggtttccatggaaaattcttctgaacattaaggcggaggcacatgggtagcagtacaccctctctctattgcttcatgagataagtaacactctggtaccaaaacaagaaccagacaaacacaacataaggaaccctcatgaatacacacgcaaccgcgaggctggggatagagctcagttactcaggtgcttaccgtgagagcatgactacatgaatttgacccccagcatccacataaaagccgagagcacccttggtttcagcactgatggcctcaggcaggtaggtccctgtccctggggctccagccagtttgggctctccaggatcagtgagaaaccaaattcaaaagcagtaaggtggagtgaccaaaagacacctgatgtcagcctttataaccataacagttataaagttgtgaagtatcgttgaaaacagtcgtatggttggggtcaccacaacatgaggaactgtataaaaagggccacagcttcaggaaggctgagaaccgctgctctagaatcaaaagggagagcggctcagtgggggcccccgcattcagcagctatggaagatctaggcattgtcttgaggacattagtcgttgggaacagcaccactcctgcagtgtccttctcgggcctggggcctgtgtgtataagagtgtgctgtgagctgagtaatgagcgtgcacatgcattctctctccgctcctggtggtgatgtgattggctgcttcagtgcctgcttgacctcccacaataatagattgcaccctgagattgtaagccaaacaaatcctttcccatacattgctttgtcagagtgtttagtcacagcatcagaaaggaaactaagacaacgattaaaagttctattaacaaaagaagaaaaagtcatataatctcaatattatgcaaaaccacaaagtaacttaatgaatggtctttatcaagatgaaaatatcttctctctgcagacaacattaacatggacagacaggccataggtgagaaaaatagtttcaagtcatgtgtccacatagtacagaaccctttcaaaatttcaactatttctttaaggtaagaagacagcctgcagcatcaattctctattatgtcccctaaccctaaagccagggctccaactccaggctatcaggcttgacccaaataccctcgtccagcagctctgttctgagttctcacttgtcacacagacttgtatcatgacatctagagtgactctcttggaagctgggagctggcattgagactgttacagtcttcagtctctcagggactgggtcacaggagcaggtcaccacaccaagctctgttctaatagtttgaagctggaagtagtccaaatggacactaagaggcaaatatgtcagcttttccatacatgctaatcagcagcttaaaaacaaacaaaaacagtgccacttgaaaaatgccagtaatggagctgtgtactgtgtgactctgtgtgtttaaaactgcagaaggtgtgagcttgtctgtagtcagggcaggcagatcaactattggggcaggcaaggaaggggcaggatttacaaaggacacgaacatgcaggagctagattcaccctcgatggtggtagcctcacaacacgcatgtgcctgggttttggggtctgagctgtaagtctgtgccatgtcttggcatcttatagacaatggtgtggatattgacagtgacctgttctgtttccaccttgattttcaatcagaaagtgggcttgctattcttcattaagactgatgctgcgaggtgacctaacactgccctggaactgaacctagaccaaagccagaggctgtgacatgtagttgaatctgagcatagtactgtccctgagaattcccagagaatggatttgtggttatggaagaaaatgtcctttttgttaacaatatttcggggcagggtgcacatgtatacagaggccagaagccaatgttagatcaaggtaagagtaggttagtattctgtgctattatataatatgtggtctttatccctttgccccactaagggcttgttcactcccccatcttgtgggttctttctagtttcctgacactccaaattaaacacacaaccccagaaacttgaagctaagatccaagtgtgagaaaggacatgcttgcttggttttaataagtttcccaagttgttgttatcatctgtctctctgctaattaacaagaataagggagggaggcagttaattaaggactggtgtaagctgggttccagctaattgagggtttttttcatagacagaattaatgtgcaattcaggcagaccttccaaattacagttaataaagttttatttatagcaccactggggaacatcaagggcacaatgtcaaggaatgtgggaaaacactctgaattggtattgatgggataatccaaagtcaggcatacaaacaggcataccacaggaagagcttccatggacaaagacaacagggaaggaggtgggatttttttcttcggcccctacaacctgtgtatcctttgcagcttcccagtgtctggttcctccgcaaacagattcttctctgaataaatttgatcaggtactcagcctaacctctcttgctccgcattttgcctcttcacgtacacaaagctcagttggaagagagttcaatgtcggcctcttctctatgggtcaggcattgttgagcatcctccctgttctgctggcccaccgtggggctgctctaggaggaatgcagactgcctctatctagatacccgtgcttcctgcctgctaagctttgctttgggggatagctctaggtttacagaaatctgaggtgacagtggagcccgccccagtttcctgtgtctgaggcacctcagtggacacagtgagacctgtgttcctgtgccggttggtgccttaccttaaccagctgcaccattctggtgcaccacagggtttctctgtccactctccctgggaggggcttcagctcctccaaatcaaccctccccctttctccctcaaccctctgtacctctgatgtccatggcagcatgaggaggccccttggctctgcacacctgcacttgggttgcggtagtgagaggcttggggtggaagacagatgagcccccttctcacacgtgctttgccgtttgtgttagcgtgcttcttccttcaaagtcatgactcccagccccagcgattactgcaaacactgctttgttccttcacctgttctgttccggacccagatgtgggtatgggggttgtttgttttctttgtgtacttagactttgtatccgttgctttgttttcattatgtacttagacgttgtattcgttactcttctgttgccgtggttacatactgggaccagcagtgacaaagtttattttggctcacagttccagagtaagacaacagaggagtgggaggcagaggaggcaaaggaggcagagcagaggctcagatcacagctgccataaacacagatcactgacagcaaaccagaaatgggcaaggctataatatcaaaacccaccccaacaacatacttctcccgcttcaaggctctactttctgaagctttatgacctcccctaagagcaccatgagccagggaccacgtgttcaaatgcatgaacctctgaaggacattttccattcaaactatcaggctgttctaagtctctgtgtttgggatgaatttagttttatacttctaagtttttctagtctcccttctctgtgaggaagccatgttcctagaaacagtctttcagatgggggggggggggtctcctagctctgactgggcagagtcttcctcccggtcactgagagccacatctgatgagcaggagtcaggaacatgctcacaggaaaaacttataaatgttttctcttcctctctccctgccacctcattcatataatttgatgctttgagggtctcttatgactcaagtataggttatagtctgcagaaaaccagtgaagggaagggacatgttagggatatgtgtttgcagaaacctttgttttgtgtaagccagtcagcaaagctatgtactgtgtaaatgggttctgggtactgtctcactgtctggtaagatagaataccatgtgaaggtgttttcagcagtggctacaagtgtatctacatggcgacatttctccccagtgcagatacacatcatgagcagcatacatcactgtcactatgtggtcatgtatgctacctcagagatcataaccacttgtgacatggagggtttgtcctgtgagtgtagccaagagggaaagaaatacaaatggccaatccccgtctgtcagtctatacagaaagaagagcttttctgaccggcctgactgtaaggcagagcctgggagactcgggtgctcctctccatggaagaggctgagtagcagcaaacaaagccactggggtccagaggtggcatgtggactggggacagcaagctggactgtcaaaccggtgaaggaagagaaggacattttgaatgtccttctcaaaaggatgcagtcgtcacctctgaacaccagctgggaataattttgaaggctggtgagatggctcagtgggcaaaggtgcttcttggacaagcctgcagcttgagtttaatccctgagacccacgtaaatgtgcagtgagagaaccaactctactgagttgacctctgacctccacaggcatgccatgcatgtgagctcatacatacatcatatgtggcacacaataacaacaacctaggcctatctttaatcccagcactcaagatagaaggcaaattctgagtttgaggccagcctgctgtacttagtgagttccagaccaaccagggctgcatagcaagattctgtcttagaagaaatgggattgtgatctcagtgccaccgacacagctctgtggggcactcagagacagggtaaggcctacataacagaagtcattcaaggagttgaactgagttctaggaaacaagtgacttccagccccaattctgtgtgtgtgggtagggtaagtttatgtctaaaaaacccaaaggctctattaataccaataaaagaacttagtgagatagaagccttaatacagaagctgaagtgacagcagctagaagattagacaggaagagcagcctgtgtgcggtaaggtcataaatccagggataatctactgtgagatggggaaagccgccacaaacaataccttaaaccattcctgagagacacacagtcaccttcagcagataagaacacaccctgctctcttgcagtaggattctgtgtcataaacatgtcagtgttctctcggttaatttataactttaatataatcctagtaaaattaccaacaggcttttttttctggaactagacacaatctcagcttgatatggagaaataaaaagaagaggcagggagccctggctaggaaggagagtggtagagaccctgtcctcctagaccacaactaaccatggatcttcagtgatgtaccgggcctcagacagactcgtggactggtgagcactgcagaagcagccccccagtgcagtctgtgaatgttagtggcagcacctcagctttgcagttcttcagctgtgatggtagaaaagctagaggctgctgctgtttggatctcaagtgactgggaaagacttggactggaggaaagtagtctgcaactataggggtggagtggagtgggtggggctcttaggtctttgaaggtgtaatagccacgtcacccccctgttttctctgattccttgctgccgtgaggtgagtgactgcttccaccttccccaccctgatctagaacctcaccatgtgctcaaaagcagcaggcaggcaggcaggcagccagagacccaaaacaacatttagaataaacattttagtttttgtcttgtcttgtcttgtcttgtcttgtcttgtcttgtcttgtcttgtctctctctgtaaagccctggctgtcctggaactccctatttaaactaagctggccttgaactcacagatcctcctgtcaccttatccagcccaccattctgtcttttacattcagtgtataaagtatttaatttatcacacagacagaaaactgcatgatagagattaattgtacactttggacaatagaatttaagttaaagagatagcttctttaaacataaaaggcaaaatcataagatccttagaagagggactagagagagggctgagtggttaagagcactggctgctcttgcagagaatttggtttcaattcccagcacccacatggcagtccataccagcctaaaactgcagttccaggggatccgacaccctcacacatacatacatacaggcaaaacactaattcacatcaagtaaaaataaatgatttttttaaaaaaatagatgagaaaccagatagattctattttaacctgggggctattgagctttttaacctacaattccaaatttagatgcctttgcaaagaaacttacttgaatataaataaattttatatagagaaatattcaaaaatacatcacaactaaaaaaataatataatgtgttccctcatgcataaagagctcctagaaatcaaaataaacaacagttcagtaggcaagcagtcaaactgaaggcagcagttccctgagaagctgatccaggctcaccagtatgggcaccttggctgttgtcccagagcatctgagttcagttcctagaactctgatgacagtgctcagggtacctgcagggagagtctcgggaactgtaagaagagcaaggaaccctccatgagaaaaatcagggtgtggggtcagctcagtacagtataccctagagatacacttgaaacagcacaagacaggccagctctgctgctagcagcctgagaaggactcctgtcagtgaccgccactcaggtaaagccagtccttgacttagacacgaaaaagagattgtgggtgagccagtgtgaaacagagctgggccttacgcagaacacatttttaacatgtgtttaaacactagtttaatgggaagaaaggggctcagggaattaataagacctgtgtgtctcagcagtggccaagccacagctcaaagggtcactaagaaaccttctttgtgtcattttgataagcaagatgatgcatgatccagatcctggacaggattgtaatctaacaagataaagccattcagatcccagggttgcacaagacgggtatgatggagctttggttgtaagtgggttctcatgaggctcatagaccactttgagaaatccatctagtgcttagcctcaggcaggatctgctgccatttgaatatccacactgatgtctgttacagaagtatgctcctatgttggcaacctgaatagcaaatgctgcgagccatgcagagttcttgatgcccaactggcaaaggcttcagccagcacccatttcccttctcacagctccataatttttttttctttttattgtgcatcttgtaacaagaaaaattttagagaaaaaacaaaaagcaagactccagtgtcctgtcgtggtaggccctttggtttaggaaagttggtgagagtgtaaattcacttttatttatgaatctataacaaaagcccatgtgagaaacagaaaaccgagcacacggtggcagggagctctagttggttttaatctctccatagaattttggtttttcgaccttaatggtaccttggattttatggtatgtgggggaggaaaaaggcaagtctaaacgttggaggaaggaacacacgtgcctttcacagccacaccaggcacagcatggtgactctgttcttgagggtcatctttcacacagggcattgagtagtatagctcacaggattttcaatatttaaagtaaagagccccatttggaaagtgacagtacccatcactggggctactgggaaagcagccgtgtcaggtgtcagctgtggggactgcgcaattcagggctctttctgctgcttcctgaagaacagtgaaatccctgccgtgctcctccaccgccagggtctggtggtgttatggccaggagtgtgggttttctcatctgaaaacatcttccctatcaaacatcatgcctgagccacctccagcatccttgaagtactctgtgctcacactggaaggtacaggcagggcattcatagatagaatctcatgggtcaccctgtgatgcccaacagctcccctgtcaggcatgagaaactgttcatgtaagttcacatcttataggagagcagagtcaggccaggacgccctcctctggaataatgtggacctgctccctggtggtgctgtttgcagctgcagctatagctgtgcaatcggacttgcagctgcttcacctctgcccgctcgtgccttcctttcctctatctgatgtcctgagactcagacttacggcagttggagagggtgtcattgtgacagagacagaccaccaagaaaacctcgtttttctgcctctccttccccctccttcttactctagccttagtatgtcattagtgtgtcttagtgtgtctagccttagtgtgtcattattgttcctgatctggggaaggcactgcttagcaagatcttggctttcccagtgtggccatgtttggtgcccccacctcctcctctgagcctgtatttccacagtgacctgtcactggctttcctgctctgctgggctttgctttctttgcaactcagtgaggctgctggcctagaactcagagaaagcaggtcaagggaattgtacctccttcttggcaagtatagctactggggagagccactctccatgcagcggaaaccagtacacactggcacctgtgggcgctggcaatgaaagcagacatgtgaggagcagccatgactgttgcctgcagtagcctgacaggcttatcaaaacagaaatcttttaatatatgcctcataatcgccaggctccgcttttgaaggcttattaaagtgatcatttcagatcttgtgacttgggaggctcacactcagaattagaaggatatgaattaatgacagtttactactctcagatgagctgcacttaaggagtttcctgtaaacgtgtgggctttgatttgacttgtcggagctctgatttgaaaacaaagaatcttttctcctgagctacaccggtgccttctgctgctgcaggcatgggcagtctgcagccctgggggccaggcatggatgatgggttgagacttccagctcgtttgttagctgcctcaactaaagcagggaaattggtaaagtgtgtatggcttgatgagcagaagctggggtcaaaagcctgcagtctgagccagccttctccttcttgtctaattataccttacagagccaggccagtgtccaactgatgaactagctcatcaccatgctgccatgaggaattcttctggacccctgacaaaaggagggtcatgcagagtgtttgcactgagcacccaacagaggccatgtgaaagccacctgcctctgagaggggctcaggacctgcactgctctggaaagtcaggaagtcctaaagcaggatttaacattcatctttcttaccctcggttttttaagttccagtctgggttccttgagagtctctgagcctagagcagagctcttgggagccggtgagagggtggcaggcacatcaccctgggtgctagtcccagacagccttagcatctgtctccaccgtaccttcattcatgggtcacatgactctactgcttcatctttgtgtcattcaaacagagcagaggccatgcccctcacagttcccacagtggccacacctcatgatgtgaacagcctctctctctttgcagctgggccaaggcctcagtctcagcctccttactcaccctagagctttcgcaccaccagtcccagtgtgacgtcagctcttgtctggctcaggtgtcttgtgttcaccttcttcccaagtgcactgcccatctgtgcaccccacctctttagggagtgacgtaggtaagcagccctggcctcccgtcccttcctctgctttcctcgtgtcctgacctctgctcctcgccgtaacaccacctgtacttgttgctttctttactgctgagatgaagcacctgacaaagacaacttacaggaggaggacgggtctgtctgcacccaagttcaaaggcacagttgatggtggcgtgtcagccggatcccgaggctgagacggaagcagaggaagatgagagctactgctcagctcctgtcccttttgtgtgatctaagaccccagttcacgaaatgatgccacacgttagggaagggttttcctaccccaactagcccgactgttaactcccctgaagatctgccagaggttagtctcctataattccagctcctgtcaaattagcaatcagtactaaaagtgttgttgacagctgaccttagacctggcgtccggctgtaccgtcccttactctcagcttctgctggctcttcagttcctcctagcacccagtcacctggctcttcccatcacacattccagtactggcctgtttccctctgttccatctttcccttctccgtttctcctcctccagtctgctgtactgttctccagaaagcatgtgctgtgcccaccctgcagctctccatgcttagcttctcagctgttgccagcacaactatcaacccagttgtccctcacagttaaaacacggcttgactggctgaaccagtgttctgcataggcagggtccccagtgtgtggcacatggtgtgggtggccacacaggtggaactgtattcccaggaaggggtcaactgagttagaagagctgcatctctggtggcttctttagcacttatattacaccttgaatcctagagctctttctttgcttagtattgaatgcccctattatgatattcatcatatggcatgaatccagacaaaatcccctagagcttcatcaggtacccacactgcagaagcaggagtgctgtcaggtatcctcatgtggaaggcgacaggaggggagcctgagaagcagcaggaaacataagaagggaggagtctgagatgaggagtaagaaacctgggaagaagcgggcagccaggaaggaagaagacagggtgagcaagtgaggggctgaccaggaaggggaacctgaggggggaaaggggtctgagggagggatcctaagaggaagagaatctgaggtgggggaaggggcctgagaagaaatggggagtctgaggataaaagggtggggtctcagcagggctagagagatggcttagcagttaaaagcactgactgttctttcaaaggtcctgagttcaatttccgggaaccacatgatggcttacaaccatttgtaatgagatctgatgccctcttctggtgtgtgtgaagacagctacagtgtattcaaataaatataataaatctttaaaaaaaaatagtcagcaaaaaaatggagaccctaaaagataccaagagcatgagagaaagggagcttaagaaacagttggggaatgagaagggagaggtctgaaagtggggtcacagcctgtgtcctgcgtcaggcccagccacccatcttcaggaaccagaagtgagattaaaattaacagaaggcaaaggatgtgcacatctaagcagccgggttaggtgtggtcccacccactgttggcccatcctcatctggcttagcctgtaaggtggtctgtgtgactcctctggctggtgccttttccatcttgtagcatgagattcccaggaaaatattttgaggattccattgtttcaactgtgagattgagagacacaagtttctctttagaatatcttcatttctggatctagagagctggctcagttaagaacatttgctctgtcagagagtccaggttcaattcccagcacccacacagtggctgtaactccaatcccagggcatccaatgccctcttctgactacctcaggcactaagcacatatgtcatacatacatacatacatacatacatacatacatacatacatacatacaaacagaacactcatattcataaaaattaataaaatatcagaatatcttcctttctgccaggctgagagcgcagaacgggcagagagcacagtcctaacccagccgccagccctgggacccagagtgtgctcttctcttgagagtggcagggctccagccttttcccaagtgaaatctggccttgcaaggaaagatgcacagtagtgacattcccagagtgttggcatgggaagccatgacacagccccctggttcctgcactaatggcctctcttttgtctcctttccctccagtcgtgccaagctgacctcgtgaaggacaacggtcacaagtacttcctatccgtcttggcagacccatacatgccagtaaggactgagccacacttctctcttgcccagcatgacattgtctccagtgcacactagggcttgcctttcctcgctgagggccaggtagagaggtgctctacagagctatacgtgggtagacacttactgcccacaccacacactgctctgtttcttcctgccctgggtgagaatctggtcttcctatgccagctggtgagctgctattgcacatctctgcctagccgtggcgtctccattacctagagccagcaccctgggcagaatccttgtgtgtctacagtgtggtgcctcaggggacctgaaggccccttaacagacaagacgctgacagattttactgaaggaaggaggagattatttgaaagtttgaatttcatacatgctaaattgtttttaaaaattagcatgaatatagagtatatgggtagttttctcataatgtcatgtcatcagattcttcagttcctctctccttctttccctccatccagctctgcgaagagtaatgtatacagagcagccacccacagacgcacgcgctctctctctctctctctctctctctctctctctctctctctctttatctctctctctcatagcttaagttgccagtatgttcaagtacagccgcatactgtgctctgaaggtggcgtctataagagtaactttcatatgtaaattcttcgtctggccgtttatttgtttgttttaagtgaaatgatacgatgtttaaagagaaaggtgggaacaaagctgccagcaaagttctaactgggactggcattgtgctgggtaaccggtacttatgtactttacctaagtggtgtatcactgtcatgggcagcgtaggtttatagtttatccacagtttggaaataagccctgccttcccttcagaggaaggaagaatacaactaaaggaattgaaagctctaagctggctagcctggcctggcagccacaccctctatgctcagatctgagagaaggagaaacccccatgccagagaaggggaagactcccatggttctggtgggcagtgggccttgccactacagtgacctcagaacagcatgccttacacagaccctacgtgggatataaggccatgaacaggtagcactgccaagtgacaataccagggcctgcagggtgtgcctgttcttcattaatgagaactagcaagcttgtcttgcttttgaaaagctgaccatctgtgagctctgcagagaaagcagcaattactaaaggagcagaggcctcagccagcagcaaaaaaaaaaaaaaaaaaaaatgaggggggggaaaaaaacccttctgtgcaaaccacatctagatctcaagtttgtggtcctgaaggcacaaatacaaagccttcctatagagttcctaccctagagccagggagcacagcctgcctcaaacacagttgcatgcttccaaagggaaggaggccactgcatcaatacacaagagaactagcatctccagaaaagagccaaagggactccaggagcagcctctgagaaacacattgtggatggctggataaaggcagtatggtttaatcatgcctgccagccactatgtttgcttcagaagcagtttcctgcctgctgtaagaaaataaaatctgctttttaacctatccttaaaaataattgttttaaatagacagatcttgggggaagagggagtacaagctagagtggaagaaatgcccctcccacatttacaactcaggaggtgatccctcacaggggccacacagccaggaagagaatctgtgaaggctccacatgagcatggatgaggtcagccgctgtcactgacatcctcccagcactgcaagagaggcagcagagagacacagtgagccctggaacaattaaaacttaatccatagacatagcataatcaaagtaacaagtatcaaaagcataaaggaaagccccaaaggccccagaagacaggaagagcagacagcagctgcagtgatggtccatcacagtgagggaaacaggacggtaggtggcccttcagtgacttccggacagagtccctgctaagttatgctgctactcagtagggtgaagtgcagatattttgggacaaaaaatgatggcttggcatttctgctatgcagaagatggtggcctgtactctattgtagtcaactcaggagatgtcacgagtccccggggataacttggtaagactgtcgatgtgcatgtgagactccatgaagtcataatgggctgtcagattcccacgcaaagtgaagagtgcaacgttcattttactagcagtgtgcttggctcgagggcacaggcttcctgagctctacacatagggaaagcatggttcctgggcctggcaaaccaattaaaaccaccaaccactttatctgccatgacaggacagggagcagccagtcagcatgcagacccttagaaatgcctcagcaggaaggctggtacatgctgctttccttacatgggaggccagtgctgaagacagaaggcacagggtgctctagagaggtgagtctgctgtgagggtgcacagccatgatgcattttgttttccaggctgaacataggaccatgacagccttcattcttgctgtaatcgtcaacagctacacaacagggcaagtgagtatcacagcagctccagccacctcgtccctccaggaatggcacaaaggtgccttgtttcacacgggtcctagggcagggatgccgcccaggccacctttttcacagctatgctattcaggtagcctgtagagccttcagatcacagcagcaggcggggttcctcgtactctccacagagggccagtccttcgattagctcaccattgaagggcaaaacagaataggcaggatttacagtaagaaaatgcagtgtcttgtgtttgagcaaggctgctgccacccttgtcaggaccctgccccacttacctatgtcctgtgtctaggaggcctgcctccagggaaacctgattgccatctgtctggagcagctcagcgacccacaccccttgctacgccagtgggtggccatttgcctgggaaggatctggcagaacttcgactctgcaagatggtgtggggtgagagacagtgcccacgaaaagctctatagcctcctctctgaccccatccctgaggtgagttgtccttgcagatgtaagcttctgtgctaggtcagagcggtggtgggttttatctgtaaagagattgtggggccatgtgcagaagcctgcccacatttacacatgactgctccagagcccttagggccatgtgcagaccccaagataggctaccgaatctcatttgactttcaatcatgctatgccaactctgtatgcactggggtaggtagctacaggctggcacagcctctaagaagcaagtttgaaccattctgtttagcacttcctgtggggcaggaccaggtcatcacttatgggcaggggagcgctgagggagggaaattgcctgtggtatgttgtctgccatatcctgtgtgtgtgtgtgtgtgtgtgtgtgtgtgtgtgtgtgtgtgtgtgtgtgtgtgtgtgtgtgtgtgtgtgtgatctgagagcacgagtgggtgtggtgggatatgggtatgggtgtgtctgtgttaccaccatgattgtctgttgcaggtccaggtgctgcattctgggagatgagatagtggaggggcttagatgattatgaatcattggaacacttagcacacaagtgacagaatcatcttttgaagcaggagacccagttctagattgttttgctctcagtgggaatcagagagcctgctatcatcttcagaaatgattactgtgtttctgttagtaagccaagagtttgagcagctgtaggtagaaagtgcagcctggctgtagtttgtttgcagggctgttctgaattgcccggtgtgcatatcagatcagattttggctagctacttgagaaatcagtgccatctgtcccccaaacatgccaaggacaaatctatgctcatccgtctttgtttcaggcccccttatggccttggaaagccctgacagagttaggtctcaacctctatagttactataaaaggcagattatttcttacagaaaagcctaaaatgaacgtgccaagaaatcttttaaaagtaaactcatacagtagcaggaagtcctatcctgtctccttgagaggtgtcagccacaaatgcttgtctcatctacctactagagacagccacttgccctgccaagggaactccacatctggatgtcccaccaaaaggatgggccttgttggagacatccctggaatgcatccctggaattgctgctgacaggcaaccatgtgaaatctttgaacagacccgtgtcaccaggccccaagccttgggatataaaccagttctcaatgtctgaattgaaataatctatcaaggtttgtttagggtgtgtgcgtgtgcgtgtgcatgtgttcactttacgttccactcactgtccccctctcaggtccccctccctcttctcctccccttttcctcctagacagtgtcccaccccaggtgtcttccccaccctgtcacatcaagtctctgcaaagctaggtgcatcctctcccactgaggctagacaaggcagcctagctagaacaacatattccgtgtacagaaaacagcttttgagatagcccctgctccagttgttcgggacccacatgaaaaccaagctgcacacctgctacctctgtgcagggaggcctaggtcctgcccttgtgtgctctttggttggtggtggttcagactctgagagcccaaagggtcctggttagttgagtctgttggtcttcctgtggagttcctatcccctttggagcccacaatcctcctctctattcttccataagaatccccaagctccatccactgtttgcctgtgcgtgtctgtatctgtctgagtcagctgctgggtggagcctccaagagaacagccatgctaggctcctctctgcaagcacaacagtatcattaatagtgacaggggttggtgcttgcccgtgggatgagtctcaagtggggcagttataggttggccattccctcagtctctgctccatcccccatccttacatttcttatagacaggaaaaatttggggtttgtgggtgggttggttccctatcgctccactagggttcctgcctggctacaggaggtggcttcttcaggttccatgtctccaatgctaaggtcatcctcattgattcttgggcacctcccttctcccaggtctctgtctcatcctggagatgcccctcccaccttcccacccccttcagttgcagatttccattcattttcatgaccatctggctgtcttctcctgtccctccccatacctggatcctgacccaccccaccccccatcccctctccctcccagttcccttcctccttctgcctcttatgactattttattccctcttctaagtaagtaagactcaagcctccttgcctgggatctctctctctctctctctctctctctctctctaagttttatttatttattatttatatgagtatactgtagctgtcttcaaacacaccagaagagggcatcagatcccattacagatggttgtgagccaccatgtggttactgggatttgaactcaggacctctggaagagcagtcactgctgttaatcactgagccatctctccaggccccccgggacttctttcttgtttagcttctttgggtctatagagtgtagcatggtatctgtattttatggccaatatccacttataagggagtgtataccatgcatgtgcttttgggactaggttacctcactcaggataatattctcaaattccttccattttcctgcaaaattcatgatgtctttggtttttaatagctgagtaatcttgcattgtgtaaatgaaccacattttctttatccattgttcagttaatgggcatctaggttgcttccagtttctgactattatgaatacatctgctatgaatatagctcagcaagtgtctttgtgggatattgaagtgtcttctggatatatatatctgatcatgaatgctatagatgagtcttgagactattcccagttttctgagaaactgccaggttgatttccagagtagctgtacaagtgtacagtcccaccggcaatggaggagtgttccctcactccacatcctcacctgcatgtgctgttgcctgaggttttgatcctaatgtaaggtggaatctcagttgttttgatttgcatttccctgataactaaggatgatgaacattggtttaagcgcttcttggctattcaagattcctctgttgagaagtctctgtttagttctgtatcctaatctttaattgggttatttggattgttggtgtctaatttataaattttggatgttacccctctgtctattaagtgttttgttttgtttttcatgacgctggtccttttgcttatctggaggatagtggcttgctttcctccatcctccaggcctggctcctcttaagactcacccacctgagcctggcgtggtggctcactcctttaatcccagcactcgggaggcagaggcaggcggatctctgagttcgaggccagcctggtctacagcctggactacagagtgagttccaggacagccagggctacacagagaaaacctgtctcgtttttaaaaaaaaaaaaaaacaaaacaaaaaactcacccacctgtgtgagccaaatgcagaccaaaaggaagtttagggagcacagacgtagagcagctgtgcccagctccgcagcatagcccatctctagattggaaaggatctggagccccgtgtatataacttgctaagtggcagtggctcatagccagggtagttcaggattgtttgcacattgttgccctggtcttcctctagccctgtgcaggatacttcatgttgctcataagaggaagacactagttctccgaggtcatatcaccttgcgagctaagctgagctaggtccccaggcaccatgcccagcccagtgttgtttcactgcctccggaccctggggactctaccctttctgacctctatttcgcttctctgtctcagaatggacccattccttctctgtttgccacaacctaccctctatggtcctctccaaacaccattgtccccttcacttccatatctagaagttgactgtgcaagccaggttaaactctgtttccccctccacagcctggtcatccctgagctggtgctggcctgcctctccagtcagctcctgagccacccactcaccctttctgctcgtcaataacagtgtagctctaggcctggagcaccatgcaatagtgtttgtgaaattgaattgagttgaacttatgtgaactgaattgaattaactttcagacagcctcagcaggcagaaatgcagatggcagacacatcagccgtgggtgtgactctgatgttctgtctcctgccttgcaggtccgatgtgcagctgtatttgccctgggcacctttgtgggaaattctgctgagaggacagaccactctaccaccattgaccacaatgtggccatgatgctggctcagctgatcaatgatggaagccccatggtccggaaggtatgtgggtgccagctcagtagctgaagtcctgaagtcggggcccaggctgtgtgcctggagctgagccaacacaaagggcctcatgtccctcatatgtgcatcatttgatcttaaatgtctgcccaactcttttcacagtgtcttcattgctcatctctgttcacttgagggtactgagctaactggctctgctacagcttttacacaacagccatctcctgacacaggcacatggcactggctctctaaagggcagtatccccctatgtcaccttccacttgccaacagcagagtcttatttctctgctccctaagggtcacacctccatgaaaagatggtttcacatgaccttgattcccgacccctgggcccaagccaacaaggccttgagggaaaggctctgacttcctggccgttcatggtggagcagaggctgtgtgtgagatgggcagtccaaactattcacaggtgactccccatgcgtgtgctgccacagagagccactgggcttccttttcagcattgcttgtcttttaaatatttctttctattttatgtgtattggtatgcacattgccttcatatatgtctgtgtgagggtattggatcccttggaactggagttatagacagttgtaagctaccatatggatgctagaaactgagccctggtcctctagaagagcagtcagtgctctcaagcattgagccatctccccagccccctcctcagcatttctgagtggcagtgttggctccctttgatggtggaccttgggaggttgggtgtggctttggattatcctgaagaacagctctgtggctaatgtgagaatgataggcttcaccagtctcaaaatgtcggggtatattcatctcctgcctttctgaaacttacccgagtacccccatgcctcaccttcttaaaagatttttaaaatgtgtagtgagaagccagacatgataatcctatgagtagctgagtctcctattaatatatagattccccatggggaagtcacctgtgggctcaaagtagaacccacacttgtggaaccccaagatgaactgtcactgcaggtctgcaggaactaaagccctttcagagaaggtatgctcacacacacaggaaccgagtgtcaaacacactagggaccaactgtccccactcccagcctcatcctcttgctgcccgccccactctgccagactgctgggctgtgggctgtgcatggcatgatcccagtggcccccggaactttgaacaagctcctccctgtactttgctggttacttgctatgcacttttgactgcctgggtacaaggtgccccttggtaacttagtccccaccacaaatcagggagtacagtaggccaagttagatgagttgatatgctgaaatgtgagggaagggatagagaagagtcctaagtcaggaaagcttgggtgaggggatatcaccagcagtttgaagatgccagcatcaagaaccacatgtcagggctaagaagacagctcggtgggtaaacactcttgatgccctgcttgaagacctgagttcaaatccccaaccagagtttctctgtggcacacatgtaagttctgcttggctgtgctggcctactttctacacggaagaagaaagactcccaggaacaagctagtcaaactggctctgcctgaatatataaggcagagtggtcaagaaagaccacttgacgtcaggctccagttgtacgtacaacacatgcactggaaaggtggctgtctgagtcctgtggaagtctttcatcccagcacttggaaggcagaggccagcaaggcagggctggctgctggctggagtgacagctcagagggcggggctggctagaatgatggctcaggttaagagcactttccttaaacagcaatgctatttttaatgtcttttttgttttgttatatttatttatgtatatgagtgctctgtctttctatgtctgcatgacagaagaaggcatcagatcccattatagctaccctggaggtgctgggaattgaactcaggacctctggaagaacaactagtgctcttaaccacttagccatctctccagccctgacttgctgctcttgcagaggacatgaatttggttccaagcacccacatcaggtggctcacacaggtagtagctcacaatctcttgtaactccagctttggggatccaacatctcagcccccctcacacccacagtaatgtgcatataactcagcaaactcataaataaaaattaaaactaaagtaatattttagaaggtggacatacggggctagaaagatggctcagtggttaagagcaccgactgctcttccgaaggtcccgagttcaaatcccagcaaccacatggtggcccacaaccatccgtaatgagatctgacgtcctcttctggtgtgtctgaagacagctacattgtacttagatataatataaatgaatcttttttaaaaaaagaagaagaaggtagacgtacacttgttgaggtgagggcagtagcaggtaagttgtagtttggtgagtctttaaggttgtaatctttatttttgtagagtaagacagacccagccgcccaccttcctcagccatgtgtctgggtcaaactcaaactgatgtaaattgtcagagctcctgccaaaggaacggagaccaggggctactaggaagcaccgtggaggccaggcccagtgctgctggggatgtgcagatctgcactggttagaaaatctcagcagtgtagagcacagagcccatcccacaaccatgtagcagtccgagttgttcaccagtgggtgtgtgaggcaagggcccgtgtgcgcagcctggcacccctctgagcattgagtaaaggcatcgcccattctctaactgaggtctcttgggcagaccttctgtgtgttcagagtaaaatagaaaatatttagtacatgccttctgtcatcaaagagttgctctatgcagatgcagagagcctttgtcctcctgggcatagtaaggacactcccgaccttttccttaagtcacaacctcacccctggtggccttttatgaaccaaagtggtgatgctagattgaccatcagggcggcagcagcttcttccgctttatactggcatgaagggagaatgggaggtttctagacagatggctcttcttccccagaggggcctggtgggtatcgacttgtggggtctgtctcagaatccttatccctgacacagatagaattagctctgtggtgatgggtcaggcagcctcaggttgacagtgtttgggaagactcagtgggccctcacctttgctctagtctacctcagcatctgaggatgttgaagggaaggtagagaccaatgcaagcctctggcccaggcgacttgagctgtgggtccctgggcataattgggaagttgcagtgggtctgagtgcatagcagtttcccatcatatccatggtaagcttgaggctttgggacacaaacaaagctactgtaaagtcagcctggagctaagagaggtgggagaagcaaaaacgtgtgtgtttgaggtgagagaggacctcagctcaaggaggcctggctgcagcacctcagcagacctcgggcctggctgtgtgagcagacaagggtctctccagcagaccttagttttctgcagacagctttctctttacagagaccactgctcatgttgacaagcttacagtccttttggcttccttttgcctttctgtctataaacatttaagttgtggtgctaaactatcataaattgtgtaaatcctgtcttctcagactcaggcactgagatctagttgtcattttaattcagggacttttctcattcatagttactggaacccactctagctaagttagcttcttgctcgctgtaaaaatgcttcaccctcatagatttttatgccctgggtttcctgtttacccccagagatgtggcactgccgctaccaccatctcctgattctcatcatgtctcccagtagtctcttcctctgtcttacccttacctgatttaaccagggagcctgcgtgggactgaccaagccctgcacatatatattgtagttatgtaggtagcttggtcttcatgtgggactcctgatagcaggatcagaggctgtctctggccctgttgcctgcctgtgggccacttcctctagccccagtaggaaggggtacctatgctgcagcttaatgccagggctggctaatgtccatgggaggtctctccttttctgaagagaaatgggggaggaatagatgaggggaggtacagggtaaggactgggaggacagggaggagaggaaactgtggtaggataattaattaattaatcaattaaaaagaatgcttcaggttatcaactgtacccacctatccattggtgggatcacaagaggcagtttgaggctcggacagggccagaagcctaatcgtaaatatttcagggaatgtaattcacattcagaaagccttggactgataattggtgcctagcaatgagcgagtagactaaggcaggtgtgcctgctttgggagacccctctcgacagcccctggcctgctgcctccacagcccccacctcctctgcacttgtgctcccagctgtgcagccctgttctaaccggctgcctcctggagccgacttaggcattagtgtgcggatctgctgcccagtcaatttcctgcctctgtagacgtaactgtcaactgtcgcttctccctctctacaggagctggtggtggctctgagtcaccttgtagtccaatatgaaagcaatttctgcactgtggccctgcagttcatggaggaagaaaagaactaccctttgccttctccagcagccacaggtacaggggttgctgggagcctgggacctccttcttggccttcaccaggacaatcagtggcctgggttcagccaggccaggtctgagcatggctctctgatgcggtgtctcaggcctttagaagggtacacgtaggggagggtgtgggggacttttgggataacattggaaatgtaattgaggaaaatacttaataaaaaaaaaaagggtacacgtataggaaaagggccgtgctgaccctcttactgctccccctccttcttacccttcttggaattcaaatttggggacatcttgaaagatggcccacctctgcagtggagcgtgctgaaaagaacattagctgtcttcctgtgatgagtaattgaatcacattgttgtcggcctcatgttgccgtgagtcagggtaggaagcatctcttctcacatttgtccttttcgctggagagtacagtcatcttctgtgttcctatttcattgcccctccctccctccgaccacaggaaagagactcgtgactgataacaaagcatgcctcctttccgtctcttgggaaggaagtgaagccgtggctggctggaaacagcagtaaggtggaggggcagccaccagaaggctggggtcctgccaggtgcagggtgctgaacacccctctgtcactgcctgtgctacctaacaccaagcgcctcagagctactcttccttcggtccatgctctcctgggatttagtactcaatgtctacaaacagtacctttgaccaactaaggcccacactcacaccagggagtgacagggaggcccttccacagtccttcttgtctcaggaacaccaatatccctgttgccatggctgcagactccagcattcaccctgctcccatcctgaaccccactgctaactcttttccttaccccctctttcctagagggagggagcttgaccccagttcgagacagcccatgcacccccagactccgttcagtgagctcctatgggaacatccgagccgtcacgacagctaggaacctgaacaaatctttgcagaatctgagcttgacggaagaatgtaagattccagaaactagtatttggggtgggaaggtttggtgcgctcttcacagacatttatcaaaaatgctactgtgccccttgaccctgccctccagaatatgggcctgatgtcttgtgtgccagagtgacaagtgaccagctgttcttgagccagaatcttccttccagatgtgcacttggcaaagacctggtttaacatccagatcagtcaggccagagtgcgtgcgactgacagagaggcccaccagtttatgcacacacatgtctattagtttgcttgtgtgtgttgtacatgtgcccactgtgaagaaagctcacgtctcagacaggccattaactgtaagaccctgacctccttcctgtcacattctggccagcgggcagctcagtggccttctctcccgggaacctcagcaccagcagcagtgccagcagcaccttggggagccctgagaacgaggagtacatcctgtccttcgagaccatcgacaagatgcggcgtgtgagctcctactcagcgctcaactccctcataggtgagtcctcgccgcatgtgatgccttttctgatgcctgcatgtcttcccttgccaagggtttgctctatgcagaacagcacacgccttagtttggtcagaatatgagccaaaactctctctactggatgcaaaagaataggaattaactggagcttgaagaagtgaggagagcattttgcaatgggactgtattttacaggctggtccagggctatgtgagcttgctggctctgccaggcaggaaggctgccagacgagtccatctgtctttctctgtattcctcctgtgtgctagaccctggcagtgatgagcggtggctctcagctaagacatcctgcttatctcagccaggatgaagtgggtgctctggtctctggtagggagaagccaaggatgatgttcactgtcccagtgcccaggagagccctacagtaagcagtgagaggtcaagagcctgatgcataaggcagagggtgtcaagagtcctgacgggctctccgtgctcacctgctaaacctctacccagactagcagcttgacccttcactgcctggaaactggggtttagtggccagtgttctctgattcggccatgagtggtatccctggactttgctaggagatgagaatcagctgagttttcttgctgtgtacctgtactcatcctcagactgtggagttgaaatgtaagccccctaggtccgccacacttctcatgtggttcatcttggtaagaccctgtgtgacatgcacagtgtagcctggggccctggaagcttcctcaggctcaagggctgggagccagggcctattacaggcaagctcaaccttcttgtctggcaagttaatactagtgttgtcctcagttttgatcttggagatggcagggttaaagacacacaccagcttacaaatcagtgtgagaaggtgacaccacatagatcccagtgtttgagagggtagtagaggaagatgaagcaaacacatctgggctcctatagaagctgctgagccccatttgctgtggccctcaactaaactctgtatctcagtgtgtgactgtgtctgtgtgtgtgtgtctgtctgtctgtctgtctgtgtatctcagtatgtgtatgtgtgtgtgtctgtgtgtgtgtatctcattgtgtgtctgtgtgtgtctctgtgtgtgtgtatatgtgtatgtgtctgtctctgtgtgtgtgtctgtgtgtgtgtatctcagtatgtgtatgtgtgtatatctcagtgtgtgtctgtgtgtgtgtgtgtgtgtatgtgtgtgtgtgtctgtgtgtatctcagtgtgtgtctatgtctgtgtgtctctgtgtgtgtgtatctcagtgtgtgtctatgtctgtgtgtctctgtgtgtgtgtatctcagtgtgtgtctatgtctgtgtgtctctgtgtgtgtgtatctcagtgtgtgtctatgtctgtgtgtctctgtgtgtgtgtatctctgtgtgtctatgtctgtgtgtctctgtgtgtgtgtatctcagtgtgtgtctatgtctgtgtgtctctgtgtgtgtgtatctcactgtgtgtctatgtctgtgtgtctctgtgtgtgtgtatctcagtgtgtgtctatgtctgtgtgttcctgtgtgtgtgtatctcactgtgtgtgtgtgtatctcagtgtgtgtctatgtctgtgtgtctctgtgtgtgtgtatctcagtatgtgtgtgtgtgtgtctcagtgtgtgtctcagtgtgtgtctatgtctgtgtgtatctcagtgtgtgactgtgtctgtgtgtgtgtgtgtgtgtgtgtgtgtgtgtatttgtatcattcacatcttgggaatttggatgggattgcagctagagatggctcagtgattcagagcactggctacacttgcagaggactcggatttgattgccattacccatatgggagctcttaaatgtctgtaactccagttacgggggatcttatcccctcttctggctatgtaggtaccagatacatatatggtacacagatacatgcaggcatggcacttatatacacagaagaaaaaacaaaatttgaaggaggaagtttccaagtgagtagattttgagaaagagaagaaaacatcaaccttcctcctggccagctttctccctgttcagtgtgggggtgcccacgcccacatggggacctcagagcttatgtagggctaagacacataacttgcagaatccattcctggcaacacgtgcctgtttaaagccaatttctcctttcatttcaaccaaagaatagcattttctttagcccctttctctgcatgttgcagaagaggttttaaaaccatggcaacgtggaggacatacttacacgtgttcacacaagagcagctccctttcagatgccctgtcctgtgcccctcccaggtctgctttaccagagtgctccctgaggtgacctgctctctggctctatggtcatctggcatacagggtctggcccagtgggtgcacagatctgcactctgtgaatatgtagatcttccacatcaccacttttcttgttttcagtcagttgtgcccaatgaccacctagatctcctaatcgcccctccctccctccccccccttttccgggcctctttccctatggcacacatgtgcctttgatctaattgcaccatgttcctgtctgtggaccctgggaggttttggcatgccaggtgaggctggactcggctcatgccttccttcaataaggatctcagctggacagctctacagtgtgcttcttgggctagcctctagcccctgggagacttgatgtaacctctagggctcagagcaaggtagtcttgcgagggcagggtccttgacagagcatctcggttgttttcatgctcttcttgacctagctgtaccaagactcatggctgtcatttttattatctaatttctcaagagtggtcttgattgttattattggatgtgtgtgtgagctgtgggtatcttcattgctccagcacacgtgtggaggtaagaggacagctctgcagagtcagttctttccttctacatttcatgggttctggggttgagctcagctcatcagggttatactggaagtacattctactgactgagcggtctcgccatccctaaggttgtttcctgctgctgtaatacagtgagcagccttgcctgtcctggcctgccacctcgctccctgtgttcctgaggctcgcccatgagcataggcttgcccagagtggaaagaatctgaagagggtgtggcagatccgtgggtccctctacagcaccctccttaccccttgtcagtagtgcccactgtgcacgaagcccatgcccacacaaatctgaaccctggccacagatgccctgccaaagctccagccccagcagggaaagtagtgccattgtgtacactctgtcttcctgcctgtcaactctaccttcatcagagactcgtaccaagagagagaaggatatggtctcacttcaaagccactgggagcctcagaggacagggacagggtttttacaactctgtgagcagtgacattttgtaacgtgttgaaaatgcatcaccatggtaacaaatccaaggtagagctaatactgaaggagtgagaaaaggaagagtcagaagcacagagctaccctcaccctcaccctcacccctcaccctcaccctcaccctcaccctcaccctctgtgccagcccagagccctgatcctgtgttcgttcctgcgggagccagcaaccccagagcctaagcctgggagactggagtgggtcagggctgaaaccccaagctcctgcctcactcagacaggggcaggatgactccagggagaagacattggccaagagcccctgtgaggactgctcagtcagcattaaggtgacagacagccattagccacctctgttcttccctattttcctcttgttgaggagtcaggaagcacggcgagccttttcatcccggcatagtagtgacctggtgaggccctgagtgtgcaccaaggggcagaggctacacatgtgtctgccctaactgagagaaatccagcagggacttgctggagagagttaatgctaggaatgtagctcagtgggggagtgctcacctatcacacacagtccctgctgtggtgaccaaagcttagtgggtcatacgaggatgctgagggtcaactacaaagaccatgcagatgttccagggtcactggagataggaggccagagcagtgggtcagtataacaccccccaaaggttctatacattaggccgacagcttagactcagaagggaaggtataactagatttactctgaagcaccatgacaggcgcacaaggaagaacaaatacaatggccacatacacacgcagccaccaccacccaccaccgccagccactgccaccactcccccagccctgggacctgtgtttctaaagactggcagaagtcttggccatttccagatcatcagaggacctgacctcactctgccagctcttcaagccctagatgaggactcgcagcctcgtgtctatacagtcctttcccaataaggctctgaggttcagaaacagctgcagagctctgagagactgcacttcaccacatgctattcagaaagctgtggccactgctctgaaaatcaatcctagaacatcacggtcttttattacttctagtctagacatgaaaatagatccttagcccttctagagcttagcaagtagcaagttgccggccaggcccagttcctgcctctgctttgaggcagaacccagtgtccttacctcagtcccatgggccctgatccgtgtgtgagggtggcaggttgtattttggagatgttaagacagggcagttgatttggcaaggagccagggagaatcactcctggcaaatcagggctgatgtgaaatcaagaggtaatttgtaaccacagcttccctttccactaaaacaactgtgcctcccatcccagtcagagggtggtaaagcttagagttgtgttctctgctacggtgtcacacagagctcaacatccacagtcagcccagtcattgaaataggctttaaactacacagtaatatttacaagtgtctccctttctccatgtcctgcacattgttagacttttctggcagtgttctgtggggttcctgattctaaaggactccccagagttctttattctgtatctgccaccccagcccatgaggccacaggggctttaggactccacctgtgactacctactctgttcagtgtctgctgagtttggtcagtaagctgagggagggagggagggcctgagccctcattagtcacgcaccagcccctccccagtctgtgacgtcagtccgtccgacatctgagtaacacggttcaccagaagcttcgagatagatcccttacagcttggtgccacgtggcaactgagctttgcaggaagcagcgtgtcactccccaggaggatgcctgagagtaccagaggtagctgtgtgagcacttgctgtcgcttagagaggcgctgccaactccatctgagtggccagttccctgtctctcaggggaaactgaaagcagaacatgtggccctgtctctagagtacactggaagccacctccttctcctctcctcagctgctgcttagcaactccatacctcagagctggaaatcggatctgaggacatttcacccagagagattctaagctgattgtactagttttcttagactttacttgtaaatctagcccagtgtttggaactgtagagttttaagttgaaatgtcagtcctctacttctgagttgtagccacatgagagagcacggagtgagaaggctgctttctttggattttcctgccactgtgcaacccaagctacattcctccaccacatccaggcttatcacaggcctaggtctcctggcacatgtgccttcctacttactgcttcctgggctcactggaggcttagaactactgacatcgagtctttgcagtcctgtgttgtcgccttatagagatgcctgtctcagctggacacatggcgtaatggttaggagctctcagtgctcttgcgggagatgtgggttccgttctcagcacctctgatgcataactccaggtccagggatcctcctttgacttcactcggttcttacatgcacatggtgctcatacagaccttcacacacacacaccacacataccacacacacaccatacataccacacacacacaccacatacacacacaccatttttttaaattaaataattattttttaaattcctgtcttaagacttagcccctcagtgacaggcagaaatgccttactcagctcaaaagagaagctctgtattcaggagctgaggtgcagcccacttgacctcggcaccctcttagtgagtgggtatacatagctgccatggctcaggctttgccctacacagcccaggattaatggaagggaagttggattcacttcccatctatagatgagcacgcaagtcagcagtcattagagagtggacaagcagagctcaacaagtaacaaagtacatgtagagagggcagtggccacagctgtgcatcccacataaactgtacatctggccatgctgtcatctaggaacctagaacgagggaggagatatgcgtgggaaactaggtggtattctctaaacaacaaagttatccgagtgcagaccattttttagccattttcctttagaaagccctgtcatcaaaagatgagacctgcctgccaggcatggtggtgtacccagcacatggaagacagaggcaggtggatttctgtaattcaaaggtagcctaatgtatatagtgagtcccagctagccttgatatacaatgaggtctgtttcaaaaaagggatggggggaatgagacctgtatgataaagcttgtttactaagagaattctttttaactttgtgtgtgtctgtgtatatgtgtcagtgtgtgttagtgtgtatgtgtgtgtttgtgtacatgtgttagtatgcgtcagtgagtgagagagagagagagagagagagtgtgtgtgtgtgtgtgtgtgtgtgtgtgtgtgtgtgtgtgtgtgtgtgaatgcaggtgtgctatgcatgtggtagtaagagggaatcagtcctccctttcatggtgtgggttctgggatttgagttcagtcgtcaggctcaatggcaagagacttcacttgctgagcactgggaagctgcctgcagccccagctctaaagtcctccttcctgtcagcatggggtgctcagaaaataaactacctcaaaagccaccatcacatgcacagggatggagctacttgctactaaaagatctcctgtttgtttctctcttgtaggagtttcttttaatagtgtttacactcaaatttggagagtcttactgcatctggctgctgatccctatccagatgtttctgatttagccatgaaagtcctcaacagcattgcttacaaggtatgtatatgagagatcgtcactgaagtgctcacagttttgcttctgtgtgaatattcaaataaggagctccagggatatccaggcctacacaacaacagcttaaaaaataaacaactttaagcaagcgttttgaactcaaagcttcgtaagtacatccgaacttcacttgcattgcagcttcagtcgtaaaggtgtgatctgtagtgatttcccctcctccactctgggctttgtgcttgtcgatttctctgttattttcgctcccagttgacttgttctttcacttgtttctgtcctgagcttttttattcttctaattctcatttctttcttttttttttttttttaagccacactgcctctttttttttttttttttttaaagatttatttattacttattatatgtaagtacactgtagctgtcttcagatacaccagaagagggcatcagatctcattacgggtggttgtgagccaccatgtggttgctgggatttgaacttcagaccttcggaagagcagtcgggtgctcttacccactgagccatctcaccagccctctttcttttttttttttaagatttatttattacttattatatgtaagtacactgtagctgtcttcagacacttcagaagagggagtcagatctcgttacggatggttgtgagccatctcaccagcccctaattctcatttcttaaagcatactcttctttggggattagcacctcctcccattcctttttatgagaatttagcctaatcccaagactgaagagtgtcaggcagaagttcaagagactcccctgtactctactctgaaaatcctatcccctctctgcccccaccttttcccagggtcttgatggttctctcacccctaaagcattgagctcctgctgggttctccttctgggctctgtgggtggatactgctggaagtcacttacccccataagctgggataattgtttttgtttcccatctataaaggatctagcagccactgtacatgtggtttctgaaaacatttgtttggtgtttttctatttgtttactaagttagacagttcagctttcataagtggcacaaactagaattcatatgaataaaactttttataactttttcataaaattttgagtttgcaaggaaagggcccgtgcctggtgttcagagggtcacttaggtggaaagggcaggatctgtggctttcccaatctaatccttgtttattcctgggaggtatggagccctgccctggtgctgtctgactgagcagcggtgcttgcagcagccacagctgcagctgatggcctgtttgctgctgccagctcttccctgcagatgtgttctgggcgcctagttctggctcctccttggctgattgaaatgtctcactgactgcagttgctacttgctcagccctggtagtgtcacacgtggtagtaacagcctccctgcacttttagattccgggctttagatgcaagatgaaactacacttgtgagcatcctacgtacagacttgttggaacagtggagagtttgctgttttactgcccagtaatcttccagctgaatgcccgagtgttgcctgggatagtccagccttactctgtccaacccctgtggtaccaggcagtgacccagtgaaatctaaaggttttattgtttaattaaaaaaattaaacagttattacagtttgtatttgttgcacattatggtatgaggccaaaggaaggcaggcaaaaggaaaacaggaaacaaggtgtgtgtgtgtgtgtgtgtgtgtgtgtgtccccatgccacagcacttgtggagatcagtggacagggggaactaaattgcttctccatttctattatgtgggtccctcaagcttgggtctttaaaaaattatttctagtgtaatcatcctaaaagtttatgtggacatgaagtctctgatgtttaatgtatgtaggcagttctgtcccttcatcacagttcctgacacaaagcactctgatggcttagtctttgcccttggaggcacaaggcagcctcctgacggccatgcttaacccaggctgcatagcttaggacttgcactgagggagttctcacctggttggctcagcatctagagtatattggtcatggcaagtcaggatacagctctctgtatttatctttcagtacattgatgtatttgcccttacagatactgtgcctgaattatttaacactgtaatcctggtgcctgatattgaattcatgactataagttcagtgctgcagccttgggtgttaaacagtatctttttaagagcttcaagtgcacagagcagtaggggtacagctttgacctagacctgggctttgaggttgtatttcatgaatgcagctctgagctgggagggtgtgtactctccactgtaaagtaatgtgcctcctgactactacctgccatggtagcaagctatagccacctgagaagcagccgagcactctcagggcagcactccataaggacccctgagccccagcaaagctgaacccagcaaggagtatttgcctgctgtgtctgctctgctacagtggcaaatcccagtgtgcacatgccaacagctggaagcacaccacaaatcccagtgtgcacatgccaacagctggaagcacaccacagccagggtttcagagaccagcatgggctgcccttgggaaggattcgtgtgtgtgtgtgtgtgtgtgtttagaataagcactgctgacgagttcaggaacataaacattatggaaatttttttgtgagtcataattttaatagatgccttattttctcctctaggaactaaagagattatatttcactttataaagaaatgaacctattttgcattatttaactctgaggccaagtttttgttcatcagagtcaaaacgaccttattactgtgaaatgccccctagaattctgcatccaaatatggaagttgctactagctatgtctgaaagaagccacactgcctgacagtggcagcctgatcgcacatttgtacttttccttctgaaagtgcagagaacagctcagcttcatggagccttctgtggtgccatcagctgttttctgccctctcttggactgagggtggaggaggcagagctgagatccagccacagtgtgagggagacgcacatgcagtacatgcagcctctggatctcaccttcccaacaggcctcggagaccaggcaccctgcaggtcagacagtcacccttaaccagggggaaggctcacacagcctaaggaaaggaagactcgggttgtcagtcacataatcaaatgctccactgaagaaaaggtcactggctggggatgtggctgttggtagagtgcttacctagcgttctcaaaaccacaggcccatccccagaatcacagaaaactaggagtggttgtgcaaacctataatcccaacactcaggaaatggaagatggagggtcagaagttcagggtcatcctcagctagcgcatgagttcaaggccagcctaagattaaataaagaaatggctcaaatgaaactccacacattgttctattaagcatgttacggcttagcctctcaaggaggtgtaagcaggagaacgtgagtgtgaggctctccctccctgtcccccgcttcccactgtcagtcagtacttgagcaccacttccaaaatgccctactctcaccaggtagtgccgatcccagaccatcgagactgggtggggacattcagtgctaggtttctgaggtcccctcctgtgtttgactttgactcgtacagaagtctgaatgttcttgttggaaacttgtgagagcactgagcaccgagcaagaatgccttccagtgtgccaccagaagtcaccagcccctcttacagggctctgaacatgacaaatgattcttgttgcggaagctatgggcagagaacacttgcattgtctggcaggccactgccaagctggaaaccatggatcctatgtccatttctattccctgaagcacccgtccctgtgtcctgggcagagagagcccctgagttcctcagaaacctaccccctaaagcttctgtctcccatcacctcctgctgatgctctagaactcctgagaaggcaaagtctacagctaaactcttctcccttgtagacttgaggactcatatagctgtcaggctagggacaggggggatgcccgtagagcagcctgggaactttaaatgccaagcaaacatttgggcagcatgcgcactactctcacagttaaaatgcagtgcatcgcttaaggactggttccagcttcatctgctacttgtattaaaataaagccgagggttgtctgggaaaaggaagctgtatgcataaatgatttgtgtctgattgtgacattgtaggggtggtgttccaggtagtgactgagtgatttagaaatgtaagaggtctgaacagtgacctcccagagcagagctctttcaactgaaggttccatggggctcaccttctcccctgagctcctagatgacacaacctgctggtcctgtgctaatataggggccactacatcactcggcctttgtgaagctgctccagctctttgaagagcagagcaggttcctgcaagcacacagtctgctagttttgagagagaggtcagtagccaccttggcacaggagtattgttgacaaacacgcactcagcagtcctgcccatactaaccaaagcactggccgcagtgctgtacctcggactaatgggaagctcctacacaggagctcatgggagctaatgggactaatggggagctcctacacaggagctcagaccctgcagatgtttgtgaacggtgtgccagaacgtgctgtgatcttacttcccacggggctgtgtttaaagaactgattgaacctgcctctgaaacgtggaaattaaaaacaggccaggtcatgtcttcccctagattctaagtccagagtggccacctaggactctggtgaagctggctgcccagtcagcaggccagacctggcctccaacctgcctcaccctactttaccagtttgcccttttccctagtcatcttcttccctggaaatgaatatgtgcatccttatagtgtgtgagcatgaaggaaagtgtgtgtgtgtgtgtgtgtgtgtgtgtgtgtgtgtgtgtgtgtgtgtgacaagagtgatgctctttatctggttctggggttctggtggagcccaggatctgtcagatactaattctgtactcagtcatcaagccacacccaacccagtgagttaatctgtgtcgggggtggtttgttctggggtaagtgaggttcccatgcgctacctctcctgcctctttggttttcatgaacccctttgaggaatacaggacgtttgtgactgaccagcagccacagttctgggctgtctggtgatgtaacactccagacagacaacagcgtttcctgacccctcagtacacctgcctgagctgcagctgcctcccccgagacagagccagtctgggcccctgaaagggccacctcatggctctcagatgagaggaagacagtactgaggactagccccaggtggccttgaagcaggggaggagccttgaacacatcatgtttccgctgctagagcttctgccaagataactccccagcctgagcctcacaggctgtggtgaatgaaagagcagtccctggtcctctgtcacccctgggtgtgtcgcactgagggcttttgacctctcttgtcattcttcctttgctctcttaggccacagtgaacgcccggccccaacgaatccttgacacatcctctctcacacagtcggccccagccagcccaaccaacaagggcatgcacatgcaccaggtggggtaagtggcctgccaagcccctccgcccctgtgctgggtctccgatgccaccgccctgccaagccttgctttcctctccttcccttctaacatttccccttctccatctctttccctttgtcctttctctctagacacacaagtacatgcggatgtgtgtgagctccgggcccctttctagacatctttcctatcccaggaatacttcatttgcatatcatgaatcaggaaaagttgaatgaagccatatttctatgacctttgggatttttttttcccagaggccataggttctctatgtaggtgtgcaacaggatgtgctacacagttgctgctcaggaagcagtatgactagcccaactgtgactgcacacaccagctctatgtgactagtctgaggcgactggtcacaccagctctagattgtgttatcttgtcctcataaacatttgccagggcacatccagcaaggacagtcctcactcagctttggcaagtggcaggccaggcagttgaacattccccgaggtgacattatcaagggagagagcctggatcctcatcactacagagtaatctacagtaaaacatgctttctgctcttctctcaactgcagaggctccccgccagcatctagcaccagcagctgcagcctgaccaatgatgtggccaagcagactgtcagccgtgacctgccttccagccgcccgggtactgccggccccacaggggcacagtacaccccctcactcccaccagttccctcgaacacgaaagatgtttgacaaaggccctgatcaggtacaaaggcctgagctctgttgcagcccttgcgccctgtaagcgctcagtgtcagaacagcgtgctggggactttgctttcctgacatccagcatggtaccttagtttagggtcattccactccccacaaccctgtgccagccattgccttcaagacccttggagacacagtggcacccaggtccagcacccctctgtctgcaggtctagtctccatgcagcacctcctccctaggttggcttatcttggcccctctttgagtcccagttagcacgtggagttaactcacttcttccccttcttaggtaaatagcatctgtctccacttgatgtagctgctgctcatcagggttcattgtgaatggcttgtttggttttcctataaacatttgattattctgtacaagcaggcacactccctgctcttaactaagctgtcagaacagtttaggagagaggaatgtgctctgagaggcacagagatggcacatctgtcagccagtgcacagtggagaggggtgctcaggatgtcccagcagtagagactagcatgactcactgtgtcatctaaaaggtaaaggaggaaccacagcttagagcagtagcacacacctggaatcccagtactcaaaatgcaggccggaagaccactggtgttctttctgtatgacaagtgagactgaatccaaagaaatgtaggcacagctcccttgtaggttaactgtagagcagaatcacaatgttagtggctagcaggccatgtggcagccattgatatccccacccccaccccttaccagtcccttacccctgccctggacagctccaatgactcttaagcaccttgacagccagtaagttccgagtacagtcagcatcctggttgacccctgacatagctgggagcaggtggagaggactgtggtctaggggagccatgcaccaagtagagggtctatgcaaccttccccacatcagaattctcaaatggagccaaagctactgcttccaggaggccagtgagcccatctcccactatgacccctgagagtgggaggccctcaactgccaacatgcagtctgggccatttctttagccctggactaagcacagggcactggcagagggcatggaaggagaagacggctgaccctggtggccaggacctccctgctcccgtagtggagaagagtaaagtacagtcatttgagcctcatttgagctctgactcacctgcgcttggctgtgcctttgtcattgttttctatggctgatgaaggacaacctatgctggttagcagggacctggcacagacacatgagctgagcacacaggcccgcctgcccatgtggctcaggtaataggagtcagcgagactgggctggccatggggaacagcaaggcagatccaaggtcctcaggagtactaggcaagcactcatccactgagccacacccagccttgaccctgcttctcagtcagcacccagccctgcccaggaacttcagactgcagtgagaagtgctcacctggcacggggttgttcactgtcactttctcaagtaaaacaagtagaggatgccaggctcacagtcatgagcgtacaatctcagcactcaggagcctgaggagcaagaccaggactccaagccagcctaggctacgtagtgagactgtttctcaaaaactaaagtcagtacaggaacaatgagcctaaagtgttttctcctgattctgctctctctcaagaccacagatgatgcagatgatgctgccggacacaagagcttcatttgtgcctctatgcagacagggttctgtgactggagtgcccgctactttgcccagccagtcatgaaggtgagtgcttagtcctgcacagcctcggtgcccccggaagctggcgtcctcttgctgctttctcactgccacgtgcccttgctgctggttcttgttccttgttcctcggacccatcctgtccctgtctttggcttgctgagccctgttagcccagctgacctgagcagatggcctgggatttatgagcggagttggggctgtgctcgttatagtcagcctcaccttgggttctgtggctcctgtcatactttgcttactgttggggggtgacagcaaactgctgtcatggtgcaggtgtcaacacctaagacaaaagagccaaagtcctcctgatttctcaaagaaagcacaggcaaagccctaccatctagaacctgccagcactccatgtcaccgtgttctcactggcagggtctaactctgtgttggagttagagtgagaacatgagtgtgaggctctccctccctgtccttgagctgtgcttggtgactgagtactctgggacaatggggatctgcaaagctgtcttctggttcttgctctgccgtagctctcttgataccaagcatgaaaggtagtattgtaaagaaatcagcctgcaaatcttccaggtgtgggagtcaagctgtaggaacaagacaaggcccatagctgcccactgaccttacttcccagtaccatgttgtcctcacagaggggaacaacgtgcccttctgattctgggacagcagttaagacaggaagtacatggtctggacttgtgcagtgagcaagagctgcccagaactcagggtgggggcactcagacactgggtagagccatgtgggccagcagtttaccagcagtgtggcttcccaggacagtttgtgctatggcaggggaagttaatatgtagaatatagaaacaggccacctgcttccctctcactgtggtggcagtgactgtcagtattggtgactccctgggacactaatgagaagctttctttgaagacattgacaattacttgatctctgccatccttgtgtggtgactcggggaagggcacgggggtctcagaatgcatggcccttagacttaaaactgaagccagtgtgttcccaaagcactgtcctagcgtgagcacaccatggctgagtacagggcactgggtgagcatcctcagatctcagacgctggcgacaatggctaggcctgatccttaggaaggatctactgtgcggtgtgtactgtgctggctcctcagctcggcataggccaatgcctccgtactctcctgcagtacatacggcatgtaagagttcccaccacaggagtcagggacacaaacactgcagagacaatggccaagaagaacccctaggacagtggttttcaacccatgtgaccccctgggggctgatatatcagatattctgcatatcagatatttatattataactcataacagcagcaagattaaagctaggaagtagcaacaaaagtaaatttgtggctgggagtcacctcaatatgaggaactgtattaaaaggtcatagcattggaaggttgaaaaccactgccctgggcctattgccccatacagaagtgacaaggaacatttagcaaataagcaaacgttgttttcctgccgtgctgacgagcctgtcgtcgtctcagcgctgtttggttgcagcctgcagtgacagaggggaagcagggcgtgctttatcttatttgaaaggcgctttaaccctcatgccatgttgctgtaatggtgcatcaggaccttctgctgctggcctgcatacgggagaagtcaaagttgtaaggctgtggctgcctctcaaggagtaaagagtgtcagaggtgtgtaaggaacaaaaacagcttcagagaggaaacgtgtcggtggtgtagcaggtattgcctcacggtgccacagaatgcctaatgaggggcacagtcagaaagcagagactgctggagctcacctcactttcccctttgccttagtccagggtcccaggcttgaaatccctacatctaaggcgggtcttcccacctcagctaacctagtccagataatccattctagtcatgccacagctttgtttccatggagatcttgaattccatcaggttgacaggattagccatcactgacagcagtgagcacctaatggttaggactgagtgtacagagctcatggccagattgcatacaggtcgataggacccatggaagccctcttcctgtgcaggactccacagctcagtatctgctgtgtgatccacaaaacaatgttagtgacagcctgtcctgtacattgaatttagttttgaataggaatgtttttcttctctgagttggcaaatttcaaacactgattctgtccagaacttgcctcctaaaggagagaagaatgcaaacatctaaagatgctgttatagtagggaattgccacgatgccagacaacgctgtcagactgtgtctatccccaagaccggtggcctttctgaggagggcattccactaaatgtgtgcgtgttgctcgtccaaaggtgtgtcatgtaacactgtttataatactcaagaattgcaaaccaaaacagaacattaattaagaacattcatttaacatgccacatccatagactgggtggcaccatatagacattaaagagtctgttttctctctgggcaccatgaacagaaagtgccagcgtgtcggagcacagccctgcacctcaacccaaggcttaaggcacttgtgctgtgcagctcctgctcttggataattatgcacatccatgaatctggctccgagcacattattaagaagtcagaaaatgggaattgtgaggctaaatgaagtcaccgtaatacacacagcttcagcttgattttactacatttgctcaaggtgctgcaaggccactctttcacctcacgcgtgagttctgagtctgtgtagaagcaggaagccctaggctgattctgttgtcctgctgtggtaaagctggaaaggcgtcactgcaccccagaagtgagtgtggcgtagggtggagtcctgactgctcttgactctgcagcacgagggctgaaaggacaggaaggcacctttgtcagacagggttggacgcatcagggagaactcctttatgtaaccatgggtctccagagactgagtggagaggacccaccctcagggcctctttgtacagctgctctgcactgcctgtgtgtgtgtatgtgacatggcctgtaagacatagtaggaagaccaatatcagagataggagcctggcagagaggagcagcatctgtgacagagacaccaacacacacactctttctcaaggacacacctcacaggcccaccatggaaagggagcaggtgctgctatctccagacactggaaactcaagagtaaaagaaaagtcactgatccagactcataaaggagagggaacagtcaccacacagtccacccttagagcctgaggcacaggccctgcttacagctctgcaacagagatcctccttttttttttttttttttttttttttttggtttttcaagacagggtttctctgtgtagccctgactgtcctggaactcactttgtagaccaggcttggcctcgaactcagatctgcctgggattaaaggcatgcgccaccacgcctgcagcagagatcttcctgatcaccaacaggtcagctggccccagcaggaggctcagcagctgacctctgaccagaggaggaagaacacagaagccctgaggtacccacgggagggcataaagcgagcccagctcagctccacacatcagccataagagaccaagctgtttaccttgctctctgccattctgcacattaagtgtgggattcatttaaaaactataaaaagtccaaaattgtcaggtaggcactgtcaagagacagagccagtcataatgggactcaagtctgaggcagcccagatgttggagctaacagagatggagtatgaataactgaatagacaaaaaccacacaacaggacacgtggctcatactgtagatcccagcaattgggaggcagacagagagtattgtcatgagtttgaggccaaccttagccatgtggtgaatcccaagatgccctggctacagagtaagaccttatgaaaaatgaattaaaatactgaggctaatggaaaaaagtggagagtgtgcataaagaggaatttcaaccaaattggaaagtaaggaagggcccagtgaggtggctcagtgtataagagtgctcaccactaacctgacagcctgactttgagccccaaaacctcatgatagaaagagaaccgaatatatatatggctggagagatggctcagcagttaagagcactgactgctcttccagaggtcctgagctcaattcccagtaaccacatggtggctcacaaccatctgtaatgagacccgatgccctcttctggtgtgtctgaagacagcgacagtgtgctcatataatacacatacacacaatttaaatagaaggttgctaggctgtggtggaacacacctttaatctcacacagggaggcagagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaataaaaaagcaagaaggcttacacttctgatttcaaacttccatgttggtgctaattaagtctgtgtgatctggacatgaggggagatgggtagcaaagcatgcctaccatccccactgcgaccataaacacaactcagagacggggccctttaacccatgagctaccacagttcacctgactccagtcctcttggctgtttaaagaaagacccttcatctcctccaatcactcacaaaactttgtggtttaaaatattacattatcaaacataactgctagtttcactagttgttaccatttgattgtgctagcattgtatcgtctccaaaggctcatgcccttgggagccttggtttccagctagtggcactaatttgggagttggtaaaaccttgtgagttctggaggcacactctaggaagatgcaccatctccagcctcttcttccacctcgatgtgagaagcactgttctacgacatgctacctgccatgatgccctgcctcgacacagctcaggaacaatggatgaagccggatgaccatgggccaaaacctctgacaatgtgagccaaaataaaccattcatgtgtagtcccggctggcctggaactcaatatgtagctccagctgccctcaaatttgtagcattcacctgccttagcctcccaagtgcaagaagacagccgtgagcagtatccctgggctcagctcttctgtcgtgctgtgcatgtcagggtttggtctcagcagctggagtctgactgacacaattggcatttctggcaaagctttaaagaagaaggattgagtgtggtacagaaatagaggtgtagactcttcagtatgctgtgtaaaggcagcaccactttgataccaaaaccatgtgtcataagagaacagactgctatccagtggaccccaagtccttcacacagtattaaggaggcaaagcacatggaccaccccatccatcagtcactcagcattaaagtcagcctcctaagtgagaacaggaggatgaagaagacagatgtctgacagccccacagtcattcatgacaaactcagcaaactagagatagaaatgagcctcatttcccttgtgaaggacacccgctgctaaagcaagttgagtaggcttgatggacacaggtgtgctacagagccacctgcatccctgtaaagagcagctagaaattgaagtgtggcatttgcaatgacactacaaaacagaaatgctttggtataaaaaaaaaatcctgaaaattctgttactgtaaaataaatgggagaggccatgttcacaggtgggaatgctcagtggcagcaggagctgggcctccctaggggacacctccctaggggacacctccctaggggacacctccctaggggacgcttaaaccagttcagccccatccaagtcccaggaacactgtttggcacaacaaactgaccagcatgaaatggggagaaaagcaatggagttgcaacaacagctccagggctcacaccatcctatttcaggatggccaagtcagtaatcaggatccgagtggagctggagcacggacagacacacagatcaatagggtgaaacagaggacccagagatggagctacacaggcaggttccattgatttttcagaaaaggtgtgaaaacagcccaatcagcagggacatttcaaagacatagccttgttccccgctcacaccttatcaacaagcagcagagtgatttgtagccctacctgtaaaaccccaaatataccgttttgagtgagatagagcctttaataaggtacaaacgcataagccatgcaagaaaacagagctcacgtgaccatcctcagctacacagtatgtttgaacccaggctgggatacacaaaccctgtgtcttagtttaggtttttattactgctatgaaacagcaccaatgcaacttggagaggaaagggtttattcaacttacacttacacatcccagttcaccatcaaaggaagccagaacaggaactcgcacagggcaggaacctggaggcaggagctgctgcagaggccatggagggggaggtgtgctgcttgctggtttgctcctcatgccttgctcactcggcctgccttcttatagaacacaagaccaccatcctggggatggcaccacacacagtgggctgggccttcccatcaaccactaattaagaaaatgacctacagacttgcctacagcccaatctggtttggtttggttttggggttttttttgtttttttgttttagttatttttctcaattgaggtgtctcctctcagatgattctagcttctatcaagttgacataaaactagctaaccgtggccagcctggtctacagagtgagttccaggacagccaggcttacacagagaaaccctatcttggaaaaaaaaaaaaaaaaccagaaaaaaaaatgttttttgagccggccctggtggcacacacctttaatcccagcactcgggaggcagaggcaggcagatttctttgttcaaggccagcctggtctacaaagtgagttccaggacagtcagggctacacagagaaaccctgtctcgaaaaaaacaaaaaacaaaaaacaaaaaaccagccagcacacccttgttctgagtaaaggctaccaaaccagatgacctgagttcagtcctatgtggtgagaagagagaaccaactctttcaaggtgtcctctgacttccacatgtgcaccatggcacatgtacccacatatatatatatatatatatatatatatatatatatacacacacacacacacatacatacactcatacactaaaataaatgtttaaaaaaaatgggggtggggtagggagtggaggctggagagatgactcagcagttaagagcactgactgttcttccaaagatcctgagttcaattcccagcaactacatgttggcttacaaccatctgtaatgggatctgatgccctcttctggtgtgtttgaggacagctatagtgtacttatatacataaaataaatcttggaggaggaagaggagttgcttttcattaagaaaatgaagttaatcaggtgtgctggtgcactcccttgatcccagcaccatgagagcagaggcagtcagatctccatgagtttcatgccagcctgaactacagagcgagttccaggccagccagagttacatggtgagaccctgtctaacgaaatgaaaatatgcagacctggtggtacatgactataatctgaggtaggaagaatgcagggttcagggcagcctggactacacagtgagaccttgtcttaaataaacagaggacttgcacacatgcttcgtaagaaaaatgtagctggcaggtgagtgcacagacgttcagcagcatccgtcaggtccgtgagaggtcaccacccctgcttcaaatgatggatctgaaacttgtcagtcgccagtgctggcgaagaagaggagcctctgaacagccaagctgtgctctgtaagggtagaggagatacaacatctactcggagagcctgcacatggaagtctgctttcacagagcgagaaaggccatcatcacagtgtgctgagtggaaggttctttatagctcctcagaacaggcaaaagcccggggtcagaaagcaggctggtgcttgccagacttgacacggagaggggacgacacccagactgctcaatccaaattgctaacagttatgactaaacatctgcctaatcccaaaaccatccctaaagagggtgaactggctgtatgtcagtcaaatcaacgtgactgtagacagagaccactttctccgttagtgctcaagtcatatctaatgatcatggaaagggcacagatgtacacactgtaggcttgaactctcagaccattgcccacccggctgccacctggagaaaggatgggggtaatgacagactgtgagaagagcagatcacctgtcctttagccggaatggccagtgttggcccctcccttgaggtcctccccaattttttcttttcccaagccttttttcaatcttgatagtcacattccttgccttccctaggcaccaaaagtaagacatagccccaaggtctagactccacacaagacctgcatatactgtcttactttcctttgttccagagcctcaaggtctttgtcaccagaaaagggctgggcctcagttttcagctccctctcagctgcctgtgcctccactggaggcttcagctgtaattggtctttctaaaaagcaagaggtacaggattgtcctgtgatatcctaatcgtgtgacgtggtaaaacagcccacatctctctaggagctcagaagccaggcctggatgcttacttactaaaaggcactatttctcagaccagatagaaatgggaaagagaaaatggggctggggggtctgagctgttgtacagactcatctagcccctccatcccgagagctggtcacccccagtgatgccatgcctgcgccttctcacagtgcaccaatagtgcactatccctgcctcccttagtgggtcttcctctgtactttctgctgcctgttcatctgtgtgcctggttccagtgctgtctatcacaagtatagcagctctgcaagagaatactcacctctacatgctgggtaaagacacagccgcaccctcacccctcactctgtgagacagagtccagtgacagctcaagtgccagactgtctgacactctccaggtttctatatgcctgtgcctcccccactgtctcttcaggccttgattgtctctgttttgttgtctttggagcctgggctggagtctcccacatgtgcagcagtggctcagtgcagagcttcagagagcagcaccagggtcgtctgcctgctgtaagcaccttttagacctctgcttctgatgtgctccagaaaagctgggtctcacaaaagcatctctctttctctctctctctctctctctctctctctctctctctctctctctctctctctctctctctctctctctctctctctctctctctctctctctctctctccacgctcgggtctgtcagaagctgcttctcgctgttgctcacctcactggtcattgtcattccttttcaataagctctgcgttatcatgagataaaacttgtgcttctgagcccacatttgctgctgtgggacgttttctaaactgatagccacccacagggaagcagggccatctcccccatgtccaaactggacatgctcctctggcccctagttttgtggtttgggtgtggttctgtgccatttttgacacaaaaaagaagggtgcctggcaataaaaccctgagaaagaaatacagtcccgtctggggtcctcggactggtgctgtgtcccttaggaagcctctgtaaaacactgaaggaaatacaccaatacacctatgttcacgagcaagctcggttctcaaagccagcaccactgtctctgcatggccagaagcatttcccttgtttgggaatctcaggaccccaccctgacaggcccaccttatcctgttagctggcttcagccagggaaccgactagaggacccaaaccacccacactcagagagtaatggcgtgtgattgttggcttgtgtttctgagacacagttctctatgtagcccaggctggcctagaacctacctcagatccccgagtgctgggttcatgtggacatgccgccatcactgtgcccagcttacacgtaagtgactgtctcgtcgctgccgagcctgatcctgcctgtgttttctgtccttcaagatccccgaggagcatgacctagagagtcagatccgcaaggagcgtgagtggcggttcctgaggaacactcgagtcaggaagcaggctcagcaggtcatccagaagggtaagtgcacctcgcctcccaggggagcagcctctgccacacacactcaggactggagtcccctgcagcccccaagcactgtgtgtgctgctctgactggtagaggcagctggaaccagaagggatggtgttggggaagagggaactgcctcagggggagggctcctcctcaaggagctgtgaccttctgagaagcatcactcctgtttgttggaatttccagaagagaagtgcaagccctttccagaccctgggaacccgcatctcagtagccacctgggacgtcctttccctgtaacagaagcagggccctagctttgtccagcctgtctccaccctgcccttgcaatgaccactggttccattcttccaaactgtgacagccataccctcaccaagcccttcccagatctgaaagcatgccacatttgcttccttgcctgtttttgcttctagtctcatggggacatgttagtgatcagccaaggacagtatgtgtactgctgtgagggctcaagagcaagcttctgccagcagcttgcattgtgtgtgtcccccaggcctgaaggacatgcagggaacagggccatgtcaagcgtagcaggaatgagggccagactaccttaccttaagcccagggtctttatcgcctctcttgaggagtacagagtgaggctcccccaccacccatggtgcagtctcacagctgtgactgcatgcgagtgacaggcggaggccacttcacatctccagccagtagccaagtagtttttcctcacagaggtggctgtggctgagggtcagcgtagtaagcctttggccttctccctagtagcacaagtcagagttctgaccatacctccctgtcctctgaaatttagaaaataacgaccaattacttgttagattaaggctgaagcctcagaagacagactgtctatcccactgagagagggccatgccagcagcgtcagcccaggcctgcctcgttgagtgcctgcatttgctgcacaaccccatctatgtctctcaggtccctgacagtcattactctgcaggaaactgcttgctgttgactctgtcgtcatgcctcctgtccccagcacccgtgtcgctcccctatgtagcacagaccctctcagagcaccctgttcactgcactctccagacagtgtttccttaggctcccgggactgcaggccagggcagccagggtaggttagtttcctgacacgagtttggaaaatggatctagcccacatagtaacatggctaggagtcttgggcagctgcagagacaacactgactcttctgttcaaactgaggcacacagtactcagagtacagagtcaggggccagaagatggctcagtaagtaaaggtatctggggccacggtagaggtgctgtcattcctccctggtgctttggcttttaagctgtgtgttctgagtggacttcactgcccaccacaccatgtctacagctgcctggactctgcatccttagctgcatcctttctggctcttaccacactcttgcaaagccaagagaatgtgaatcagctaatgtgtgagcctagtgaaaaaaccttgtcccttgccgtgaccttcacccctgtgatttttgtctagctgcttcccagactgaaaaacctggaattccacctgggtcttgagtggtggtagccacaccctccttcatcctgaagttcttagcactctctttagactcaataaaattcctctactctgaatagtgctacttacagtatactaagtattgatcaaagacatgtcagtgtctagttctgccaggagttgtaagacggagccaaacaaaggcatagaccctagagctgtggatgcaccgggctaaagctaccccttcctgtcagtgtgtgctttcagccttctcttggatcccagctgtcccctccttcagctctcctaaagacagtatcagtgttgctgcagatgaaagcctggtcccaattttctcttacaggcatcaccagactggacgatcagatctttctgaacaggaaccccggcgttccttctgtggtcaaattccatccctttacaccatgcatagctgtcgccgacaaggacagcatctggtaggcatggctctggctcacctgctgtcttctctccccattgcacttgaggtccacctcattctggactcaccgggtcttccttagtaaagagtaggctgagttgggcgtggtggcacacacctttaatcccagcacttgggaggcagaggcaggcggatttctgagtttgaggccagcctggtctacagagtgagttccaggggcagccagggctatacagagaaaccctatctctaaaaaccaaaaaaagaaagaaagagagagagagagagagagagagagagagagagagagagagagagagagagagagagagagaaaagaaaaaagaaaaggaaaggaaagaaaagaaaagaaaagaaaagaaaagaaaagaaaagaacagaaaagaacagaacagagaaaagaacagactgggaacccagtttgctccttgcctgttctgcagaagcaagtggatgacagagaatccctaagagagaatggaggttttgtttggtttggttttgcgtttttgctcttttactttatgtgcattggtgttttgcatgtgtctgtgtgaagatgtcagaactcctagagtcagagtttcagactccgactataattgccatgtaacttgaaccaccaagtggttgcagggaatagaatccaggtcctctaaaagagcatccattgctcttaagcactgtgctatctggagagaatagagtataatttgtactgggtgctgacctggtccactgaggaatctgcccatttcttgtattcatgatttacacactgccttgttaagtcataaactgcgtgtaacaggaaactggccatcttaaccatgtgctgtcagtgcatatggatcctatgaagaccaacccacacccacctctagggtgttctcctctccctaccaaagctgcccagtggacactagccccttcccttgggtgccatcagccccatcctttttgtttctgaacacgatgcctcaagggacctcctgagtggaaccttgtggtatttgtcctttggtgactggcttctttcacttttccttcatagtttgctcatactgtagcatcttcagcgtttcctccttctcagggcctggtaatgttctgttgtaaggctctcccacactgttgagctgtcagggtacttgggtatagggctcgatgtcatctcaggtaccagaggtggactgctgcatcatagtcttcctcagcgaccatactgtgtcccccccacctgcactacacaaggctcctcactcacactggccagtttctgctctgctctgatggcagccacctacggcatgcagctgtgccccgttggggtctgggtcatgtttccctagtgactgtctttctgtgttcactcttattccttcaagtttttgggactgggagaaaggagagaagctggactatttccacaatggcaaccctcggtacaccagggtcaccgccatggagtacctgaatggtcaggactgttccttgctgctgacagccacaggtgagtagcactgttgtagcccaggcctggacgtgtgtaagggaaaaggcaggaacacgttggtcaggactctgggaccattttctcatcaagcgtccctggcccttccatgactggaaatactatgtcagcctctgctccactaaccttcatgaggacccatgggagttccagacccacatgaaagcaagggaggaggacgttataggtcataatgtcctccagggcccatgctgccccaacctctggtgtcatcagctcccctcctccatggctcccacaccaggtccagccatcttttgcaggccagcttccttcttctgaaggtgggtgagaaacgtttctgaggtaggaatggctctcactcagagttcttgttttgatttttcacctgaaatgtcttaatatcatgcttgttttgaacaagatgttttccctaggttgcagttggtttattttttgttgttgttttgtgttgtatgcctttgtttaagacaaagtctctgtagcccagcccagcttcaagcttactgtatagctaaagatgaccttgaactcctggtcatctttgtctctgtcttccagaatctagaattacagttatatgttactttacctccacgctatacagtgctatgaactgaacccaggtcttcacgcttgcacagtgagctctcttccaactgagctgcatcgccggctactgttgtctagcaatctaagacatgattcctgggtcgggatggtttagtgatagtctgcttgcctggcatcacagagccccatgctgtgtccctagcaccacaaaaactacaaaaataagatcacaccagcactgatgacctcccattgatgccaggtagaaagatgaccatgatgctgatggaggtatcctgagcccaccgtcctcatcctgggcctggacttggcatctaagccactgagactattggtgtcttgagcatgatttatgaatacatggcttatcgttcacacttaaaaggggaaacaacttgcaatgaattaatccaacaacctgacagtccagccctaagtgatatagtagctagaggtggcccaagtggctctcaagtccaacagcccagtacacagcaagctgccacacccacatccactagtgagggaaggacagtgagtgatgctggctctcctgcagatgctctgagagtgatgctctttgggagtgatggaggctggcttaacaaccttagttgtgcttatccaggtcaaccagtgtaccagacactcagcagtcaccaaggtcacagagccaggccagacacagaagatcctggtgggatatgtggtcactggaagggtcacttgttgctagagtacactgctcacatgtgttaggtgcattggagaccagcatctgccaagctgcctggaatctggatctttatggcttttcagaggctccacttgtccttgtagactacctagtgtctgcttctgattgttgggagctgcctgctccccagggcgttgatggttacacccacgtgctcagttcaatgtctgcatattctggtgacacttgatgggcgtgcccctccatcttgcctccttgtttgttttagtgtttgtcacatttcctttttttttttttaagatttatttagctcatgtgagtacattgtagttgttttcagacacaccataagaggacatctgatcccactatagatggttgtgagccaccatatggttgctgggaattgaactcaggacctctggaagagcagtcagtgctcttaacctctgaggcatctctccagaccctcccatttcctttttaagtgaagacatattgccataaaagacactatctagcaatgccacctcagaacccacagcatcagtgctatccaagaatgacctatgcacagtgcggttagggaccctcaaggcaccgctaagactagaagagagttcagggtcaaattgaaagtcccaagtggagaggagaggaagaaagagaaggaagggaaaggcatcagagtggctaaggtcatcctctcaagggaaaagcgagggaagggcccctgaaagcaaggcagatggggtctcgtgtgttttggtcaggagatcccagcatctgtcctctccaggcttaggtctagctgggtacacagaggaccagcggcaatgtgggtaaggatgaaggctgcaaagctttctcctctggaaaacactgagagtctggaccctcgggaaggatggggaagggtctccagctctcaccctgcttccctgccatcaagtccagtgtggggtctaccgcggccctgtctccctttacagctaccttttactggttgctcatgtcagaatagcaggactaggcattgagaacactgcggctgtgctgtggagatagggtggggcgcaaccatgggttgtattgctttctcctttcctagatgatggtgccatcagggtctggaagaattttgctgatttggaaaagaatccagagatggtgactgcgtggcaagggctctcagacatgcttccaacaacacgaggtgggttgggctctctacacgctgctgacagcatgaactgggtcttggctcctcagaagaaggctcccagaactgtgtgaagagtctgatgcctccaggacacctattcagttctgaggtcccaaaatcgattacccagggatctccttagaaaccacaagaataggtaaccgtcaaggatcccagtgctctgccttgctctcagtttggccaagtcacgagcagcactgcaggtggttagatgtggcttggaaaagggcttctgctggctagtgccagcaggctggctctgctggctagtgcgagcaagatggcatggcgtctttcctctttgccagctgtgttctttcccaggaccactgtgtagtgatctgctgtgggtagtggagtcttgccacactcacacctgtctgggctggagggacctgtcaccaccagagctatgaggagagaaacctaagtggcttgtggcttccttgtggaagtcagggcgactgaggtgaggagtgagtggagccccaagggtctacacatagtgtcagctttcccaggaatgctcgggaactggccccgtgcctgaccctcagtcacactgggtacgtgcctcctgcataactgagcaccagggatgaggagagcctgtgtgtgtacacagaccagctcctgccccatggcttccgaatgtacccccataggtaccacagaggacaatggagcattagtgtcttgttgccagccactgcaagtgtgccttgtgtacagagcttgctttacagacgcttggctctgatggaggtacatgcccatgtgaacagaatggccttttgagaattcctgagagctgagccaagttgcccactggccatcttcctgccccagtagctgggatgatagcacatgctgttgcacctagccaagagcttggttctgttgtgcttgcctgctcgtctccatctgggtactcaggatgctctctcttcagcatcttacactgtgttagagcatccaggtgggccatgacctgtacagaacccccgctttgtctaagagaactaggaccttggtggtctgacgtggccagaggccactaaaatgtgacctgctctttatgtctcagagttacagaggatgtatttggtggacagagattccgagaccctgttgtctgtgattcactgtcatgggtgggtggagtgtataaggttctgggagagcacagagctcatcggagcgttgttgaagtaacccagccgtacatgagtgaggggatgcccagtacagccccatctcgcctgagccattgtttgacatagtgacaccactgtttccccaggagctgggatggtggtagactgggaacaagaaactggccttctcatgagctcaggggacgtgcgcattgtcaggatctgggatactgaccgggagacgaaggtgcaggtaaccactccaggcccctacagagaccccacgcttcatcacgccccaactgcatgctcccaactcacctaatagaccccatcctcatgagtcagcagctgccatccaatatctgtgtgggaggcacatgggggcatcttgctgccaggtgaaaagctaattattcctgggtacacactgattgtggcactttgaccctgcattacagcaataattaaggttatgctaacccaagttatttccaaatattgttttctctatgcagattagggaatatcagataccagtggggtgaagtatcttacatgagaactgttaactgtttgacatctgcgtctctcttcttaccctgtgatgctgcacatagaagacagggccctgtgtatgctaagcacctccccacgctgcccctgagctggaattcagcccctaacttaaaccatgttttattttcaagattgattgtttttgagacataatcttaccttgtagaccagtccagctccaaattttccattttaatagattgtattggttttgcttcagatacttgggcttccttgtcagagtccaattgcacctacctccttcaggtccaaggcagaaatcacagatgctgtaagaatagcacacagatagctgagggatgtctgtcttcctggtgcccaaagacacacagaacatatactaggcctccgcactccccaacctgccctgcctgacaaatcatggctatgtcacagaacagagggatagaagggttggggcaggagtgacgagagctgtcaaggcccccgctggaagcttccatgtatcctcaagccccacactaccaccaaacagttaagccctggctgtcagggtccctgtccctgtggggagagagagcctgattgttcctactcctaagggtgctgccagggaccctgtggggctcctgcaggtacagggcctccttgggtgtcatcacgtcagctgcaaaggcaggagtggggctccgtcacaacctccccgactcacagccctccccagcccgcgggttcctctcaggctcaccccatctgattagaaggcatttttccctctgaggcccatttccagctcccattccttcttgctgccattcatcaccccctgcccttctgcagtatttatggccaccgtggggagcagagaagccttccctcagctcttccctggctaattaggggcttgaggagagagctaacgaggctccctccctgccaaaatgtgcttcgcctttcttttcaggaaagggagagattgctgggaagattaattggcactgagcaccaggcatccccacagttgccttccaggctgtgcccaggcccaggctcacaggctctgctccacctgcctggtaggccaggctcagggcagactctcacgcagatcgcagatcagggcatgattgacgccctgtgaaccctgcactacccttggcccagttcctctggcctgtgagagccttgcaggtggagaccagtttctcagcctgagagagaagaggatatctccacagaacaccctgcagccagctcgaggctcctcactgctctctctttgggcttaggacatccccacgggtgctgacagctgtgtgacaagtctgtcttgtgattcgcaccgttcgctcattgtggctggcctgggtgatggctcgatccgtgtctacgacaggaggatggcactcagtgaatggtaactgtcacatctcccctctccttagcactattcaagctccttccagatggcagaggccaccccactgccagtaataagtccagattgctcagtgagcatgaagtgtcttcggcagtgcacagtggacctctgataccagacaagaagatggcacccagggctagagagaaggctcagtggggtcaaccttcacctttcactgtctggctgcttcaagttgaccccacagacagaaacagtgacctcactaaactgctgactaaggcaggaccaggtcttcctcatctcaaaatggcacccaggcttcaagaccctaactgggtaaacagaggagagagaaatgagggggtggcctaggacagcctcgctagcccctcctccttctgggtgtcctcttgaggctccgcccaagggcagggctgccagctccagttcagcccactcctcctagccctacctgcagttccctcctgcagagcagttggggagaggaactgggctgggccagtcctgaccacaccttcctccttagccgggtcatgacttaccgagagcacacagcgtgggtggtaaaggcctacctgcagaagcaccctgagggccacatcgtgagtgtgaggtaaggagcaaaatatgcatgagacatttgctgtgaaaacattattctccctccatttaaatatgttcttggtgtttaaatagctagggactgttggcatttcagggcagtaactgacagtaactccgtgactggcctgaaaggtcagagggcagagcaagagtcggggtggaggtggcaggtaggctgggctgaaggaggagatgcacagataggcgtgtccctcacaggagcagcaaagcagaatgcaccaggtgggtggcacctccctagcaagtcacctcagtgccagccagcctgtgcacgtaaactcgggcccactgctcagtaaatactgtgctgagagcagtggatctttatctgctgttaaagagacagcaaagcataattcactgtcacaaagccaccacttcttcagagagatttccttccccccttgtctgtggcataaagcaaagcataattcttggagtggacattgaagcagaaggctataagcacaggcgagggatccctcagccatcttctgcctctgacaactctgttcctggcctttcttgtaatctcttctctgaccctgctgtgtccccctttgtgtgagcatgctatctccctttagtcaatcctagccttttctggcttgagaggggcagcttgatgggaaccctggctgccaagaccagtggggtggttcgacgtggggatctgtgctccacctgacttggaggggtcctgggagtctacatggctttggccttaccagcatgtgcaagtgggcattgaaacttctcatggccagttatgccatccttcagagccaggttcctccccctcagggctccagatagtatccctaaggttgccaccagcaagcatcaccctggtcctttctcacagtgtcaatggagatgtgcgcttcttcgaccctcggatgcccgagtctgtgaatgtaatgcagattgtgaaggggctgacagccctggacatccacccccaggcaaacctgatcgcctggtaggtaccctgcctgcctccctccatgcagccccctgtttctaagcagaaggccctttcagagtgtacagcctttgtctctgtcctccacaggacctttgaaagaacagtttagagggtgtaactgtactaccatgaaataaaaacaaaagatgtctcccctgccttatccagctttgagaacaaagacctgccccctggcatctctggggacaggcctggttcttcctgacagtaacagatgcgcagccacttcctgcctcagggtgacacagagatggacctcctagcctgtgtccccacttgctataactctcagcctgctccttggactgtctttctcttgcaccacagggagacagaaactaatatcctgaccatctttccctccctgccacagtggctccatgaaccagttcacagccatctacaacggaaatggagagctgatcaacaacatcaaatactatgatggcttcatgggccagcgagtcggggccatcagctgcctggctttccacccacactgggtctgtaccttcactcctgggtttctgggaagggcagaggggttggtgggggcagcaaggagagaagtaacccggcaagcctgatctcctccctgactctaaggatataaagaactaagatctgttaggcctggggtgtccaggaaagcactgccctgccccctagaaaccagcccagttctttttttttgttgttttttttttgtttgtttgtttttgttgttttttttttttttcttcgagacagggtttctctgtgtagtcctggctgtcctggaactcactctgtagaccaggctggcctcgaactcagaaatccacctgcctctgcctcccaagtgctaggattaaaggcgtgcgccaccacgcccggctccaagcccagttcttaatgctcaggtaaaatagataacacaacagctagtgtcctctggtttggggagcaatagaaatgtgtcatgagcacgtgtgtctataactgtagtcactctacagagtgttgtgtcggttagggttttgcagagtgggctccagaggcgcctgtgtgtatcactgttgaagtgcacagcatcagattcccagaaccatcccaggggagcaatcctaaaacgaagctgcagggaattgtgggtagtatgcaaatcacctgtaatggaatttgaatgatacattattcctgctagactctggcagttaacgaccctcattgctgtgcctgtgcagtcagaggtgttactgtggtatgtcctcacccccactagagctcagcacagagtacaagcagcctgcacccttcctctaccccagcggtgccgcctgccgcatcacaggccctgctcacgtgctctctgtctctccacacagcctcatctggccgtaggaagcaatgactactacatttccgtgtattcggtggagaagcgtgtcagatagcggcacctaggaccactgccaggccgcagccacctctgctgtacatagtgagccagcctgcactgctcggatgcagtgcccacctacccacccacctgcaaaccccggctcctgacttggccgtggccagctgaggaggggcttgcacatccttccttctgtcttcactataacagcgtacaggtccagagcaggggaggggttggcctggcttcccatcaagaaccagcacccaggcaccaaggacctcctcagtgcagcatggtcctttcctgccctgttttcttctgaggttttacaaagggacacatttgatttttccatgtgatcaaagcattagttacagagcagacagcgccctgtagaatagccgtgctggggctcctaagggccatggcccagccccactgtcctctcagagtgtgctgccagtcctgggaaatggataagagcaattgggggaagagagagggtagaagagagggaaggcctctcctgctacaaggtatggaagtctgagcctggccctcctggagcaccgaggcagtccagcacattgtgtatgtcatggtgctatgaggaaagctagacctctgaggtccagcctggcgggcgccctcaagtgagctagctgcaggagagggtctggttcagggcagatgaggcagatctgtagttagcggctgcctccatctatcaggcatattctgaagtgcttctctcccatagggcagtaacagtggccacaggcctgtctcctgcttgtgccacacacaggtacacacgcatgcaggcacgcagcctccccatccataattacatggatgccctggtcttcctgcccatgtacacttaggtgtgcattcatgcaggcccatagtttcccctcctgcacatatatgggcactgtggccggccacatgcacgcacatgctggcctcaccatgcatagggctcagacacttcactgaactcagaggctggagggcagcatcagctctgttgatggtggaactgaggttacatgatgcagtatgtgctgagcacgagttccacagtgtcctggtgtgcctgacacgtgtctgcgtgcacaggcaagagaggaccatggacactgtagccctagatgtcagcactgtccccgtgtgtccgacatgtgtctgtgtgcacaggcaagtgaggaccttaggcactgcagccctggatggacccagcattgcagagcagttgcacacaaacaggacacaacacaatgatgttttgaaaagcattttccgttttccctgggaatcaggatctttcagaggacaagtgccaacaggagcccagggacacggggttgggacatctgtggcagaggctgggtccctgtgctgtgttcagtggacctgttttagccaagagcatcttccctgtgagaggatcctacaggctgagctgtcctgggcaagcagaacaggagaccctggcacggcccctggaaatgcattctcccaaccgggtggggctcaaggaagccagccccttggttgggccatagagcagtgtggcgacaggaaggccctagagccacctgacttacccctgctcagttctgcagagagcttcaggggctgagtgtgcgtcagctcagtccttgtccaactggtgactcagttttggccgcacagggccgcctgatgggctgggctgcttccctgccctggtggaaccagtgtttgcatcttgcccacaggctgggcctcacaagtctgatgcggaaattcaatcatgaagctaagcaaagctcgagagagcgctgacctagagcgcatttctctatttattttaccaaaatgagagttgaaaggactgacaggacacggaactgcagtggcgtccagagcagtgacagcaacagagtgttaataaagaataaagccgtgagatgtcgctgcccttgccagatgagaatggtggggtggggtggcccaaagggctgtgcccttgtggcttctgcagtccccgggtccctggggtgagacagtcttggccagagacaaggctactctatctacccctccaggcctgggtggaagtgaagacatgctggttgccatggagatcttgaggcatcgtgactgggattcctgtgctgaccctgggcttgtcattagtaaggtttccccacatctacacagaccagcttcacgcggctgtccgtttccctgttagtattgttgcttctcagcaaaaccaagtgctcctgcaagggatgggcggaggtgtgcagccagtcctggagagacaggtcccagctttgtggtcctgtgaggggcagacagcaaactatctctgggtgtgtgtcagggctccctcagccagtctcatactggtcactgtaccaggctgggcctccactacccactgcgaatgtctccatccccatcccgggtctcctcagcagaccttacttggccagaggaattgggcctcttgggttgtcctgatctggtcagtagtctgattagaacgcacatgttcccattaagtggaaggatacctcaggtgtcagggtcaagagtgtgggcaaggaggtgacttcaagaggccaagagcacataaggaaaggaggagggtctgaagggctgagctgtctctccaacccatacactggaactctgacctctcccttccccccagtacctcagcataactgtagtggaaacagatctttacacagggcaaagtgaggttatagacgacagtagtccagtggaagacaataggacaaagaccacgggcatggcagtacacaggcacagggagacttcaggaagaagcagtctagacacaccaggttctgacactcctaagactgcctacccagtcagtgttagtcagtggtcactggcctaaccctggtgtactaatgtttctagcactgcccttgaagccctcccagccctgctgctgtccctgtctcatagaggtgggatactaactacaggtgcttgagcttcagacgtctctgcagaacttaataacagccaacagcatcctgtgggccacagctccaactggagccaggtctgtgcttccttggctaggagaaagacgacttccataagtcacccatgtcctggcatgacaccacaggccctacacacagtacccaccctctcccatgagcctgaaatctctcctgaccagttgtccatgttaccccaaccatgaagataggccattcaagggtgacaggaaagagtctgctctctacccaagcccactcctcccacccatcacatggcagggctgtacagcacattgggaatagaccaaggctccacgaacctatcctccaggggtctctgaagccaccatggcagccctttggtactgccatgtcatatgcacctgctaggcccaagagatcagtatcacctgggggtcagcatcactggtggtcaagtacccctcagatgtagctagggagactatccataccccataagcagacagaactggcgagtcttcaggaggcaacagagcatctcctgactttacagtccttctccagtggtgttggacatccccagctgagaggcagttatgaagacgcctttacccaatgatctcaacctcaggaggcaggctcagggtttctggcatggaagcaaggtcttcagcctctgacctaaggacctaggactccctgcatagcattgaggactttaactccttgttgggggcaggggcatggagacgtgtggcccagagagccaccatgtccctgcctttctccaagggttagagtttcccctgcaggctgtgctccacccctttgcaaatggggagcacataaagggagcaccagctgcagtcaggacctcatccaggtgggggcgactgctcagcctaggaaagtggctgctccgggccacctgtatcacagtggggatgagacaaacacagatgacttgaagccaacccagccactcctctccagagcccactttgtggtgtgggtgttgtgtaagtggagcaaaggccatgtgagtacaggctgtgggttagcagccccatccttccgggagagaaggtgtcccagagagcttacatgcactgccaggggaagggtctaaaaggctggatacaggtcaggaagacccagagcttatactatacggtggtgtgacctgccaagggagaaggtgtctagaggttaggacagcctcctacccccagctttgggctctgagctcagcttccctctggccaaagggcccaatgatgctttttctatgaaacccagccgtcttcaggaaccaccccatggcctgtcaaagggataatgatatctcctctccaggccggttctacagagacagtaaccatccagtggccaggacacacatagggacttatttttatttgttttgctattttaacaaagtagatttgggggaggatgacacaccaacaaagagcaacttgaaaaggagactaagatgccagtttcccttaaagcagcagcaaaagaataatgtctagaaataaaaaaggagattggagacgtacaaaactacaacacattcaagaaacctgaggagccgggcatggcgtcacatgcctttaatcccagcacttgggaggcagaggcaggcggatttctgagttccaggccagcctggtctacagagtgagttccaggacagccagggttacacagagaaaccctgggggggggggggggagggagcggaaacacctgaggacccgaggagatggagaggtctcccatgttcatggatcacaagatctaatgttggctagggagatggctcagtgggtaagagcaaaagttggacacagttgcacatattggtaatcccagaattcctatgatgagatggaaggcagagacaggaaaaccccagaaattcaccggccagtgagttggaaacactgtttcaagggggatgctgaagactacactcagagttgccctctgacttccactgtctaacacccatacccacatccactggcacatgcacacattcaaatggtggaaattacagtagaaaccccaaccctcagggctggagagggtgcagcattagaaacactctgcccttgatcttcaatcccagtgaccatgtcagtcaactagtgactgcctgtagctccacttcccttcatgtgcatatactgacacaagtagtcaaaaacgactattttaaaaagttttaaaaatagaaaaccaaccctcatgttgcagaactgccaaaggtcccaaaacagccagaacagaaaggagggattagaagattctaatttctttctttttttttttttttaaagacttgcttattacatttatatgagtacactgtagctgttttctgacacaccagaagagggcatcagattctattacagatggttgtgagccaccatgtggttgctgggattgaactcatgacctctggaagagcagtcagtgctcttaaccactgagccatctctccagccccagaagattctaatttcttaattcagaacttaaccgcatttggttagagtagccactggaataagggtcagagttacaggtcagtggactagaataggaaatgcacagtaagaggccgcttacagatttgtaacaagactactcagtgggtgaagaagactctccaagctgatgtggtggctcatggccacagagtagagaatgaggtctgctattatctgcaggccagcatggcctataatatgaaacgctgtctaaacaacggtgtaaaaaagtgaaaagaacccacacagtatataaatgcctctaattccaggcttcaggtagccaatgcaggacgactgtggacacaagactagcttggtctgtatatctgaaggtcagcctggggcaccataaagacctaataaaccaagatctttaaaagagatcagtcaaggacttgattagacatctctccaaagaaaacagcaaatgagtaggcagcacatggaagacatcactagataatacaaccaagtttctgggaggtaccatctcatacctgccaactcggctttaatctgaaggtggaaagtagcacgtgtccaccaggacatgaagggattgtagcacttgtgcactatgtagggggcttgagaaggagtgggcgatactgaaagtggcttggtatctcttcaagaagatcagcacggggggctagagagatggctcagtggttaagagcaccgactgttcttccagaggtcctgagttcagttcccagcaaccacatggtggctcacaaccatccataatgagatttgataccttcttctggtgcatctgaagacagctacagtgtacttagatataataataaataaatcttaaaaaaaaaagattagcacggagttatggtacaaccctgcaatttcagggctaaatataagtcccagagaaacaaaagcatgtgaccacatggaaaccttggaggatgtttataggatgttgttcataaggcagaaactacctacatgaccatgtgtgaatgaatgaataaacaaaacttggggtgagaggaacaatgtggttagcccccttcactacctctttccaccacataaggacaaagtgtgcaaggcattgtcttaagaggcagagcctaggctggcatcgagcactggacctgctaaagcctggaccttggacttcctaatatccagaattgtcagaaacatgcttattctttattttttattaatgttatttgtttagagcgtatgcatgcctgcacatgtgtgggcatgcacatgccatggaggccagaggaccttgtgggatccagggtttgaactcaggtcatgaggcttggcagcaaatgtccttaaacaccggagccacgtcaccccactggccctctactctttatcagtctcagaggagctggattgagcttggttgagtctttgctttggctttagttttggtatttgagacagggtagccctgtctaacctcaaactcttaatcctcttgccttatctttttgagttctgggtttacaggtgtgactctatatcatacattgtccttatgagatgcagttagtatgagctggactacagaccctgtgttatcagccaagattttctcctaaacagcatctggtttaccaaaggctgtgtgaccccctcatagctaccaaagccctcgtcaggtctgacctcctcctctgtccacccctaagcctgtcacctgtcttactggtccatgatagcctgtcccctgccccactccacactgtcctgctctgtcgtatctgatgatcaggcttctagggtcagatgtcacccccttccctaacaactatccccagaatccccctaccttactgctcatcaccttgcccgtgccccccatcaccaccccacaagccagagcaggaccatggatggtaggtactaaatgaaccagtgagtgagctaccagtggataatgcctgagtggggagagaatgagctaataaacaagccagccatctgctgagcataagagtgaggggcgaatgaataaactgcccatatctaggcacatctgtgacaggagcctcagcatggaggttacacagcagttcatcagctgcctgtcctacagcaccactgtgtggttgcagtagggattgccactacccacattaacataacatcccagaagaaaggggctcctgttctcaatccttcaaagatgtgagagggagggagagagagggagacaagtactttcttctgccccgccccacccctgagctccctcagagcagccttcctcccctcagaatttcctctagaaggtctagcaacatacgtgcaaggtatccctcgttgctggcgatccaggcctgcttgaaagcaagcaggtgtctgcagccctgactggtcagcaccaacccctgagctcaggccctatctctgggatttgctgtcttcttactgactccacagtattccttcttgggcttgtctcatattttctgctacctgtgtctgagctctgagggccccaggaccactggatccattgcacagccctcctgcacctccccctataactcacctacagcctgcctacattctgccagtagctcaccacatagtatgtgtgtaacgcacagccgcggctcccactttatgctccctggcatcagcttacacatgtgagagtcacacacccagatgacatacttgtttaagacaagagcccaatctctcccagcttcaccagcgtagccataagcttctggcctttggaccctgaaattggcttgggtagacctcccatgacaaggctgtcattcctgacttgggtagattgttggcctcagctgggccatccagagccctgttctggttgtgccaacgaggcctgcaaaggtgagctgcctttcgtctctttcctgctttccaaccctagatggaagctggcccagagaagctggcacagtcacaagagtgacatgaaggaggaaagtgactcctgtgtctgccagttcttgctccctggtaaaggttgggaacatctcagtgccagcaacacacagggatcacacttacactccagctatcccaacaccacctccctgatcgatcactcactctcttgtatcccccactgcagactgcctgtgagtggctcggcactgtgtcagccccgctgctacctggtgttgcaaagctgaaagccacggaagagatccaagttagattccctataagaaactttctggaaatgggaaaggaatagttcttgtcactgttttaggctggccttctttcactcagtagaaggctggctcaaggggagacagtgcacaggccttctcacaccccacctgcggacccataggcagtcttcatccttttgcacatccacctattacccacctgcaacctgccttgtgggcagcttgcacctcacccctcagtgcacattgattgacagctgtgccccttcttgataactaggtcagcaggcctgcatctatggcctctgtgtgttctcagggctgctgcagaagatgctgtgcagagacccagggatgggactccccagcctccgttcctccaacccttcggtgattttgagacatgtggttctcagcactaaatatcctttaggtgaaatatccaagccagtaaggatgcctcggttggctcagtctagttccagaaacagcctcacacagaacccagcactggttacccaacgcaccaaaggctctgtgcagtgtggattgagttgtttcccccagaactcacgctgatgaccggagaggtggtttacacctggctcctctaacagagagaggtgtacccagtggtggctcatgaccatctttaactccagttccagaaaccaataccctatcctggttttgtggacaccaggcacgtgtgtgtgtcacccccaacaaaaagcctcatgttgctgttttggcctcagaatgtgtccttctttggaacagggccgttgtaggtacagttgggttgaggcaagccttaatccaaagtgatgattctttataaagaggatttggacacagacagtgggagatgcagtgtgaaggtggaagcagagatcgggtgatgttctgccagccaagcagccgagggaggatcacaacatgtcgccttcagaagccagggaaagcctggtgtggcctcccacagagcttgtagagaaatctgccctctttattcctctgactctttcaacgattttggtgcttctgaccccagggctctgtgacaggacagatgcttccaaccctgcctggttaaaccctggtcactgcccggaatagtctttctggaaagcagagtcaggcaaccaaggaacaggctcagagctgcaccaggggagagcttggggctgtggggtaggatgctggtgtctgccagcaccaggaagattgcatttttagaatggcatacaagggattttaaattctcagttcaaggcagagtgagaaaaccaggaaacacatggggctgctagaagaggtaaccaagtttcctgtggccgggctgctgtgcctgcagatcacaagcaagctgtaccctgcagggtgcaggattacagggcaaactgaattctcagcctctgcaggtcatctgtgcaggagctggagcagaaaaccaacgggaaagcatcagggcaaagagactgaggggctgagcctggccccatcactcctgaacccccaaacccctcggcacagacaccgtgcttgcaggccatacctgtgacggcatcaccctcagacctgacagaaatgagaaccagctaagtcctgtcacaaacatcagacacacactcgaggttttgctttctggctggatatcaaggagatggactcaggccacagaagcatagccctggctctctgcatttgtgcagctggcacacaccccgagccctgagctccagcactggcttgcctatatgtgaaaagtccgggcagtttgcttgtcgaggtctgtgctacagtgtttccactgagatgtgttagttccttagcataacacaaaggaaaaaacaaacaggttggaaggggagttctctggaagagaggtgcactaaagtcaagccccaggaggaagccgctccgtaccttgcttctctccccagggagcaactatatttgtgccttttgcatctttaaaacaaaacctatcaggaccaacgtaaagcaggagaggctggcgtaggctaactgtttcgggaggctctggccacagcagcaggagtgggaggcagagggatggaccatagagatatcagaaccattaacccccaaaggtcggtcactagtgacctactttttgccaccaagaagggaatgcgtgttcaaacagttgagcctcctggggccatgcgtatgacatcatggcagctcacctttcccaaaggacgccagaagcttgtctgtgaggaaccttgtagaccagagacgaaggtgggagatgttgtcatccaagtgggttcctgattcctcagggacctggggtaggcagggtgggttcagttgcaggaaagatgttaagctttgagcagcaggcaggacaaacgggactgggcgggctctgctcactgtgaatgattaagtgcagagggtgatctt

SEQ ID NO: 452 - DNA, 5323 bp, Mus musculus
ataaggtacctgagctgggcccctgaggagtgtgctatgctggccactggatcacttacctcctagcagactttgctactcaaggggtctggagatgagtgaggtcaaggagagtattggatggaattgagcaagtgactgttttttgagggggaaaaattctcatctagtgtcattagtcaaaataatatgataaactaacaggttaaatgtgagacaaaatttaatgctaggatgatctgtgctcatccacttacctggtctgtgccagtctgcacagcagggaggagctgaggcctaaggaccaagatgaagacggtgagtgtggccttggtcctgtgcctgaatgtgggtgtggatcctccggatgtggtgaagaccacaccctgtgctcggctggaatgctggatcgatcctctgtctatgggccctcagaaagctctggaaaccatcggtgcaaacctacagaagcagtatgagaactggcagccaagggctcggtacaagcagagcctcgaccctactgtggatgaagtcaagaaactttgcacatctctgcgccggaacgccaaggaggaacgggtccttttccactacaatggccacggggtgcccaggcctacagtgaatggagaggtctgggtcttcaacaagaactacactcagtacatccctctgtccatatacgacctgcagacgtggatgggcagcccatccatctttgtctacgactgttccaatggctggcctcatcgtcaagtccttcaaacagtttgcactgcagagggagcaggaactagaggtgaggtagctgcgattaacccaaaccatccacttgcccagatgcccttgcctccctcaatgaaaaactgcatccagttggcagcgtgtgaggcacacgagctgctgcccatgatccctgacctcccagccgacctgttcacatcctgcctcaccactcccatcaagattgctctgcgctggttttgcatgcagaagtgcgtgagtctggtgcctggagtcacactggatttgatagaaaataggcatggcagcactaatgcagtggacatcttgtctaggatccctggccggctgaatgaccggaggacccctctgggagagctgaactggatcttcacagccatcacagataccatcgcctggaatgtgctccctcgggatctcttccaaaagcttttccgacaggacctgctcgtggcaagtttgtttagaaattttttattggcagaaagaatcatgaggtcatataactgcaccccagtaagcagcccgcggctccccccgacatacatgcatgccatgtggcaggcctgggaccttgctgtggacatttgcctctctcagctgccaaccatcatcgaagagggtactgccttcaggcacagcccattctttgccgagcagctgacagcattccaggtgtggctcacaatgggtgtggaaaacaggagccccccagagcagctgcccatcgtcctgcaggtgctgctaagccaggtgcaccggctgagagcattggacttgctgggacggtttttggacttgggcccttgggcggccctgtcggtgggcatcttcccctatgtactgaagctgcttcagagctcagcccgagagcttcggccactccttgtcttcatctgggccaaaatcctcgctgtcgacagttcgtgccaagctgacctcgtgaaggacaacggtcacaagtacttcctatccgtcttggcagacccatacatgccagctgaacataggaccatgacagccttcattcttgctgtaatcgtcaacagctacacaacagggcaagaggcctgcctccagggaaacctgattgccatctgtctggagcagctcagcgacccacaccccttgctacgccagtgggtggccatttgcctgggaaggatctggcagaacttcgactctgcaagatggtgtggggtgagagacagtgcccacgaaaagctctatagcctcctctctgaccccatccctgaggtccgatgtgcagctgtatttgccctgggcacctttgtgggaaattctgctgagaggacagaccactctaccaccattgaccacaatgtggccatgatgctggctcagctgatcaatgatggaagccccatggtccggaaggagctggtggtggctctgagtcaccttgtagtccaatatgaaagcaatttctgcactgtggccctgcagttcatggaggaagaaaagaactaccctttgccttctccagcagccacagagggagggagcttgaccccagttcgagacagcccatgcacccccagactccgttcagtgagctcctatgggaacatccgagccgtcacgacagctaggaacctgaacaaatctttgcagaatctgagcttgacggaagaatcgggcagctcagtggccttctctcccgggaacctcagcaccagcagcagtgccagcagcaccttggggagccctgagaacgaggagtacatcctgtccttcgagaccatcgacaagatgcggcgtgtgagctcctactcagcgctcaactccctcataggagtttcttttaatagtgtttacactcaaatttggagagtcttactgcatctggctgctgatccctatccagatgtttctgatttagccatgaaagtcctcaacagcattgcttacaaggccacagtgaacgcccggccccaacgaatccttgacacatcctctctcacacagtcggccccagccagcccaaccaacaagggcatgcacatgcaccaggtgggaggctccccgccagcatctagcaccagcagctgcagcctgaccaatgatgtggccaagcagactgggcacagtacaccccctcactcccaccagttccctcgaacacgaaagatgtttgacaaaggccctgatcagaccacagatgatgcagatgatgctgccggacacaagagcttcatttgtgcctctatgcagacagggttctgtgactggagtgcccgctactttgcccagccagtcatgaagatccccgaggagcatgacctagagagtcagatccgcaaggagcgtgagtggcggttcctgaggaacactcgagtcaggaagcaggctcagcaggtcatccagaagggcatcaccagactggacgatcagatctttctgaacaggaaccccggcgttccttctgtggtcaaattccatccctttacaccatgcatagctgtcgccgacaaggacagcatctgtttttgggactgggagaaaggagagaagctggactatttccacaatggcaaccctcggtacaccagggtcaccgccatggagtacctgaatggtcaggactgttccttgctgctgacagccacagatgatggtgccatcagggtctggaagaattttgctgatttggaaaagaatccagagatggtgactgcgtggcaagggctctcagacatgcttccaacaacacgaggagctgggatggtggtagactgggaacaagaaactggccttctcatgagctcaggggacgtgcgcattgtcaggatctgggatactgaccgggagacgaaggtgcaggacatccccacgggtgctgacagctgtgtgacaagtctgtcttgtgattcgcaccgttcgctcattgtggctggcctgggtgatggctcgatccgtgtctacgacaggaggatggcactcagtgaatgccgggtcatgacttaccgagagcacacagcgtgggtggtaaaggcctacctgcagaagcaccctgagggccacatcgtgagtgtgagtgtcaatggagatgtgcgcttcttcgaccctcggatgcccgagtctgtgaatgtaatgcagattgtgaaggggctgacagccctggacatccacccccaggcaaacctgatcgcctgtggctccatgaaccagttcacagccatctacaacggaaatggagagctgatcaacaacatcaaatactatgatggcttcatgggccagcgagtcggggccatcagctgcctggctttccacccacactggcctcatctggccgtaggaagcaatgactactacatttccgtgtattcggtggagaagcgtgtcagatagcggcacctaggaccactgccaggccgcagccacctctgctgtacatagtgagccagcctgcactgctcggatgcagtgcccacctacccacccacctgcaaaccccggctcctgacttggccgtggccagctgaggaggggcttgcacatccttccttctgtcttcactataacagcgtacaggtccagagcaggggaggggttggcctggcttcccatcaagaaccagcacccaggcaccaaggacctcctcagtgcagcatggtcctttcctgccctgttttcttctgaggttttacaaagggacacatttgatttttccatgtgatcaaagcattagttacagagcagacagcgccctgtagaatagccgtgctggggctcctaagggccatggcccagccccactgtcctctcagagtgtgctgccagtcctgggaaatggataagagcaattgggggaagagagagggtagaagagagggaaggcctctcctgctacaaggtatggaagtctgagcctggccctcctggagcaccgaggcagtccagcacattgtgtatgtcatggtgctatgaggaaagctagacctctgaggtccagcctggcgggcgccctcaagtgagctagctgcaggagagggtctggttcagggcagatgaggcagatctgtagttagcggctgcctccatctatcaggcatattctgaagtgcttctctcccatagggcagtaacagtggccacaggcctgtctcctgcttgtgccacacacaggtacacacgcatgcaggcacgcagcctccccatccataattacatggatgccctggtcttcctgcccatgtacacttaggtgtgcattcatgcaggcccatagtttcccctcctgcacatatatgggcactgtggccggccacatgcacgcacatgctggcctcaccatgcatagggctcagacacttcactgaactcagaggctggagggcagcatcagctctgttgatggtggaactgaggttacatgatgcagtatgtgctgagcacgagttccacagtgtcctggtgtgcctgacacgtgtctgcgtgcacaggcaagagaggaccatggacactgtagccctagatgtcagcactgtccccgtgtgtccgacatgtgtctgtgtgcacaggcaagtga

SEQ ID NO: 453 - protein, 1282 aa, Mus musculus
GLRTKMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNGWPHRQVLQTVCTAEGAGTRGEVAAINPNHPLAQMPLPPSMKNCIQLAACEAHELLPMIPDLPADLFTSCLTTPIKIALRWFCMQKCVSLVPGVTLDLIENRHGSTNAVDILSRIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRSPPEQLPIVLQVLLSQVHRLRALDLLGRFLDLGPWAALSVGIFPYVLKLLQSSARELRPLLVFIWAKILAVDSSCQADLVKDNGHKYFLSVLADPYMPAEHRTMTAFILAVIVNSYTTGQEACLQGNLIAICLEQLSDPHPLLRQWVAICLGRIWQNFDSARWCGVRDSAHEKLYSLLSDPIPEVRCAAVFALGTFVGNSAERTDHSTTIDHNVAMMLAQLINDGSPMVRKELVVALSHLVVQYESNFCTVALQFMEEEKNYPLPSPAATEGGSLTPVRDSPCTPRLRSVSSYGNIRAVTTARNLNKSLQNLSLTEESGSSVAFSPGNLSTSSSASSTLGSPENEEYILSFETIDKMRRVSSYSALNSLIGVSFNSVYTQIWRVLLHLAADPYPDVSDLAMKVLNSIAYKATVNARPQRILDTSSLTQSAPASPTNKGMHMHQVGGSPPASSTSSCSLTNDVAKQTGHSTPPHSHQFPRTRKMFDKGPDQTTDDADDAAGHKSFICASMQTGFCDWSARYFAQPVMKIPEEHDLESQIRKEREWRFLRNTRVRKQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDRETKVQDIPTGADSCVTSLSCDSHRSLIVAGLGDGSIRVYDRRMALSECRVMTYREHTAWVVKAYLQKHPEGHIVSVSVNGDVRFFDPRMPESVNVMQIVKGLTALDIHPQANLIACGSMNQFTAIYNGNGELINNIKYYDGFMGQRVGAISCLAFHPHWPHLAVGSNDYYISVYSVEKRVR

SEQ ID NO: 454 - DNA, 439892 bp, Homo sapiens
  misc_feature (1)...(439892): n = A,T,C or G
aaccctgtctctactaaaaatacaaaaattagccgagtgtggtggcacacacctgtaatcctagctactcgggagggtgacacaggagaactgcatgaacctgggaggcggaggttgcagtaagctgagattgtgccactgcactccagcctgggcaacaagagcgaaattccatctcaaaacaaaaacaaaaacaaacaagcgaacaaaaatgtgattgtgctacagtattatgaccactacagcctcactaggtgataggaatttttcagctccattgtaatctgatgggaccaccgtgctatgtctagtccacctttgaccacaactgttctgccgctcatgagtgttacttacaacatccttatgaaatagacactgttagtttcccaatgttacagatgaaatggggctggggtaagtccagctcctctcccagagcctcagggcaaggaattgacagagtgaaaactggaactgaggcctgtgtgactcccagcacaagcaggcgctggagggcccccggcagccacttgcaggctaatgggtgctcttgccccatgctgggcactgtgccacacattgcgagggtctgcgcttagcatcaggcagctgtgcttggaatctttgcccagacttggtcagtggagagatcttcagaaagttatttcatccttgtgcgtctcaacttccttgctgatacaatggatctagaacacaagctcttcccaggggttattaggagggttacaagtgttaattctcaggaaaaaggcttggctccccatcaatactcactaagtgttaggattatcctattttacttacaggcatatttctctaatctcccctatgaaaagcagaagcaatggttggcctacctttgtcccctcaggatctactgttcagctgagagcttgagaatcactgatgttatgtaaatagtacataaaataacaagtggggagtttaaaaagagacagttggtcacattctttgtattttcatagattattaaaatgaagggttacaaaaattcattttgcatattattattattattgttattattattattattattgagacggagttttcgctcttgttgcccaggctggagtgcaatggcatgatctcagctcactgcaacctccgccacctgggttcaagcgattctcctgtctcagcctcccgagtagcggggattacaggcatatgccaccacgcctggctactttttgtatttttagtagagacggggtttcaacatattggtcaggctggtctggaactcctgacctcaggtgatctgctcaccttggcctcccaaagttctgggattacaggcgtgagccaccgtgcccatccagtttgcatattatatattggataataaattttctcaacatagtctcaatcatataaactttcctcccccaccccatttttcttttttttctttttttttttttgagacagagtcttactctttcgcccaggctggagtgcaagctccgcctcccaggttcacggcattctcctgcttcagcctcctgagtagctgggactacaggcgcccgccaccatgcccagctaattttttgtatttttagtagagacggggtttcaccgtgttagccaggatggtctcgatctcctgacctcgtgatccacccgccttggcctcccaaagtgctgggattacaggcgtgagccactgcgcccggccccatttttctttttcttttcttttttttttttttttggagatgcaagttcttttattaaattctcaaattacccaatttgtgtgggccatctgtttcctacctggaccttgacacattcagaagtcaacaggacactgtccgaatgggttttggttagtaactttcttatagcgtctctcactgtggctcacccatctgtgttgttctcctcatccattcaggaaatgagattttttttttttttttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagcactttgggtaggccaaggcgggtggatcgcctgaggtcaggagttcaagtaccagcctggccaacatggtgaaaccccgtctctactaaaaatacaaaaattagccaggcgtggtggcgggcacctgtaatcccagctactcgggaggctgaggcaggaaaatcgcctgaacccgggaggcggaggttgcagcgagccaagattgcgccactgcactccagcctgggcgacaagagcaagactctgtctcaaaaaaaaaaaaaaaaaaaaaggatcttatttaaagtctctgtggacaatagatgtccttgcttgtgaagaactggagacattggaaattggaactgcagccccaagtggccagcccaccacatgccacagtcatggaatcacccaggtgagacaagtcagcccttgaatttccaggctgccattactcacagatgctcactgcctttcaaaaacctagagccacttccaaatgcttggctgggacttgaagagaatcatccgtgacatactagaacgaggtttcttttaaatgtcaagatgccataaaatgattcaggcccatccttgaaccttcagggtgagagctgagcagtcacaagcccctttctggtctttacatgaatcacagaatttcaaactggaaggatccttagaaattcgccttctccaagttcctgatgtcacagacgtggagaccaagggtggaggagggcagaggctttgctgaaatctgcaggaattggtggcaggttggggaccatagaatgtgtgtgtgtcttcatcctcagtccaggacccgagtggacccctggctcggggtcacatgtgttaaacagtagagggtgtgttttgttctgctgttttgaggagaaggtgagtctctttctgctttgtcagatggaagtctggacaattacttcatagcattcattcatttgccacacatattgattaagggcccaatatgggacccgaactgaatcactgcaggagactttagagcgaatattgtctaagacctccaagtctgcctggctgtgaactatcctcagagcgacctgatttaagaattcagattctggctctcttccttggcgctgcctatggagggggcagccatctcctccttggcatcatggccgccctcagaccccctgtgaagcccaagatcatcaaaaagagaaccaagaagttcatccggcaccagtcagaccgatgtgtcacgattaagcgtaactggcagaaacccagaggtattgacaacagggttggtagaaggttcaagggccagatcttgatgcccaacattggttatgggagcaacaaaaaaacaaagcacacgctgcccactggcttctggaagttcagtctacaacgtcaaggagctggaagtgctgctgatgtacaacacttcttactgcgctgagatcgctcacagtgtttcctccaggaaccgcgaagccaccacagaaagagccgcccagctggccatcagagtcactgacccccatgccagtctgcgcagtgaagaaaacgagcagacagctcatgtgcatgttttgtgtttaaataaaactgtaaaaactgcaaaaaaaaaaaatgcagattctgaatcccggtctccctgctccccgatctggggctctgggttggaagctgggcatcctgaattttagtttcctgggcgattctgaccacctggtgggtttggacttcaacgtgctcactgacaccttcgtttagaatttcagatacgaaaaatggatttcccaaggtcacacacgttataggtgaggaaactgagtctcacacagattcagtgggctttcccaggtcacagagctagttagggatgaatgggtttagcgttgctgcttttctgtaactgtgacttcctgcaagagctgctggaatgcagctgtctacagccaccggaggtggggagcaaggtgacaaggcagaggacaggagtgattttgttgccttcagatgagaacggggtcttcctaagaccctgcatccctgaagcctctgctggtgactgtgaggatagtctctgccaacagagagggtgccctgagtttcaataggagaattggctccatggggtgtaataaccaaacgaatgtgcggaatgacaatgatttaatcctgtagcctttattaaaggcttgctttgtgctgggtgagaaaggtctgggattgtattcttcattctcattttgaaaggaacacaaatgccatcaagattttgatatggatggccacatgtgtctaagccccggaaaaccatcctgagagatcaagaccatcttggccaggatggtcttgaactcctgacctcatgatccacccacctcagcctcccaaagtgctgggattacaggcgtgcaccaccacgcctggcctcgttttattcttatttatttatttatttatttatttttgagatggaatctcactctgtcacccaggctggaatgcagtggtgtaatctcggctcactgcaacctctgcctcccaggttccagctcttctcctgcctcagcctcccgagcagctgagactacagacgcacgccaccacgcccagctaatttttgtatttttattagagacggcgtttcaccatgttggccaggctggtctcgaactcctgaactcgtgatccaccctcctcggcttcccaaagggctaggattataggcgtgagccacggtgccctgcctacatttggttttatagtccaccttacacagttctctatacattgtaaatgagccaaatttcctgaattgaaaaagagagtcacacaagaggcttgcctccacgcacagacatgtagttttagatgtctgcacgtgaagctatatcaaaataagaataaactactgctaccaagaagtgggaaaaaaatttaaaaaggataaactgctcagaaaacgaaacagattaaacaaaaaattgtattagatgaaattttttttcatcgaatcttgctccagactcttcttctgttgcttcagacccttcttcatctgaagagtcttgctctgtctcccaggctggagtgcagtggcacgatcttggcccactgcaacctccgcctcccgggttcaagcaattctcctgcctcagcctcctgagtagctgggattacaggcgcgcaccaccacgcccagctaatttgtgtatttttagtagggacggggtttcaccatgttggccaggctggtctcgatctcttgacctcgtgatctgcccgcttcggcctcccaaagtgctgggattacaggcgtgagccacggcgcccggcctttcacttggttctctatgaaaaaattaaagagaaaatctgattgacactgtggaggacactacactccaaaaaaaaaagtactatattttctaatattatcagtgctttttaatattttctaatattatcagtgaagcttttgccgctttttcaaaatctggaagaaacaaggcggttgattcctttaatttcaggagcatgtaacttcatttataatgacaatgtttttgaaaaaataaattaaaccgacagtttcatttgtaggattgactttaataacacgcctctactgaacaaatggcgattaactggggaaaacggaattatggtaaccgaggtaacggggtcggggactctttctccttcgctgcatgctgggtggcggggagagaccgctctgaggaggtttggtctgtcggccacgccgtaggccgcggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactccccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcgggtaagtggattctgaaggcaccccttgaacttggtagtttccccaacaaagaaagtttacagcccgaaaagtgtccttgggaaagcgccgacatttccccctagccacacgttgtaagtcaactagaaagcaaaagccatttcagactgcagtttttggttgaaaatggaaaatgctgttttggttagtcattattcactgggtagtgttaattcaattccaactaagttctaattcagataataaaagttaagcaaatttgaaaatagagcattgcgagtatttacatgctctttggcatactacttagttctgtaaacacttagaggaaggacaacgtgcgatataatctttatacccacatgattagtctactttttaaaatatccaagctgggtgaagtgcagaagtctgatatactatgctaggaaatgagattactggaaaatgttcaactagtaacaaattagtgcaaagttattataaagttacactgaacttcattctagtcttctaaacaatttctcttgaagctagattttcctccttttatgtagtgtcctgttgctgtaacttggaaacaggatttctttaatcgtgagttagggtatgaggcgtcgagacttgggtgcaggttttagggtgtccgcatggtgtttggagtgtggagagtgactcacaagcagctggtaggaaagaaaacagccgaattttgttggatttgtccttcataaaacaccatctatttcctggcctcaaaagcaaaagggtagtactgcttctcctctatgcacacttataatttgtctttttgtaagttattttctccctccaggctgcttttatttgcacatttcagtggtataaaagaggaagttggtgttacaatgtttgattttctctaggcttatgtatatgtttatggaatattattgttttttagtatatgatgttgaacatatataagattacacttctgggctgggcgcggtggctcacgcctgtaatctcagcactttgggaggccaaggcaggcctcccaaaggcaggcggatcacctgaggtcaggagtttgagaccagcccggccaacatggtgaaaccctgtctgtactaaaaatacaaaaattagctgggcttggtggcaggtgcccgtaatcccagctactcgagaagctgaggctggagaatcgcttgaacctgggaggcagaggttgcagtgagccgaaatcgcaccattgcactccagcctaggggacagagtgagactgtgtctcaaaaataaataaataaataaaacttctggtaactctagtcagtcagtcagtagtaaccagttagctactgacttggcttacttctaaaaggttaggaaaatttgtttcatccaaaagcattttaaggagttaaataagttagtcattgggggaggttgtataaattctatcttatggacatctttagtagtaactatatagttaaaagcttttgtggttgctatacatatatgaaaagactttttaaaaaattctttgtggagggcagtttttttgttgttgttattttgaaatgtggttctctctgctgtcctaaacctatgttccaacagtttgaaactgattaatgggtatacgtttgaccttttaattaaaacattaatttgtgaatgatcaacattccctaataagcttttcacaggttgttaagagaaacaaaagttctgtgactcttagtaactactgagattgctgcttagaaaggagctggggagaaagtttgctgtatctgtttttcgttggagaaaatcagcagctaacatcttcagttgagtgtgtgggagtttggaatcttgtcatctcttccctcttccaaaggtcaggtcctttggaatcttgtcatctcttccctcaaggaccgtatcacacatgctataggacagaagttgcaaactcaaatgatattgagtggggatggtagcataagagaatgaaacaggccacatttaagaagaataatggcataggttcaaagataaagacaaatggcagctgacatttggcacagtgtgtgtgacagtttctggagggtgggaacaggggctccctgatgccataactgaaggggcaactgggctatggccaggcctctctctttgtctttgagaagtcagcaaactttttttttcttttattgtaaatattcatactaattcagatttattaccaaacacactgtagtccaacactgcaggctgaacaaccccatttgtggagtgtttttctgtttcttttttttttttttttttttgagacagggtcttgctctgtcatccaggctggagtacagtggtgagatcacacggctcactgcagcctcgacctcctgggcctgagtgatcctctcacctcagcctccccagtagctgagactataagtgtgcgccagtgtgtctggggttggggagtctcactgtgttgcccaggctggtcttgaactcctgggatcaagcaatcctcctgccttgtcctccaaaaatgctaggattacaggcatcagccaacacgctcagcctggggtggttttttttttttttttttttttttgagatggagtttcattcttgttgcccaggctggagtgcagtggtgtggtcttgactcactgcaacctccgcctcccaggatcaagctattctcctgcgtcagcctcccaagtagctgggattacaggcgcctggctagttttttttgtatttttagtggagatggggtttcaccatgttggccaggctggtcctgaactcctgacctcgggtcgttcacctgcctcagcctcccaaagtgctgggattacaggtgtgagccacagcacctggccctggggtgttttttgaccagtgggttacctacgtaagaatctctgttacccaggcctccaggccacacagtcccactgtgctggacgtagcctccagtctggtggagcagcatgtttgtaaagtgaaatgtgtgggcgtggttgttctgtgctaggagctacatcaactacttcctggtggccactgactgtcctaaatgcaagctgagattttgcttcttcttgtggttaatgtgcaattccatacgcttttattttgtacatatattcattagttcttactggctcctatttagtagccttgctacagattcctcaaattgacatctttaccaaagttgactgactgatgactcccaagaagttttttttgccacccaacacttggcatccttccagagctacagcccttgcccgctctcagttgggattcctgccatctttgttttgaatcagtcttggttttcaaatgccacttttaccacattttaatttctaagttactgttactttaaaattattatcaagttagtttgttgtttggttaattctactatgtatagtgaatgaggcatatatgtatccatagtgtttttagcttgcaattttcaaataactagacatatatgaattgtagttcaaaatgaatcattcacagacctttggctaaaacagatacgtatatatctcccctatttgtgtttttggctcactgcaacctccgcctcttgggttcaagcgattctcctgccgcagcctcccgagtagctgggattacaggtgcccaccaccatgcctggccaatttttttcatatttttattagagacggggtttcactatgttggccaggctggtctcaaactcctgacctcaggtgatccacctgcctcggcctcccaaagtgctgggattacaggtgtgagccaccgtgcctggtctaactgtgatactttatagttatcacagagttcattttcctactggaaagtggacagtggggataactggtctcagatgactcttttgcctggaatatgtgggatggaatgacgggtgcttgagagctattgctctgaaagtgttgacagacatgctatgtctacacacatgtagactgacagacacactgtctacatgcatgtagcacccctggcagacacattctgtgtacacatgtgtggtgtcattgtcagacactatttccatgcatgtgtaggaccactgacaggcatcctatgtctacatgtgtaggggatgaaacggttagatgaagaaggctattttgtaaaccattctctagactcagttgcattgctctgtagccatactttgcccaggtcatggaggaagcagagtagatctgttcaactaatacatggactgccaaaggtttatgcggtcttttcagcaagggtaatagcaatccttcataatctacactaccccctctgctttcctcaccttgcgtcctctccacattccaactgtgccctgttccactcccctgagactggtctccatatggccccagtttgttgctaaatctaaagttctcttctctgtccttctctgttcttatttcacctctcagcagcattccacaatgtggaccatggcctcttcataaagctctttcctcacttgcttctgtgtcttcacgaaactcggattttcctcttaggtcactagttgttccttctcagactcctttgctacctgacacctaaatgcaggggcaccccaggaattgatcttggaccccattctctattctgggtgtgcccctccctagcagatctcatcggggcccatgattttaaatagtgtctacatgccagtgatgcttaaacccccaatctttagttctgatctggcctgaaatttctgtctcagatgcctactgcctgctttttcttagttttctccatcaccacttgccacaaccaccatccactcagttgttcaagctgtaagtttagagtttatccttaattctttcctctccctctctttatcgccccatccaattcattagaacccatcagcgttacttccaaagcatgtcttacattggcctgcttcattttgtctccactgatgcagccccagtccaggcagccactgtctcttgtctggacactgcatttgtgtcctgactggtctccctatgtccattcttgccctacaaccagtttttcacatagcagtcagagggatcttttatttattttgaaatggagtctctccttgttgctcaggctggagtgcaatggcgtgatctcggctcactgcaacctccacctcccgagttcaagagattctcgtgcctcagtctcccgagtagctgggactaccagtgcatgacaccatgcccggctgattttttgtatttttagtagagatgcggtttcaccatgttggccaggctggtcttgaactcctgagctcaagtgatcctcccacctcagcctcccagagtgctggattacaggcgtgagccatcacacctggccagagggattttttgaaagtgtgaaggggtgggttgcccctccacacctgtgggtgtttcttgctaggtgggacgagagacttggaaaagaaaaagaaacagagacaaagtatagagagagaaataaggggacccagggaaccagcgttcagcatatggaggatcccgccagcctcagagttcccttagtatttattgatcattcgtgggtgtttctccgagagggggatgtgtcagggtcacaagacaatagtggggagagggtcagcagacaaacacgtgaacaaaggtctttgcatcatagacaaggtaaaggattaagtgctgtgcttttagatatgcatacacataaatatctcaatgctttacaaagcagtattgctgcccgcatgtcccacctccagccctaaggcagtttttccctatctcagtagatggaacgtacaatcgggttttataccgagacattccattgcccagggacgggcaggagacagatgccttcctcttgtctcaactgcaagaggcatgccttcctcttctactaatcctcctcagcacagaccctttacgggtgtcgggctgggggacggtcaggtctttcccttcccacgaggccatatttcagactatcacatggggagaaaccttggacaatacctggctttcctaggcagaggtccctgtggccttccgcagcgtttgtgtccctgggtacttgagattagggagtgatgatgactcttaaggagcatgctgccttcaagcatctgtttaacaaagcacatcttgcaccgcccttaatccatttaaccctgagtttgacacagcacatgtttcagagagcacggggttgggggtaaggtcatagattaacagaatctcaaggcagaagaatttgtcttagtacagaataaaatggagtctcctatgtctacttctttctatacagacacagtaacaatctgatctctcttgcttttccccacaaaagtgtgaatcagattctgttacttccttactggtggtctccattggcttcctctgtgcttaaagtagaactcagactcctcttgctggttcacaaagccttcatgatttggcctctgcctgccttttctgcttcttggatagaaactcctggaatgcttttctctctgatctttgcacacctggccccttcttcgtcgttcatacttagcatctaggtcccttcctcagagaggcccaccatcaccccatctgaagcagccaccctggcactcataaaccctcctgatggctatttatttctctgatatttttctccctacttcctcctggagatgtgagcttttcatcataaagcaaggacctagtctagtctatgctagtccatagggcagtgcttggcacatagtagggattcaacaaaactatactgatacaaaatggatagtttacaaaaggcttccacatacattatctttaaggctcaacagcaccataaattacctagggatcattctctccatgttactgatgaggtaactgacgttttaattgaatggcttacctaaagttacataagtaacatggccagcagtgagaggaagtggaacctgtgcagagggagaaacaaagtttagttcaaaacaaaacaaaacaaaactgtatcataatgtctccactgaaacatttatgttaagaggtcagggggttgaaaatagcagaccagcagaccaacattcagcagacagagaaggatgctcagtctgctcacagcatgtgccctgtgcactggggcttctcctagacccttgcagggatccacaaggtcaaaactgttttcataataatggaacaccattggccttttccactctgttgatacctgcactgacagtgcaaaagtgatgaatcaagacagtggtgccaagctgtactactagttcctgatttctttgccatgcacatggagagaatgtccttgctaataaagcagtgaaaatgatgacttttactaaatcttgactgttaagcacacatctttttcagactgtgtgtgctgctccttctcctgcaggcaaagcccagtggctgcctggaggaggagcatctgctgccttcatggacgcagcacgtcccaaaggaatcaccgacaggccgcctctggatgttgaggcctgtgtccacggcagacgtgtttttgaaaatgaacttagtgagctgtcacttcaaggaatacagctgacggtatttgctgccagtcatgaaatttgaaccttcaagtgaaaattggttttggaaaacttgtatctgccgctgtgagcctggcagcttcccaagacttaaagatgtttctggtgagatccatagtgatattaatgaatggaattaatgttgtagaatgaaatgtgcccacatttggaacagctgcataattcagtgaacaaatatttccagatgaccaatccatgatattataaaatcatccataggtaaaagatccgttcaatgttagaccagtggattttaatgtaatagggtacaaaaagttcaccagaggataggtgtttttttttcttttttttttaagacggaatcttgctctgttgcccaggttggagtgcagtggcgcgatctcggctcactgcaacctccgcctcccaggttcaagcaattctcctgcctcagcctcctgagtagttgggattacatgtgcctgctaccacgcctggctaattttcatatttttagtagagatggggttttgccatattggccaggctggtctcgaactcctgacttcaggtgatccacctgccttggcctcctaaagtgctgggattacaggggtcagccaccacaccccgcttgatgttctgttgtgtgcgtgtgtgtatattttttgttgttatttgtttgtttcacagttcactgcatccttgacctgggctcaagtgatcctcctgcctcagcctcctgagtcgctgggactacaggtgtgagtcaccatgcctagattttttttttggattttttgtagggatggggtctcactatgttgcctatagtgagagtttaaatattttattcaaatagattgcaacagatctttaagaaactaccacttactcaattttgttgtaatatcaaataataatattctcaattatttggatattctgatactcctgccattatgtatctttgtgaggccagatttttctcacatacttcaaccaaaacagtgtatttcaaccgattgaatgtggcaccaaaaatgagaatccaaggtggggtgcggtggctcacacctgtaatcccagcactttgggagactgaggcgggcagatcatgaggtcaggagatcgagaccatcctggctaacacgatgaaaccccatctctactaaaaaataccaaaaattagccgggcgaggtgacgggcgcctgtagtcccagctacttgggaggctgaggcaggagaatggcgtgaacccgggaggcagagcttgcagtgagccgagattgcgccactgcactccagcctgggtgacagagtgagactctgtctcaaaacaaaacaaaacaaaacaaaacaaaacaaacaacaacaacaacaaaaaaaatgagaatccagttgtcttctatgaagctggatattaaagagatttgcaaaaatctaaaaaaagccacctgagacaagtgacaagataactgacaatttttgaaaatatagttatttgtagaaatgttatttatttgaatatataataagtttgattttcaagtgaattcataaatatatcaattatgtttttctgttttaaccttcaatacggaaaatgttgataaatgaaactcataaaaaagctctttgagggtcttcaggaacctttaagaccgtaaaggggccctgctgccagatgtttgagagttattagtgtagttagaagaaagtgggcctcatccttaggaagaagggcttgaggatatcaggtggctggtcagaaatgtcaggcagggccttgaagtgacattagataagaaacataaaggccctaatctgttgccctctttccattcgctctgcctaaagaactgttgaggtctctggacttggagctgggaggatgtttgtgaagagcctgtgtgattgtgagggcagtggccttacatgtggccacctagccctccatcaggtccttctattgctccagatttctagtgcgtgtccggagggagatgcaccaccgcccacccagtagctcttgtgctgggagtggaggaacacccagtctgtctggaggaatgtccactctgtctggcaaggaggaggtggccagaggttcagccaaggtggacagctcacgggaagtgtcctgtctctccagggcgctgctgcctagacagactgacagacacggtagcaccaaattacaatacgcaagtataggtatcaatcatagtaattacaggtgagaatgacattattacggggagcatcttgatttaatattaaataagtaaatcatttgcattgaactgcatttatgaaagaaatcatccacattgaccagcattaaactcccagcagccagtgacttcatgtagttggtgatggggagctgtcccaggattccagctggggagttgttgtgcataaatttgtgttttgaaataccttattggctatggatggagtggggtgattggagaggggcgagactggaggtgggggcaccaagtggagaggagttgtgctaatccaggtgagaagccctgggggctgggcgtggtggctcacatttgtaattccagcacttcgggaggctgagctgggaggatctaaaaagtttttttttttttnnnnnnnnnnnnnnnnnnnnnnnnnnnnnnnnnnnnnnnnnnnnnnnnnnnnnnnnnnnnnnnnncatcagcgcttgtgtgattgtaaggccagtggccttacaggtggccacacagccaccgtcagggcctcctatttctccagaattctgtctcacctctccaatccctctactccatccacagacaataagatctttctaaacacaaatttatacacaacaattccctagctgggctcctgggcagctccccatcaccaactaccatgctgagcccaggaatttgagaccaacctaagcaacaaagtgaggccctgtctctacaaaaagtaaaaaataagccggacatggtggtgcgcacctgtggtcccagcaaattaggaggctgaggtgggaggatagcttgagcctgggaggttgaggctgcagtagtaagctatgattgtgctggtgcactccagcctgagtaatagagtgacaccctgcttcaataaaaacaccaagaaaagaaaccttgggagccacaaaagaggcggctgcagtaggaatggacgatagagcatggatcctactgatttgaagaaggtagaaatagaatgtgaagtggatgggttccagtgggtggagtttgtgggtgtagtgtggactggctggctggtacagttccgctctttttatttgctcttgaaatggatatacttttcattagtgagtctcatgtgagtttcaggagtcacaaagagaccatctacccagattaaaaaaaaaaaaaaaacttaaaacatgctggccaggcacggtggctcacgcctgtaatcccagcactttgggaggtcgaggcgggtgggtcacctgaggtcaggagttcgagaccagcctgcccaacatggcgaaaccccgtctctactaaaaataacgaaaaatgagccgggcatggtggcgggtgcctgtaatctcagctacttgggaggctgaggcaggagaatcgcttgaactcaggaggtggaggttgcagtgagccaagatcttgccactgcacttcagcctgggtgacagagtgaaactctgtctcattgttccattctgaagagctgtggaagactcttgagatggataagaacatgtcctcattatcaccctgtggagttctagagctagagttttaacaagatagcatgtggattacacataggaggtgtcctccagtttctgactctatcctcctcttattcaaatgactttaaaaaggaattttgaaggctaaggtgggaggatcacttgaggaaaggagttcaagaccagcctggtcaacatggtgaaacacccatctctaccaaaaatttaaaaattaggcgtggtcgtggatgcctgttatcccagctacttgggaggctgaggtatgagaatcgcttgaacccgggaggtggaggttgcagtgagccaagatcatgccactgcattccagcctgggtgacagaacgagactttgtctcaaaataaatcaataactcaataaatcaatcaataaatacaaaaataaaaaggtattttggtcatctacaatacttgtttcaggagagctgaagtttgatacctttttctaagtctaaatatatggaaaatggccaggcacagtggctcacgcctgtaatcccagcactttgggaggctgaggagggcagatcacttgaggtcaggagtttgagaccagcctggccaacatggtgaaaccctgttttctactaaaaatccaaaaatcagccgggcatggtggcagatgcctgtaatcccagctactcgggaggctgaggcaggagaatcacttgaacccaggaggcagaggttgcagtgagccgagatcgtgccactgcactccagcctgggcgacagagcgagactccgtctcaaaaaataataataaataaatacataaatatatggaaaatgccattccagtaaatatttggcattgcaaatcaatgctttaactgtgttctaggctgggcacagtggctgatgcctgtcatcccagcactttgggaggctgaggcaggtggatcatttgagctcaggagtttgagaccagactgggcaatgtggtgaaactctgtctctacaaaaaatacaaaaaattagccgggcatggtggcatgtgcctgtggtcccagctactcggatggctgagtcaaggggatggtttgagtcagggaggtcaaggctgcagtgagctatgatggtgtcactgccctccagactgggtgacagagctagaccctgtctcaaaaaaacccctgaaacccttaaacttgtcacatattggtgggtgtgactgcagagaattgtcatgccttcagaggccgaacaggaaacagctgaagaggagacagtcgccgagaacaagtttgaattttacccagctgtcggtatatttttcaggtgcgtttattgttcttgactagtactttttgtattttaaaatgttgatgtaatttcaaactgacggaaaacctgtaagaatagtatcatgagcttccctatagcctttgcccaggtttgcagattgtttacatctcgccttgtttactgtcaccctccatttacatattcagactgagctggagatgctgtcccccttctactcctaaacaccgtgtctgtctccttagaggaggccattttcttacgtaagcacagtgcagttgtgagagtcaggacctgtatcatggatatgtgctcccggccctctgtagttcagaaggtcaggtgttgctgcctgcccagcaatgccctcattatgccccgcccgtcacccaggatcacacgttgcatttggtggtcgtgtctgtgtagcctaccttaatctaaagaagtctctcagtctgttttagactttcttgaccttgatttttttaactgtgaatttaccatctcgaccatctttcagcacacagtttagtggcagcaagcacacccacatgcttgtgcagccaccaccagcatccgccaccagcagccatctccagcagctttccatcttcccagactgaaactgtctccattaaacaccaactccccattccccttccccagcccttggtaaccgctcttctgctttctgtctctgaatgttttggccttgcatgtagtagaatgtcctgaatttgagctgcctagtctttcctcatattcacactgagatggggcattttgggtaatgatgcacctttgtcagtgaatcccatcaggagcacacgacggtgctttgtcccagtactgtcatgctcatttgatccattaccttcaagccgtttcttgctgagtggtcgcctcctgactgatgctgcccttttgccatacctgtttgggagcacgtcctgactttccagcacaaccagagggcccaagctcactctgtgccctccctgccccagtcctggaattagccttttctccaaggagcctggttcctgttagtggcgaatggcattgagaagccacgaacgtgtgcatttagagctgggctgtgtgctttgcccttggtgtggcatgcgtctcccgttggttggccctctgagcaggagagagaggatggcgctctgtcttgtttacctctgtttctctgtgtatgctggaaccatggatgtgtagagagagctccagtccagctcctcaccatgatatgttcagcccttcccactttgcctgctaccactccctacccagccatgggaaaccagctccattgtcctcatttaatcatgggctcaaagctggaatgcacagaagggagcctcggaatggctaacgctggccacttgggaaagcaaatgctgcaagaggttgacttccttgttttctgaggtaaacgttacatatggtgaaatgcacagaccccagctatctgaacaattggctcatgctgtctagaaatgtcagcattagtcagtgttttgtgggaaatcactgttgttttacatagatggcactgcacgtagggtgcatggggtgaaggggacggaagacgtggtcatggccctgtaggaatttacatcttataagagaaaaacaacatccttacccacagctgagtgaaaagcacagtgcagtcatgatctgcccttgagtaacaaggtagcgatttcaggaattctgcagctggacattgagatggtgtctgttctgcaccagagacttggctgagctcctagctggatgggctgtggagtccatggtggctggacgaagatctgtgtgctcaggtggagtggttgcgggagcagggcggaggatggacaatgaattcacaagtgactgatgtatagaatttagtcattcagctactatcatcgagccccttctctgtgctgggcactgggctaagtgctgcggataccatggggagtaattcctgcgttgaaggtgttttccagtctatcagggcagatggatgacagtgcaggaggcagggtgtgaggtggtggtggctggatgggccggacggagaaaggccttctggaggtgggagctctaagccagtagctgaaacagaatggaagggaggggggtggaaggttcagctggaggaacggggacgtgcaggagctgagaggtgagtgagcagggtcttcagggaaacgccactgggggcctcctgcaaggggccttcccttgtgctgtgggagccgcctcatgcccacccggtgctctgtgcctgccattcccttcccacactgccactccccagcacttggctacgtgttcgttttgtctccccactaggatgttgtatagagaacagggactctgtgttcactgcggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncagtttaaaggatatatcaaaacaaaagtactgtgaaaaagttaaatcagatttttcctgcattttctgtaagtccttgctgaggtccagatttagttttcagctagatgtgaccgtcgcctgccttgctgccgatgtcctgaagatgcttcatgttggcacatgtggcttcatcgggtgggctaccatcctgcatcaatagtgggccgtttccatggtttctggtctgttgctggtctggcttggcaggtggcagagcctgggtcagacccgcagtttggcctcagggctcaggctccagagaaccactgtgcagccttttacttcgtacacacagctcttttcaccaagatgtgtttttactgggtcagcaggcatgaatgttttccctgaagagtttttttttttaatttttatttttgagacagggccttgctctgcaacaggctggagtgcagaggtgtgatcatagctgaggaggctgaggcgggtggatcacgaggtcaggagttcgagaacagcctggccaacatagtgaaaccccgtctctactaaaaatacaaaaattagccaggtgtggtggcggccgcctgtagtcccagctacttgggaggctgaggctggagaatcacttgaacccgggaggcagaggttggagaattgcttgaatccaggaagcagaggttgtggtgagccgagattgcgccactgcatttcagcctggataacacagcgagactaagtctccaaaaaaaaaaaaaaaaaaagataataaataaataaaaaataagggagataaagttctgttttctttttttgttttgaaatcaagatatttgttttagtcaggttcttttggttgcaaagaagagtctcacttaaatgtccctaagcaactatgttgcctaaggatgcccagtgcatcttaattgctggatgagttgccacaaagtgaacactctcacaaccagatccagaaacagaacagccccgccttgaagatcctctgtgcccccagtcgtgcccacccctccccaggaagctgtgctcctgatgtccagggttgtgtgaccttacttttgcttttggtttctctcgctcagcattgtctgtgagattcatccatgctgctctagtagccatgctcattcacccccttggaccgcagttaactcacctgctgatggacatttgggtggtttccagcatttcggctactaaaattgtgctgcagggaacattcacatgtcttttcttttttttttttttggagacggagtctcgctctgtcgcccaggctggagtgcagtggtgtgatctgggctcactacaagctctgcctcccgagttcacgccattctcctgcctcagcctcccgagtagctggaactacaggcgcctgccaccacgcctggctaattttttgtatttttagtagagatggggttttaccgtgttagcaaggatggtctcaatctcctgaccttgtgatctgcccgcctcggcctccccaaaagtgctgggaccacagctcgcatgtctttttgggaacatgtatctaatatgtctctggtgttgattcctaggggtggaattgctgggagatagagaatacaaatgttcagctctaggagataccgccacacccttcttattttattttattttttcatattaaaacaacatttattttaggtttagaggtacatgtgcaggtttgttatataggtgaactcacgtcacagtggtttgtgtacagattattttgtcagccaggtattaagcctagtacccaatagcttttttttttttccggatgtgcaggtttgttatataggtgaactcatgtcacagaggtttgtgtacagattgttttgtcagccaggtatcaagcctagtacccaatagctttttttttcagatcctctccctcctcccaccgtctaccctcaagtaggccccagtgtgtgttgttcccttctttgtgtttgcatgttctcttcatttagctcccacttataagtgagaacatgcggtgtttggttttctgttcccgtgttagtttgctaaggataatggccttcatgttcccacaaaggacatgatcttatttttttgtgtggctgcatagtattccatagcctatatgcaccaccttttcttttctatatgttgatctctggcatgtaccacattttcttatctgatctgtcattgatggacatttaggttgattccatgtctttgctattgtgagtagtgctgtagtgaacataagcatgcgtgtctttatggtagaaggatttctagctttgtgtgagagtcccagttcctccacatgcttgccaatacctggaacgcatgttatcttgaaagttttgtagaaaaacacctacagtccttacccttgagacttgtacagataatactaggaagtgtctcttacatgggagagtctttttgtaactgttggatgactgcgccaatgccatcaatgactttgtgaggtttggtggaataaggagcttggtagaagctggattgctgcggaataattgttaagaaggcaaagggaaggggaggtggtggtcacacaccatggggggtgtaggaggagcaaggtgggctggtgactgaaggaggccacagtaaaacaatgttttctttgagaaggagccagtgcaggggagagtcaaggcaggggagaatgtggtgaagcaagcggcactgctgaggaggggttagagccccagggctgggaggcggagggaggcgtgcactgctgtggaggggttagagccccagggctgggaggcggagggaggcgtgcactgctgtggaggggttagagccccagggctgggaggtggagggaggcgtgcactgctgtggaggggttagagccccagggctgggaggcggagggaggcatgggtgtgggagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatgggactacaaggcatgcgctactatgcccagctaatttttttgtatttttagtagagatgggatcttgccatgttgaccaggctggtctcgaactcctggcctcaagcagtctgcctgcctcagcctcccaaagtgttaggattacaggaatgagccactgcacccagcccacatatttctgtttctaggcttcattccttttatagctctgagcttgaatctggtatattttccttcagtctgaagaactttaactttgcttatagtactggtattttggtcacatgttttctcagcttttgtttgtctgaggttgtccttatttcacctttatgctcctagcactttaaggatgttctgttgtctcaggcttgtcttgttcctgaagtctgctgttggtcttacttttgttctctagtatgtaatattctttttctcctccagctactttaaagatgtttttgtcattggaatttagcagtttgattacaatgtaccttggtgtagttttctttgtgattagcctgcttatggtttgttgacattcttggatctgtaggattatacttttcaccaaaattttggaaaatgtactgccattatttttccagttttcctatctctccccttgttcctcctcaatcttccagagctctatttacatttattttagatgctagatattgtcccactgaggatccccattccctccatctttttttcctctgtgattcagttgaattgtttctgttgcaatgtcttcgcgttctctcatctattcttctatagtatctaacatgctctttattttattgttacagagacaggaggatctcactatgttgcccaggctggtcttgaactcctgggctgaagtgacctcccatggtgtcaggattacaggtgtgagctgcaatgcccagccctaccatgctcttaagccaactcatccgatgtatttcaaaatttcagatgctattttttttctttaaaagttccatttggatttctttcttcgtattcatgctctcttttaaatccttgaacaaatttgtaatattgttttaaaaatcttatctgttatttcctcgtcactctcatttttgggtctagatggactgactttcttgtggttgtggatcaggctttcctgctttttcttacctctagtaatttctgattggatgctggacatagggagtgttacgttgttgagcatctgcgttttgttttctgcatttaaacagtgttgagttttgttctggcaggaagttagtttacttgtagatcagctgccttcttatagggcttgttttctgtcttttaaaaacaggtctaggccgggcgtggtggctcacgcttgtaatcccagcactttgggaggctgaggcaggagaatcgcttgaacccgggaggtggaggttgctgtgagccgaggttgtgccattgtactccagcctgggcaacagagcgagactctgtctcaaaaaaatgaatgaatgaatgaatgaataaataaataaaagcaagtctaggtcaggattggaaaactatggccccttgcttgtttttataaataaagtcttctggaacacagtcccattgtttgtggatggtctatgttgatttcatgtgacagtggtaaagttgagaagttgaggcaaaatctatatgtcccacaaagcctaaagtatttattatctgcccctttacagcaggaaatttggtgacccctagtctagagaagcctttacttttggtctagtttagccctgtgcctaacgttgtggcctttctgagtctccgtgagggtcgtgggtgcttcatgaggtcccttaattcttcctcgttggagcttgaatgtttctcaccctgctccgcttctcctgcccctgtggctgctctttgcctggcctcctggagtctcaccagcagcacgccctgccttgccttcaggcagggactcaaggagcccagctccgtttctgcctcctccgtgtggctgtctcctccttgttactctgccgctctcattctggctgctgtggccatcatgaactcagacctctctctcctcagctcagtgactgtcacggtctgcatgggcccctgtctccatgcagaaagctcctgtgtcacggggcacacctcatttgtcttcccgctcagggaccacgttcctgtatgactcgttgttcaatgcctgaagaagtgttttatgtattgtgttcagttttctagttgtgtatggtgggagggctaggctgttcctacttagtccatcttttcctggaagtggtagtccccccaagtatgatatagaaggggcaaatgaaagaaagtgccagatagatgaatgatgcgtgacgggatcaccttttattaagtaggttagagtagctgatggttgatttttttatttttattttttatctttttgagacagagtctcactctgtcacccaggctggagtgcaatggtgcagtctcggctcactgcaacctccgcctcctgggtttaagcgattctcctgcctcagcctccggaacatctgggactacgggtatccaccaccatgcctggctaatttttgtatttttagtagagatggggttttaccatgttggccaggctggtctcaaactcctgacctcaagtgatctgcctgcctcggcctcccaaagtgctgggattacaggcgtgagctaccatgctgggcctgatggttgattctttacagtgaataagttgttatgtattaataagttgttctttcactgaacctaattatcccccccagtggagtttcactttccaacttacacacagcattaatatttaagattacattggtgtatcacattaatagtacagattaaagtttggaagagttcagctttcatgatccctagacaactaatttgcaaggctagatttagagtttctcctttctctgatagaaacatttgcatttcacttgggctttataacgccaggtaggtcagaggttgaaactgaaataattgttaaacacgtaagaggatttaaggataaaatcctcccctgttttggtgttacagatctaaattgggcactcagtcatgtagtgccagagtgcgggatttggctggctaccttaaaggtttagttaattatacagaaatcctctttcagtgttaatcattgttcatgtcctatagaaaatggtctaattgttcttttcatttagctattttgtttaagaaggtcctttctagtctgatttgatttctttcttttttgaaattaggaagtaaagaatacagaaaacatctatttacaattccatcagtatttataaaaacatctgtgtgcccccagcccagtcaagatatagaatatttcagtaccctaggacttctttatgtgttgcaccttgatcccagttactccttttcttaaagaggcaaatacttttcttccttttgttggcaataattatctcttcacttttcttttgagatcgggtctcattctgtctcccagactggagtgcggtggtgtgatcatagctcactgcagcctcgacctcctgggctcaattgatcctctcacctcagcttcccgggtaactgagactgcaggtgcacaccaccacaccaagctaatttttgcattttttgtagagacagggcttcaccgtgttgtccaggctcctctcaaactcctgagctcaagcaatctgcctgccttggcctcccaaagtgctgggattataggcatgagccactatgcccagcctcttcacttttcttaatggttttcctacctgtgcgtctctaaaagttgtacttgcgttttcgtgtgttgcttcttttctcagtatcgtattgataagaatcaggtggttgagaaaaacatttaggtatgctgtagggatagagtaactattttaaattcttttaaacaaaaaaatcaggtgcttgaatatatgttgtttacttctatgtaatatctcatttcatgtgtacatcacaatttacttatccattctactgctgaacaatgttgaaattagcattacatatttattttagagactgcgtctcactctgtcacccaggtgggagtgcagtggcaccatcacggctcactgcagccttgacctcccacggtcaggtgatcttcccacctcagcctcccaagtagccaggactacaggcaggtgccatcatgcctggctaatttttctttgtatttttttgtagagatggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntctgtcgcccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttttagtagagacggggtttcaccttgttagccaggatggtctcgatctcctgacctcatgatccacccgcctcagcctcccaaagtgctgggattacaggcgtgagccaccgcgcccggccggttttttttttctttttgagtcagttttggcaagttacattttaagaagactttgtctatttcatctaggtttcaaatttataggcataaagttgtttgtaacatcctcttgtgatctttttaaagtcaatgggactgtagtaatgtttcctttttattcctgacattgagatttgtgcgtccactcttttttgttgttgtttttttgagacaagatcttgctttgtcacccaggctggagtgcagtggtgcgatcatggctcactgcagctttgaactcctgagctcaagcggtcttccccccttagcctcccaagtagctgggactacagatgtgtgccaccaagcccagcttatttaattttttttttttttttttgtagagacagggtcttcttatgtttcttaggctcatcttgaactccttggcctcgagtgatcctcctgccctggcctcccaaagtgctgggattacggatgtgagccaccatgcctggccccctagtttattttatatcttattatttccttttttctactttccttgggtttgttttattaccttttccgccattcttgagggggagattcttgagatgagtacttaccttattagttttcagccatttgtcttttctagtgtatgcacttagcatttagaaatgtaaatgcttaatggcattcaacaagtagtagtttttaaaaatatatttatgtatttcagagacgaggtctccctgtgttacccaggctggtcttgaatcctggctccttccgccttggcctcccaaagtgctgggattataggcatgagccaccatgcctggctggatatacagtatttttgttcagttcaaattattctctaaattttattttgacttgatcaatttattatttaaaagtgttgtaatttttaaacatagaagactttttctaggatttatttttgatttcttaattgcattttgatcagtagacgtctgtcagcagggcagtagcaggtgcaccgcacgtctgtagggggagccatccacaccgttgccatgtgcgaatggcgccccctcgtgttgtggatggtgtaggttgcaccgctgtgtgcacacgtgtgcatacatgcatgcacacgcttggaatttcagctgctctgtcccttataggcccgtgcgtggtcagtttttgtaaatgttccctgtgtacttgaacacgatgcgtgtctacagctgttggtgccaccttttatacgtgtccattaagtcaaatattttatttgtggtgtacaaatcatttacactttactgatttttttgactgtttctatcagtaacagagaggtgtattaacacttctcaccatcattgtaaatatgtctattctccttattagacatatttagatagaattctctgcccatttgtgcttcatttatattttgaggccatattgttgtaaaactgttgtatcttcctggtaaattggagtctatattgttgtaaagtgactctttatccctaataaaactttttgccttacagtctgttttgtctcaggatagttacaccagttttctcttggttagtgtcagtcttgtttatttgtccttttatataagtcaacacttctgtagccttgtatttttcatatgtctcctataaacagcttgtagttggattaaaacagatcagtctgatgatttttgtctttcagttggagcacttagtctacttacagccattggggcctaaatttgccatctcttttgtgctttctatttgtccttcctgtaatgtttttttaaatgcctttttatagattgaaaatatttaatttcttcccttttactatttttgaagcagtgcactgtttttctcttgtaatggtttcttagaaattacagtaggaatactgaaaaaagtacaacgtccgtcatgacctttattcttttcttagacaacccaagacttaggaaattatttaatccgtttgtttcttgtatgtgagtattgctgtgtacagtattttatttttaacatcccaagttaccatccttgttttcggcagtcattgttctttcaggctgatgcacatgcttttgactcttcgctctcctttcctttagcgtctcagaactttcctatggggccacctactttgactgaaagacttcagaattcttttctcatgacggtctactgatgccacattcacttcgttagtctgaaaatatcttttttgtttgtgtgtttttgtttttttgagacagggtctcgctctgttatccaggctagagtaaagtggcatgaccttggctcactgcaacctccacctcctgggttcaagccatcctcccaactcagactgttgtgtagctgggacagcaggtgtgtaccaccacacccagctaatttttgtattttttgtagagacggggttttgccctgtggcccaggcttgtctcgaactcatgggctcaggcgatccacataccttggcctcccaaaatgctgggattacaggcgtgagctcccatgcctggcctctgaaaatgtctttattcagtcataattctttttttttttttttgagatgaagcttcgctctttttgcccaggctggagtgcagtggcacgatctcagctcgctgcaacctctgcctcccaggttcaaatgattctccagcctcatcctcccaagtagctgaaattacaggcatgcaccaccatgtctggctaattttgtatttttagtagagatgggtttcaccgtgttggtcaggctaatcttgaactcctgacctcaggcaatccatctgaactggcctcccaaagtgctgtgattataggcatgagccaccacacccggcctcagttgtcattcttgaaaggtatttttcctagggatggaattctagagtgatgttttcttttagactttgaggacagctgggacctacaggtgcatgccaccacacctggcaagttttacattttttttatagagctagggtcttcctatgtggcccaggcttgtcttgaactgctgggctcaagcagtccccctgcctcggcctcccaaaatgctggcattagaggcgtgagccattgcgcctgactctccagcttatttacagtcctttccacggaagtcactgaagaattggataagtgtacagtctatacttttcatcaagcaatagataaagaggtagcagcagggtgtcatggccagggtgtcaaactgtgtggaagctgcagtccagctctggagctgggcttcatgcccatctccagtgccattctcttcgaagggccttggacctgcagccttcctggagggagagggtgaatagccaagatgcagaatgggctttctttgtaatctggaagacctacgcttaatgaagcagtgtcagtttgaacacttcttaggcttatgcaaacatgtttaggttattttagctgattgaaggcaaaatatggcctgacgctgtgatgtgcggcgcagtcaaatgcgtcagaccctggctgtgttcacagagtgcagcatccagactgagggcggagatagcctctctgctcatgagctgtctctaaagaagcgccctctttaaaaagattgcacgttacattggaatttattcaaggtgcgtggctgagatagtgaagggatgcaaaccgtcatctgaggaacttaagtcagggagctgggttgtttagtgtggagtaaaggatctttcatgagtgagtggttgggggggtggtacatttcactccagatgtcaacagtcattgcgatgttggcactgctttggtcctgagtttcaagggaggaaattgaaggcttgagaggtgaagtaatttgcagaaggtcccctgaactcaggcctgactgtctccaaagtggcgtgtcagctgagggaacacagggtatcttgcagtcgtgatttctgatcaacacaagctgtccagcttcccaacatggccaaacaacaggacagacgtggctgctttccgtgggctctgttgcttctgatttatgtgtgtcttttctctttgagttgaagcattagaaggtgtatccaccaagatccagtaaagaagacagaaaacacaccaggtatctcaaccaagcggatttaggtggggaactggttttacaggctttcgaggggctgaaagggccaaaaggaaaccttgactgagacggtaactacaggaggcaggtgctgctgctagggctgggggaacaaatagaagaggctggagttacttaaatctagatggctagagaagggacccagtgagctggggcttgggccactgaggtagggacacagcctggcgcttgctggcaccgctgctaagtgcacagtgcaggggcctgggagcagaaggaagcaggagggcatgggggcggccggcagctgggaagggaaccatcctccctcctcgcctgccagcctccctggagggtgctggacaggtttgaacttcatgtggtagcagtaattttaaggttttgttttgtccccttgcaactctccttacttgctttgtccccttgcaacttataactaccttacacaggtactctgcattggtactctgcacaggtactcggggttattatttacatatgggatctgagcctcctgtgctttgcccgagttagggcctcaaggactttgtggatcccttcctgatcttttatttatttatttgtttatttatttatttatttattttgagatggagtttcgctcttgttgcccaggctggagtgcaatggtgcgatctcggctcaccgcaacctccgcctcccgggttcaagcgattcttctgcctcagccccctgagtagctgggattacaggcatgcaccaccactctggctaattttgtatttttagtagaggcagggtttctccatgttggtcaggctggtttcgaactcccgacctcaggtgatccgcctgcctcagcctcccaaagtgctgggatcataggcgtgagccaccatgcccggcccttcctgatctttatggcaagaggtttttgccacaacaacacttcacacctgactgaagcccagagaagcccacgtcacgatggctggaggcaaggaagaggatctagtcttttctctctcccagaggcgggagccttatgtccacatcactgtgagcctgctggccttgcccaaggactattcttttaaactaagagagtaaattaagatatttccgaggggtctgggatccatgtaaatgaaaaagttcaaccttttttgtaagccatgttcttaaaaatctgcatgtggggtagttaagtgtcacttactagagtcgaggatttcagcgcaggtctttttgaagttctgagatgaacttctcctcctctttatacttctcattccaaggatgctgagtgtgggattattcctgatgcagtgctgcctagggagaggagcctcagcacggcatctatcatgggctgctttgcttctgtatttagaaagagaactagaattttaaaataattgacttacaactacttagaaaagaaagggccaaatactatgtgcaatcatggcttcctcacggtcaggcatgtttcctgatctcatctcctttttcaggagactctttggaaatacatgcatatatttcattattgggaattaccaataatttaaccacttttgtgctattagacatttaggttgcttctgattttttaatattataactcatgatgagacagtgtataaatctttgttcagatttctggttattttctcagtatggtttctggaagtgatagaaataactggataaataataaataacctttaggggaattggcacgttttgcaaaattgctgtttgggaagtttgtcccattttatgtgcccgctcgtggggtctgagggaggctttttcctggctcggctgccagccctgggcattgccatttgaaaatacctttgcaattaagtagacgcttgaccgtttcattgttttaattatacttttcgattattagtgtagttgagtatttttacatatgtttatgggtcagtttcattatgtttaattgtttatgcccttcgtccacttgtaagtaaaacagtgaagagtgacccgtgtggggttttttgtgttttgttttggagacagggtcccactccgttgcctggggtggagtgcagtggcataatcacagttcgctgtagcctcgaactcctcagctccagcaatcttcccacctcagcctcccgagtagctgggaccacaggtgcatgccaccatacccggctaattttttatttttattttttgtagatacggggtctccctatgttgcctaggctggtctcaaacttctgagctaaagtgatcctcccatctcagcctcctaaagtgctggggttgcaggcatgagccaccatgcctagcctgtgtggcctttcatactaggtgaatctgtggccacccacatcctgagaattgttttgttcctcttccaacctagaggaaggtccccttggaagtgtggcttggggctctgtgattgaacctttcctattcatcattttcgtcagtgtgttggatacagacttggaaggcgtgattactgagtgctgatgatataaagctgggaaggacaggtactaatgtagatgaaagactcgtgatttactccaatcttgaaaggatgacatgctggcagattgtggtaaaatataacagagatactttgaaagtcctgcatttagtcttccctttctctcccttgctcccttcctcccttgctttctttcttccttccttccttccccctttatttgtcccatcaattgcgtaaatgcaggtaaacatttagccattcctgtgaaagccgctgtgtatgtggtggccttaatcattgtccatttttgggcctgtggatccctgttattctctgcagtggagactgcacatcgggccagtgcatgcctgctattctctgcagtggagaccgcacatcaggccagtgcatgcctgctattctctgcagtggataccgcacatcgggccagtgcatgcctgctattctctgcagtggagaccgcacatcgggccagtgcatgcctgctattctctgcagtggagactgcacatcgggccagtgcatgcctgttattctctgcagtggagactgcacattgggccagtgcatgcctgctattctctgcagtggatactgcacatcgggcctgtggatccctgttattctctgcagtggagactgctcatggagcatctgattttcttctggaccttctattttgagctgcattcacagagcacacctgagaaatggtggccaaggggagtgatctaggaccctgagaaacctggaagcagctccccttagggagagttgcagagggctggggatgttgaaggagagagaaggctctggaggaacttggatactcctttccaggctgagaagtgctgccctgggcactagagagggagagctctggccatggcttctgagggccagctgcaagtggacactgccatgggacaaacagcctcatctcactcattgaacattccaggaggaactaaatgacccctctcaggatgtcacgggatttctatgttgctggaaagatgcttgtggtggaagcgtggttactaggtggacctggattcagaggacagctcagctgattcctggcttgtggacttagatgggttgaacctttaaacactcagaacatcagtttcctgtaaggtggggtaagaatgcgtgtgtactgtgattgatgtgaataaaaggagcactgttgccaagtccctgagtgcagacccagcaggttggaaccacttcttttctgttccctgaacaattggactgtgtggacgcagatcctgcttccctgagctgcacggccctctctgatcgcacatacatgtgtgcatctgacacatatgcttgagtgtgagggtgacagcggtcagacaaatgggcttttttttttttttttttttgagacagtgtcttgctctgttgcccaggctggagtgcaatggcgtgatctcggctcactgcaacctccgtctcctgggttcaagcgattctcctgcctcagcctcccgagtagttgggactacaggcgcccgccaccatgcctggctaatttttatattttcaatagagacggggtttcaccatgttggccaggatggtctcgatctcttgacctcgtgatccgcccgcctcagcctcccaaagtgctgggattacaggcgtgagccaccgcgcatggccaaatgggctgttttaaatctattagaaaaatttttcacaatttttagtctctattattctttctttttttttcttttttttttttgagacggggtcccactctatcacccaggcttgacagagtgcagtggtgtgatcttggctcactgcaactttcacctcccaggttcaagcaatcctctcacttcagcctcctgagtagctgggaccccaggcatgcgccaccacgcctggctaaatattctcagttatactttcagtacacataaaggcagttgtcaaccaagctgtttgttagaaaatgctaactgtggtccctgtccactgcctctttcctgtttttttttttttttgtttttttttgttttttttttgagacagagtcttgctctgttgcccaggctggagtgcagtggcatgatcaccgctcattgcagcttctgcttccttggttcaagtgattctcccctgcctcagcctcctgagtagctgggattacaggtgggcaccatcatgccaggctaatttttctacatttagtagagatggggttttgccatgttggccaggctggtcccaaactcctgacctcaagtgatctgcaagccttagcctcccaaagtgccgggattataggtgtgagccactgcgcccagctgttcactgcctctttctgaggcctgtcccacgtgggaccttgtgagctggtggaggcctcttgagggctggcaggagcctgtgctacctctgggcccagcacctatgctcccgggagccgtcccgcctcttgccttcagtcttcatctgtactgtgaggatcatccactggcctcccaacccggtagtgaagggggaataacaaggacgtctctggaaagtgctgcaggttcccctgaggaaagctattgtagagtagaaacgagaatgcacccccggaatcagctctccgatgatatgcaggtgcagctgcctccagccctgccgttggtcaggaggaggcaaggggtacctaatgtgctcttatttggcccatgatgagtggagaaagagacctttgcccaggtgtccatgtcactgaggcagtggcggagggtgtcccccagctctgcagtggtcaccctctgcctcctgtcctcgggcagctgcctgtggctgcaggcggtgaaggtgctgttggttgtttgctcccagacctggctgtggggcctgctctgcagaggtcaggggcatggcgcagggggacccagcagggagctggagccaggcagtgcgggctgagccaggccgaggagacccccgcttttatcttgagtgttgtcatctgatgctgagttctttctcagcagtgaaggggaatcagtgtcctgacttgaattgcactttgatggggtttttagtttctgtgtgttggatttttactgagagctctagagaaactagtcacctgggggtttcagaggagggttgtgaagtgctgaatttttctttgagcttttaaggtcagaactcaggggagctaaaaaaaaatgaaaaaataataatttaaaccttataaggtgactcataaataactgcctttcaagatgagtggaattcttctgggaaaaagccctgtggaaattctcctgaccaccgagaacaaagaggaccactactataaaaacctccagaatcatcatctgcggatggagggaagactctgccaggagtgcgatttttcctttatgtgttactccgtttaccatgtctcaataaaatggcagagaaagtccttttcccgtgtttcatttttcccacaacctttcccctttcgacttctttggggcttccccttatctgagactggcccaccgcagaattcagcttcacgggcctgtccggatggaacgtggacgccatcatgtgtttactgcttttatctcttagccacttagaaacattgttaccatgagaaaatgggaattatgctttgatccttgagttaaatcgaggctgtggtagctggtgagttatgaggctttattaaaataaatgatcttggatgtgttgggtattcactggcaagatgttaccagaactcaaacatttaagataagccacatattatttgtatggattcataaaatatagaaagagcgtgagctggctatggctgggttttgtatcctttcccccaactctgttacacttttctgaaagaaaatgagactttgcttttatgtgaatagctgtagaaagctagggaggggtgccatttggaaattgaattaaaaccaaattatgtaagaatgtggttagttttataatatcctgttcttgtttcagtgctttggtttattattattattattattattattatttttgtttttttttttcctgagatggagtcttgctctgtcgcccaggttggagtgcagtggtgcgatctcgactcactgcaaactccgcttcccgggttcaagcgattctcctgcctcagcctcctgagtagctgagattataggcacgcgccacctcgcccagctaatttttgtattttttagtagagacagggtttcatcatgttggccaggctggtcttgaactcctgacctcatgatccatccgccttaacctcccaaagtgctgggattacaggcgtgagccaccgcggctggccggtttattattttttcctcagtgccgtggaggcgcacagggctgctgcacccgttagggtggccctgggtcctacagccccggggacacggtgcacagcacttgcgtagggtggtcctgagtgtgcacgctgctacgtcgctcaggcttatgtgccttaagcagttgcatagtttaggcacagtgctgcttctcaaagtgaattctacttggagccacttatatatagattagattttataatgtgtaatatgaagaggagcctggaggtatacttaatttaggaattatattatttttggtttgggttttaaagtatttgaatgcctgttaaaccaattctgtagtggctagaggttcaaaatttgtagtatttatgaaaaatactcattctaagtctgcttccttttataatttaggtatatacactctctgttcagaattcctcaatacaacgcattaaatattgttccgaggtcttctgagccccgttctcagtggtggccgtgagctaacatttccacatctgtcacaatgttgtttgcagtttgtcgggaggcgctctgcagccaggcagatggaggggccgctaggcaggatgttgagagtctgtgagggcatcaatcccccgtttctggcatagatttaattgtttggttcaactgggaagccatatattaacttctacttcaacccatcctgatctctccacagatgctagttttatacaggcctatttttctctgaaattgagcctgagagacaaaaatccacacttgggctgtcatagattttggtaaattgagtcttgtgactgattggtgcctcctgcctgccccgtgatcctgtatgtagtaaccacgtcgtgatcacaggtcatggattggggaaagttgcctccaaagatgtgggtgtctgtttttcactccactttccatttggccaaaaattcaacacttcagtttctgtttcaaaaaagtaacaaagaattaaaaggaaaaaagcagtaagaaagtttgggccatggtggtgctctggtacccgccttcctgtttctgcctgtgtcgctctggctgggcagggtccgggcatggcagccctcccctctctcctccccctctgccatgggggcctgtggttcagctgccaggcgggaactgaagagcagccccgggcgctgcagcttcctgtcctgcccatcacggtcagggacgccggtgtccgttccttctactccaagtctgtcccgagtttgaatgttcagatgccaccagcagctctttagggtctggaccaaacgtctgatttttcctctactaacctgatatgtttctcatggcctttctcgcctttttgccatgtgttcctgttccttggactggattttcacgggctcgctggcaagcaggtcctgcatagcatgctcagcatgtagctgtgctccgcgtctgccggatgaacacacgagccggtcatgggccacgtcagcaatgttctcgacctttgtaagcttcgagaatgtgctgtgtgtacagaaggacgcgcagccaagtatgcggtggaatatccagaaacaacacggggcttgtcgggtgcagacggggcgcctcaccggcccggcgcagccccgctcgcccctctggcctcccccgcagttcccctttcctggttgtgcagcatgcactcgcttgcctttttcttttctcacagttttatcaactgtttgtgcatccccgaaataatacagctttgcctggtgtggaaacgtatataaacattatcatagtatctgcgctcttttgtgtcttgtaagacacccgagatcgattctgttgccgtgtgtagcggcggttattcttgctgttgtcgtgagccattgaatacagtgtcgaacacttgggttgcccagtgtgtgtgtatgatgaatagtgctgctataagtgtttttatatatgaattttggttagcacctgtgtggattttcgggaggtagttgcctaggagtggaattgcgtagtaatcgggttgggttttagctgaggttgtttctgctgcaccacactccggcccacactgttacgcatttttactgtgttcattcctgtgggtatgtattatatcatggctgtaatttacttccccctggccccgactttgaaaagttgtatttatttatgagatacaatgtgatgttttgatagatatatacattggggaatgattaaatcgagcttattaacacaaccatcaccacacatatgtatctttttttttttttggtggtgagaccatttacaatctctttgcaattttaaaatatatagtgttattaactatagtcagcatgctgcatagtagatctctgaacttactctctgtccaactgaaggcttgtgccttttgaccaacatctcccctaccccttccacccactaacctctggtgaccaccattctactctgcttctgtgagtttcgtttttttagatttctcatgtaagtgacatcatgtggtgtttgtccttctgtggcttatttcacttaacgtaatgtcctcctggttcatccatgttgttgcaaatgacaggatttccttcttttttttaatggctgagtagtattccatggtgcatgtatatcacattttctttatccattctttttttttttttgagatggaatctcgccatgtcgccccggctggagtgcagtggtgtaatctcggctcactgcaacctccgcctctcggggtcaggcaattctcctgcctcagtctcctgagtagctgggattacaggtgttcaccaccacgcctggctaatttttgtatttttagtagagatggggtttcaccatgttggtcaggttggtctcaaactcctgacctcaggtgatctgccctcctcagcctcccagtgttgggattacaggagtgagccaccacgtctggcctatccactcattttttgttggacaccttggtacattccatatctcggctattgtgaaccacactgcaatgaacatgggtatgcagatgtgtcttgaacatgccgatttcaattcctttggatatatatacccagaggcagaattgctggattctatatggaagttctgtttttaattttcattttcttcatgactaatgaaattacacaccttttcatactcttactggtgattttgttaggatcttttgtgatgtacctgttgaggatttttgcccttttcctgttgtattgtttcttattgatttgtaggaattctttaaacattctggataacgtccttttaaaatgtgtttatatgtggaacatttcttgtcctgtgaaacatctctgtgatgcaatatttcagtctttttatggtctctcttgataaacagaaatatgtagttctattctagtttaatgtgtaagtgctttccctgtgttttatgcttgtgttgaaatattttccaaccttaaggtcaagattttgtcccataatgtaccctaaaagcttcatagttttgttttttacatttaggtccctaacgagggtgactgccagtccctgtgtgcccagggcagtcctagggatgaataattaccatgtattaataatcacaccagtctatggcccatccggcattggctttgcatatggtatgaagtaagggcccagttttgctctgttgcatatgaattttaatttgtcccagctcctttcacttgcagggactatgatgactcctctgcaggccgtctttgcgggaactaagggctgagacgcgcctgggtctgtttctggccctttgtgctgttccgggggtacttctctctgtgtgccagcttcacactcctgtctctgtggctgctgatggtctgaaaaagcacatctccccatttggatcctccagagtttcttgactccctgtgtccctttgcatttccatagaaattttaaaatcggtgggtcaagttcactgagaggcagaaaaacatattgaggctttgattgtgatttaatcatatctgtaggtccatagatcatttaggcagagacttgacatcttttcaatattaatttttctaatttttcatgtagaagtttttcacatcttttgttagatttattcttagatacttttgttagatatattcccagaattttaaaatgctattttgatgagtcttagaaattgtgtgttgtttgttctggtgcataggaatgcagtatacagtttttgttttgttttttttcaatcgactgatttgtatccagcaaccttacagaatattttaatttgaatattcacatatttatttggatttctataaacacagtcatggtcttctgtaaataatgacagtccctcctaccccatctttatactttctctcttttttctatctgtgctacactgaccaggactagtgttgaataaatgtgggggcatccttaacttttttcttatcccaaaggggaacacatttaccctattaaatacgattttttgggctaatttcgtaggcaatctccatcagattaaggaaggtttctttcttgcttataagcgttatttctttaatgagtggttattgaattttagtaaatgcttttttgtgcatctatcaagatgatcatatgctttttctcctttaatttgttagcatggtaaagtaggcatgcaggtatgcgcacatgcgtgcacacagtgtctttaatggttgagctgtgtgttagcatggtgaaggaggcatgcaggtatgcgcacatgcgtgcacacagtgtctttaatggttgggccgtgtgttagcatggtgaaggaagcacgcaggtatgcgcacatgcatgcacacagtgtctttaatggttgagccgtgtgttagcatggtgaagtaggcatgcaggtatgcgcacacacgtgcacacagtgtctttaatggttgagccgtgtgttagcatggtaaagtaggcatgcaggtatgcgcacatgcgtgcacacagtgtctttaatggttgagctgtgtgttagcatggtgaaggaggcatgcaggtatgcgcacatgcgtgcacacagtgtctttaatggttggggctgccttgcatttcaggtataatctgtctacactttttatgcatttctgggtttggtttaatatttttgtaactctttttttaaagtaagtgacctgtaattttttcctgtacagtttttgttgggttttaacaccaaggtcatgctattccaaaaatatgagtttgaggagtgtttttctattttttttctgcctctggcttttagcaagatttgtagaacttccagttactcatctgggtcttgagttttctctgtggaatgatttttttaaattatgatttgtttctaaaatgattatcatgtcttctatgcctttatgagtcagttttggtgagttgtgttttttctagtacttgtctttttctttgttacttaaaaagtttagtggcatagagttgttcaaagtcacctcttgtcaatgtggatagttctctcttttagaattctgtaccgtggttttgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntttgtctgaccgctgtcaccctcacactcaagcatatgtgtcagatgcacacatgtatgtgcgatcagagagggtcccctctcctcccctctcctcccctctcctcccttcccttctgttcccttcccctcctctccttctttcttttctttctctccttcttttttttggagacagagttttgttctttctttccttcctttctttttttcttttttttttggagatggaagtgttgctctgtcacccaggctgtagtgcagtggcgtgatctcggctcactgcaacctctgcaacctgggttcaagtgattctcctgcctcagcctcccgagtagctgggactacaggcgcacaccacaacacccagctcatttttgtaattttagtagagatggggtttcaccctgttgcccagggtggtctcgaactcctgagctcaggcaatccacctgccttagcctcccaaagtgctaggattacaggcttcagccaccgtgtccagcctttctttcttgattagtcttactagagcaggcatggggatgatagtgaaaatgttgctttttatgaataaagcacagaagtgtgtgcagtgcacaaacagaaacatcatatacctgcgatgtcaacatttcatgggagggggattagggaaaagattaggggaaagattgggcgataataaaatagaggttgagagtcactgcatgagaggctggttcttttcagggaaccagcttgtggctttgtggatcttctttgttatctgtttgctttcattctgtcagctttggatccttccttccttttactttctctgggtctgtcttcttgtgatggatgcttactcatcctcagctttctttcttctcttacatttgtattaatggctatacttttccctcccagtgcagctttgctttttcccactgggttttatttgtctctctcatttgaagtaggctggagcgagtgtggcctagttcagaaatagaaggctggtttggctgtagctgtgagtgaggaggagagcagtagattaggtaggagagagaggcctagactaaattgtgtctgggcttgcagacctgggtaaggaactaaatacaactcaggtgtgctagagatccgctgtgtggtttcatgcagggggtgttgtgatctgctttatatttaagagactagagtaagggatcgtaggggtaggagtggaagggagaagagtgctcagaggctgctctagtgcaggggcaagacgctggaggcttgccctgggtgtgatggcagtgggaggacaggttctggatttgtgtgcatctgggaagggaacaggatatgactgcccagttcagcaagctcgtttaggatacttttattgggcagctcattaactgttctctgtggcccagtggatctcagtaagctggagctttgtaattttcacttatctctatgattgtttagtgtcctaacagaatgggagatttatttgggtaaagagggcctagaaacatttaagtattcccgtgatgctggccataaatacagaaaatttggtgcagtatgtcttcacattcctacaaatttagtgtagttcagttctcaaaccatgctggtagtatcctgggggtcttcaggacccttttgggggtttgtgaggtcggttgctaggacaggcctgcgtttccctggcgcctggatctgcactgatggcgggcgcaatggcgggcagtgctgtcggagtcttagtggctcccagttgacccagtcgttgcatccatgatagcctcataactggccgcaaaaacacactacttgtgtcaaatctgggcccttctgcacgtgtttttaccccactgagtgcctttgcacagactgcgatctgctggttgctgagggacaggcactagtgggatccgggaggggcctgttggttttccccgtgggatgctgcttttccctgaaagaataagagacaggatgaagtgagcttgtcacttcaaggaaaacaactgatggcaattgttgccagtgataaaaattgagctttcaactgtaaattaaattagaattttaaaaaacctgtgtcttccacggtgaacttgtcaggttaccagcctgttctgaggcctgttctgatgagaccgcggcggccatgctgggtgtgtttgatgctgcagaagagctctgcacagctcggtgagcccatctttccacatgaccagtgcgtgctgttacaacaccatgtgtgggtaaagagccacttcaagcaccagctaggacagagggtctcaatgtaacagagtatgaaaaagctactgaaacagtttccttatccaacaaaccgcttgtggagttttggtgtgtatcaaacaatactgacaattatttcaaaagactacgtatacatgtgcagctccatatgtgatgctggattttcttcctgtgcttcagttgaatcaatgtattacagcagattaaatacaattgcaaaggtgagaatccagtgacttctattcctgagccagacagtaaagagatttgcaacaatgaaaaacattgccactcttttcactaaaattttttgtttgggaaaatagtttcatttttaataaaaatgtcattcatgttaacctgtaacaggctttttattgttaatttgaaatgaattaatacaaatgagaagaccctcatttcaatgtataacatggtaacatttggtagtgataattgggaaggggcgtctttggactcctccgtgattctaaagagtgtgaagggaccttgagactgaaaaatccgagaactaccggtttatagaagtggaagcatttagtgatattgccgttcgttcctttctttccttccttcctttctttttttctttcctctttctttctcttctcttctcttttctcttttcttttctttcattttgagacagagtctcgctctatcacccaggctgcagtgcagtggtgcgatctcggctcaccacaacctctgcctcctgggttcaagccattctcctgcctcagcctcccgagtagctgggattagaggtgcgtgccaccatgcccggctaatttttgtattttgagtagagatggggtttcaccatgttggccaggctggtcttgaattcctgacctcatgatccacccaccttggccgcccaaagtgctgggattacaggcgtgagccaccacgcccggccgtgcagttctttaaacgtaggaaatgacctttgagttttgagttcgataccagcgtttctactattaaaggtggactttctctgtcaatgttcttggaatcttatgctttccacgaagtccttgcacttgtgcagaactgtatccccttagccatgtgaactgcacggagcaacgctgttgcaggatttccttctgcctcactcagaacatatgtgctctgtgtgtgaagaagctcgtcaggctgtgagcacagcacaagaataaagcctttagaactcagcagagagaaccagccattactgaaaatggaatgttttaattaaaaatatccatcaccgggtggctcttcttttcctttatttctcaagtgtggcaaatgttaataacagtggctgcactgtggctccatggtaaattgccagttggtgagtaggatttctcccatgaagcttagagatgaacccctgcaacatctgttcttgtgacaacgaatcccttttttactttggcttatgcatatttcagaggttagagacaggaggctccttctaaaagtgttcagtaactgcctgggctgatgtgtgtgcctgagagtcagagagagagagggagaaagagaatgggggctaaggggaacaagaagggagagagagagagagagggagagagaatgggcactagggagaagagaaagagagagagagacggggaatgggtgggagcatatgaattcattggtaaccctttcactttcttttcttcctgtattaattgatgggttgaccttattaagtgggttgattttggggtttctactgcagtgtaacaatgagcatgcagatggattttctgattgtttacaaggaaatcaacctttacactagctccagcttttttcttaaacatctagttctattagaaaaaaagcaaaagcacagcagatagaagtcttgaagcctgcagtaaaacactgtggctttccattgtgaggacgtgcctgttctttattacacacaggctgcttctgtgatctgctgagttgggcagtgtcatcttagcagacagggttttccccccccttagatggggtctcgctcattcgcccaggctagagtgcggtggcatgatcatggctcactgcagcctcaacctcctgggctcaggtgatcctcccacctcagccttctgagtagcagggaccacaggtgtgcaccaccaacatctggctagtttttaaaatatttgtagagaccagggctctctgtgttgcccaggctggtctcaaactcctgggctcaagcaatcctccaacttcggcctcccaaagtgttgggattttgggcatgagccatcgtgcccagtggcaggagggtttttatgtacatgtgcttgccctttgtcaggggggtggggtgtggctttggttttgatattttcactggtactgccaggctattttgattcttcttataggagtcttgaccgtcaaccacctgccatgctgtttgggatgcagtgttttgaggatatccctggggactttactaaatggacctatacaagttgataggccttgacaacttttctcttactgtagtttttgttttattaccatttaaaactaaaggctagggagatgagccgtcctagattgaacgtgcttattagcgtggatatgttgtgaagaaatgcacgttggaaaacattgtcctccagaagcaattaacttggcagctattttgtttacattttctgtgattaatatttacattttattttaagaatttgctgccttgatctcatgctcacattttcctggttgagattggaaccaataagtaaagaaaattgacctatcaacccttttaaatgttagaaacctaagtcagagagaactgtgttaaaagaactgtgtttatctttttggttaaacctgttgtaacactgtgtggttaaattttccctttgtgctctcttcccctaatcgttcaaaggatagtgggcactattaggttcgacttttttttttaaatgtttatcttagtggtgggtcctcttatgggctagtcatttgtgggcataggttggggtgtgcagggtttatggctaattataggatcatatgtagtggttctctgtgatcaggagaaggataccaaggtttctattttacttatttattaggttgtgtaacttttttcttttattcttttatgcttgatgatggtgttggtgtttaggaacccctgtttagaaagcattttggagaaaacctgatgcaattttaattttgatgatgtcgatatctcattagataaggccttgataaaataacacctttttctcttatttcaatggatccaaagagaggctagcttggaagtggagtggtggtgatcaggaagggactcaccaccacgccacagggttgtcacatattttcctcaaagcaaaatgtaatttcctcttaaaagaggatttagatcctggcattttagcagctgtttttaaggcctggagctttggtattcctggctgttttgggaggcagtgctggacagccgattcgttcagcaggtgttgattgtgtgctgacttttgtttggcagtatttggtctgacatgggagggagtttgcaagaagcttacagcatcatttcatatggttggaaccccaagtgtgggactagcacacctaaaacagggacgcacagaaagggaaggcagctgtgattaaaccttgaagctcgtagtaccaagctcaagcctcagcatttggcagtaggagaggtgcagaatggttgggagagcctcgtagaggggatggaacttgagctggtacttgaagaaggctgagagaagggacagggaatgcggagtttagggagggtgttcacagagattttgagaggaaaccgagcatggctttttcatggaactgtgtgagtgtctgcatggcttgggtggggatgactaacttgactcaaattactcatccctgggccagactgcggtagcctgggcaccaggtgaaggaatctcaaccttatattgtaaaggcaatggggagcagtgaaagttttaaataggtgaaagataggctttgttttctcttttctttttcttatcctttttgtttgtttttgagacagggtcttaccctgttgcccaggctggagtgcagtgcgatctcggctcactgcaacctctggctcctggctcctcagctacctaggtagctggaactacaggcatgtaccttcacacccagctaattttttgtttattttttgtagagacaaggtctcactatgttgcccaagctggtctcgaactcctgagtttaagccatctgcctgccttggcctcccagagtgttgagattacaggtgtgagatgctgtgcctggccatgttttttttgtttttggttttttttttcctaaagattcatctgactgtatgtggtgtttcacacctgcaatcccagcactttgggaggctgagaccagttgatcccttgagcccagcagttcaagaccagcctgggccacatagtgaaatgccatctctacaaaaaaattaaaaatattatctgggtgtggtggtgcacacctgtagtcccagctacttaggaggctgaggtgggaggatctcttgagtccatcaggctgaggccaccgtgagccgtgatcatgccactgcactctagcctgggcatcggagtgaaaccctgtctcaaaaaaaaagattcgtctgcttgagatgtggggcgtgtggaaggaagtagaccagtggatacggtcacccaaagcatgatgggaattccagatactatatgatgccatttcaacatggaggagtagaaatggtgatgaaggtaaagagaccacagcagagaggcgtctagaaagaaattaatggctctggcaacttatttaatagaagtggtggggtgtggggcagcccaagataacaaatgtaattttcagggcaattcatggatggaggaagaatcaattcagatttctgggttgtactgtttttgatattgtattctaagatggtcattgcttcttattaggagacaaaaaggtttttaaaaatgtgaaggtcatctgcagttttttggggtgagagagtcctcaggaacgttcgcatttgcagatgcccaagagccttgagtccaagttgctgatcttttgcgcagggtggttctgccgcagtctgcgaggcttctggagggcctcgtgagcttgcagctctgtgatcctgctgacaaactggtttctttccacatgtggaatctgtgttttccctgcatggagcagtgaatggggatgtgaaaggcaccggacatgaagctgataccgtcacagtagaatccagaagagctgctcagtaaaacagcttatacattaactgttcagacgctagaaaaggcttgtattgcttattgaccttaaactttcttgattctttctatctatctatctatctatctatctatctatctatctatctatctatctttttgagactgggtcttgctctgttgcccaggctgaaatgcagtgttgtgatcactgcagcctcaacctcctgagctcatgcagtcctcccaccccagccccccgggaagctggcagatggtgttgtcctcacatggccacaggcaagctcttcttataatgtgaccttgacacttctgccattgtgagtagggtccctgttccctcccgttgaatctgggctgactcgggactgtagaccaggttataaaaggctctcccctggatctgctggggcgtgtgctgtgaggaaaccccgcagccatgcggtgaggccctgtgaaggtgagccaccatgcagtgattccagcccccagaagacactcacccccagacttaagtcttcccagctgaggccccctgagacctgtggcgccctttcctaattcttgaccatgggacctgtgagcataatgaaatgattgttttgtgctgctaagtaaagggaggtttgttaagcagcagtggataacttgaacatgttttggaagctggagccaggtgtggccataatcaaatcccaatgcctgcagctctggctttgggatggggtgttgggcagaagcctccgggcctccaggagagtgctgctggctgcctgaagggcctcctagaaggtaatagggtctagtattttagcctgtgggtggcacatgatgactgtccctgctactctgccaatgtgagaaggcactgcagacggtgtccaccacatgggtgccctggatttggtcctcagcaggctgggcttggcctactggctgccttttgcctaccccggaaggaaaggagggaacgtgtcattgcacgctggaggaaaggggccccttgttaggtggtggtgggaagcctggtgtcattgttgctgtgggaaagaggaaagtatgtgtgtatttaatgaacttgctcatctagtttaggagatttccaggcagaaaattcaaagtgccacctggcttctccttggtgtaaaggaagaggacttcctgggttcaaaaataagactgtttctcattcccagcctcttctccaggctcctcaagtgaagaaagggcttccggcaaaatgcatctggactgggctgtgagctccgttcctaaggcgtcagattgagatccaagtgcagtgtctggcctttcagctggaggagaggcctgcagattcttgcattaaatcccgtctggcctctaagagtccaaagggcgttgtcatgccacagcctcttctgggagcccaggaagtaaagggcttgtctctttatgggtgtggcttgtctaatggaggagattatgagttaatacacaaaaaggccaccaagtgttttaaagaaattatgtgtctgcctggactgaaaggagcagaggcaatacaaaatgaaaataagtctttgggcccccagacttctgtgaggaggaagcaggctgtgaaaatcacccagctgtaaatgtggggtacttttcatggaaaatgaagtatgtctgagaaggcggagctgagatcccagaaaacaagccccaggtaccaggacagagccctgatggaggtgctggcgctgtgtgcctgcctcgagtggctgtcctgggtgggacattgtgtgtggggtgtgggtgtgtctggatcagctctttagacctggattgggaagaacggggatggaagaggggtggacttgaggaactgcatgttcctgcacacaggcttctcagctgggcagggtttaggtgacgagaccccagacttcaagctgatagcagtaatcggacaggccttgggggccctggggaggtgtcaggttcattttgcatgtgggaggatgtgacgtgtggtggccagaggatggacagtggcagatcgtattttccagagatgaccgcagcagcatctcccgccgcacgtgccctctctgcagtgtaactgtgaaacgcctcccaagatgaccgcagcagcgtctcccgccgcacgtgccctctctgcagtgtaactgtgaaacgcctcccattgagaggcgaagttgctgttctttcccttggatctggatgggctgtgactggatgggaaatggcgctcttggctggtgtgctgaggacgacataccgttcacctggttctctcagaacccaagaccagccccatcggagaggctgccagaggaggccatgggaggaggtggtttctcattaacagcgaccaccactgtcagccgccagatgtgtgagtggtgaagcttctggtggtgccagtgccagccactgagccatcaccggcctttgcatcttgcctgctgaggacccggacattgtggagcagagacagggtgtcccctcccttccctttctgaattcctgcccctgcacaaggtgtcccctcccttcccttcctgaattcctgcccctgcaggaaggagaaaatgattgctggccatcactgagggttggggacctggctgtgcagccgcagcgccggcgggccgctctcccacatctcaggggcacgcaggttccgtgccagggatggctggtcaggccccgcagatgggcagaacttctcatcccacacatcccagccttctttaaacttccctggcagattattttatggttttgctgctgttggtgaagatggttcagttttcttttctttttttttggtgggggggagttttataactttatttgatgtatttgatgatcagcaattagttctcatccacattgactgtctgtagatttttgaacatggtaacaggtacataggtaaccaaagtatagaacttatttggtgaatcttcatcctcattacattttctggataaccacgcacggatgcggtaggggacattccttattcctttggcccagacagctttgttgagcctggtgtcaatgcacacatctggagttgccatctccttcatgtcaaatttccgaatctctctgagtgcccaaggggcacgcttcatgaagcccactccgtggacgcgctggtgaatgttgatggtatcttctcgggtcaccacctcgctgattgcagaatggccgtttttcttctcgccatccttttctgcgggagccattctgccgggtccaagttggaaaggaaaaggacagttgagttttcttgggttgtccattggatgatcatcccagatgggttctttgtacttctcgtgttcacatggtttagggatgtttttctgatgagtggtggaaagtaggaactattcatggtggctggatttggcgcctgtctccctcatcatgctgtttatttttgtcatgaaaaacatctttatcaataagattaatctcacttttacccagacaatgtaacctgtagacttcgttgagtaaaattggaaataattttaaatctaatttatcttgttgtcaaaccaagagaaacctatcaagaaaccgctaaagcagtgagagctcagaatgaggaggtcgtggcataaaaggtgatttttctgggagcttcacatctaggcgatggtctaatttgtactaagtgcaaacacgcattgaattcagggaactgggaaagcacgcgtgtttgaccctgcgcgctttgcaagaagctcgtgggggttggtgcatcctttgaagggttaagggaacgaggggtgaaaagttgattattgtttggttgtgcaaatgtggtgctgggtggagtccccaagaccacttcctgcttcgaggatttactgggagtactcacaggactcaggatctaatactcatgggcatgatttattacagtagaaagataacgaagcaaaaccagctaggcgaaagggtgcatggggtgaggtctgaagggaaccaggcacaagtttctgaaagccccgcccccatggaggctcacaggaggggctaatttcccccagaacaaggtagaccaatacaaggtagtgaaatgttgccagccaaagaagcgcatccgagacttagcccccagggtttttactggaggctggtgacaagtagcctttgccaaaatcccagccttctggcaggaaagcaggcattcagcataaaccatattgttggaaaacagttgaggcacagcgaaccccacttactagttagggtggtgggaatcctccagaaatccaagtccgcagaccccagccacgggccacccctgtaagcagggctttgaaaggagggctgctggggcctgctttcttaaccctcttctgcacagataccaacttatcctttcctttctgattaatgtctctcaaacacagacgggggaataaaaacctgaaaacaagcgaatattgacatgtacatcaccactttcaatcagctattttcaaccaagtgctgaagtataatacagttgtagtcacaaaggggaagtagcaggtatgttgcaagaaaaaacttattagaattgtatgttaacttggatagaaacagaacttttctgagcttatgtgctgtgcagatacagaatgctggcagagttacttctgtgagaacatcattgaattacaattaaatattaagtacctataaaatatctttgcattacaaaagtggttaaagtaactttctcagtcttcataaatgtagatagtatctttggacaaaataatgagttagtcttttgatggaacaggagaagcaggagaaaattgttccaggagcagggttgctgacgatgctgtccctgttggtccagaaggtaaaatcctcctgtattagtctgttctcacgccgctaataaagacataccagagacagggtaatttataaaggaaagaggtttaatggaatcacagttcctcatggctggggaggcctcacaatcatggcagaaggtgaatgaggagcaaagtcgcgtctcacatggtggcaggcaagagagcttgtgtaggggaactcccctttataaaaacatcagatcttgtgagacttattcaccatcatgagaacagcacaggaaagatccatccgcgcgattcaattacctcccaccaggcccctcccacgacacgtggaaattatgggagctacaattcaagatgagaacacagagccaagtcatatctttttttttttcccctttttttttgagagggtgggtcttattatgttgcccagctggtctttagctcctgggctcatgtgatcctcttgcctcgtcctcccaaagtgctgggattataggtgggagccaccacacctggctgattttctcttatgggttggagtaaggtatggccaagacggttaagacgatccatgtcctgtgggatggcccatgtttcaccagcactcagatgccctggggctcggggcttatgggcagttttgctaattctcaaagttaagttttcagctgggtgaagaaggaagaaaggctgtttcgttgaactcagtgttgaggagagcagtgactgacagcagtggatgtgctctcatcctcctgcttttactgggagaggggctttgtgatggcaggtgtataacctctcaggttttatttcttttacattaagaaaaaagaaggtggggaggtggtgggtgacagagcaggtgatatgtgagagtcagtgaaaatgcactgctgggagctagagagcctgcgcagggtttttccgttactgtgtccgtgatgagttgaggaaaccgtgtctcagttctggaccatggccgagaggaagtgcatagtcttaagtctcttatctagtgatcatcaacacaaatggggcataccggctgcaaaacagagttgggtaccagtgaggcctagaccacctgggcgtttctcttccagagctacagttcctaggtgtaaaatagagctggtgatatacaccttgccaggttatttgaaaatgcaaagcacccagcacagtgcctgacacatgggaggcagtcacagacccatctgtgctcagttgctcatgacgaatgcccgttatgtctcaggcacggactagctgtgcagtaagagggagctctgagtcagacggagggtggatttgctctttgggcactggtgtagctctggatctgattgtccttcattatctaggttttggaaatgtgagtcattatgtaaagcttgaggtgttggtaggtgctaggtgaatcaagtgtggtggtggtgttttctatgcgtgtctcttaccaatagacttttgtttttgttttttgagatggcgtctcgctctgtcgcccaggctggagtgcagtggtgcgatctgggctcactgcaagttccgcctcccgggttcacgccgttctcctgcctcagcctcccaagtagctgggactacaggaacccaccaccatgtccggctaatttttgtattttcagtagagacggggtttcaccatgttagccagggtggtctcgatctgctgacctcgtgatccacccgcctcggcctcccaaagtgctgggattacaggcatgagccacggtgcctggcctttttttttttttttttttgagacagggctttctgagactccaggagtggtctatcatgccctgctaatttttttattttttgtttcttttagagatgagtgttatgttgcccaggctggtctggaactcctggtaccagtaaactttttaggaggtttccgttagcttttgaaaattttttacctgatctttaaaaatgaatgcagttgtgtagcaatttttaaagtgattgacagttttttcccaccctaccttttcttgattgaagcagttgattaaggattttgggagtggtcctattgtttcttgtatttttctgatttttgttttagtgatgacactgtgggaaatcatttgtcaggggcaaatttcaatcttctgtctgaatggatctgtctacttatctgtccatttatttgttcactactgtttacctgtctgtccaaccacctacctacccttccgtctggccatccatccatccatccatccatccattaaagttctttttgggggtgtgagtatccgtttaattgcactgcatatctacctacaagtcatacctcttagcaatcagcaggcaatgaatcgggccattccctggttgaaattcaacttgagatttctagagggagctactcaggttaaggatgcattatctaacaagaaaaatgaatctacagtaggtcgtattacagatgcagcacatgaaggcgcccacacattacttcttagcagctgagtgtgaggtgcatgcatgtgaggctcagaccccacggtcttagggcatccttcaacttttttttttgaagaggagtctcactctgtctcccagactggtcttgaacgccccccttgcctcaagtgatcttcctgtgtcagcctcctaaagtgctgggattataggcgtgagccaccgcgcccagctttcttcaacctgaaaactatttaaacattttattactctgtagctgttggcagtaccagattttatttacaactgaaggtagttttggatctaaaaccacagttttggtaatgttcaaaaaatggatcatttagtggttttaatgtcatgtatcaatcgttttcagagtatcttttatattgctcttctgtatatgttagcttactagttgattagtgtttctgtaacctgtcctgctttctaatctagccactaagtggttggatcaggatttatactcagctatgcctcctttaaaactgatgttttgtccctcatctccctaaagtttttaatggcatatatgtgtatatatgccatttatatatatatatataattatttttaagttcattttgcttttatatctccccgattttttgacattgtttgtttagagaaatttggccacagtttttagcactgggtgctgcaggatgagggctggacctgctgcttggagctgcagtcctcatcaggtacctgctcgttgtaccacctgcaccaccacccacatgctccccaattttttaaagttaattaaaccccgtactgaaggtaaaaatatgtatacataatttttattataatgctacttaaacatataaaacccaaggctaggcataaattccttatggttagaggaattttgtgcagctgtaaatcccaaacatacaaattcaatccaactacaaaggcagtaaatgaacacaattaatttaatgtgacaaaaggatgtagttttgctgacggtgtattgctaatgttgggtttcatgatacagtgtatttgtatttaagatttttgcttgctgtcacttaattcttttgattttgagagtgatagactctctcatttttcagtttactgagcagggttcccccactcctgccacctgcccctgcccgacggcgcagcacagtgacagcgacttttcttgtgtccatctcccactttgttcaaatggcagcaaataggaatttatgatctcatttccctcctttccttaggagaaaagtaatattctatatgcattattctgcaattttcttttttcatataacagaatattctcgaggtcttccctatgagtgcatggaaaactttgtgggccatcattggagttgccgtctttacagccgttgttttttctaacaatgtatactctaatctcattagaggtttgtcaccgataatccagattacgtcttctttggccctcaaacaaccctctgaagtaggtggcggtgggggtatcaggaagagaagaaactgagattcagagaggttaacggacgtgactgaggcgacagatggaagtgtgtggggacgtggcccaccctaggtctgtgtgcctagacaaaggctgggtgcattgctgccttctcagggccactgccgcctgctgagtccagcatgttcggggcactttccccccttcttggtgatggtgcgctgaggcccacccgcagtagctgaccgtgttggtcttgaccgtgttggtcttcagagtcctttggtgtttattgagtgcccttgggcagatgcgggaacaggtgcttctgcgcgtggttcagatggaaccgctatagtctgcagataactgagcacgaagctgagggtggtcagacgcctattagtcgcaaaatttgctgacccaatgtgagagtcgggaatgaacaatgccttttactgacctaggaggtgttacaatgacaagaagaagtcagagtgggcaggaggcactaggccaggagaggagagagttgggaggaggaagtggccatgctgcaggtgccctaacagatccagggaagcatggagagcacagcgcgacccgtgtggagagggcatcactagcctgcctcgggctgcagggggcggggagcacatgcggcgtgcagacctttccttaggtttgtgctgggtgctctgctctcaggcccacagaattctgcactgtgagcagcgcaggtcggaagaggcatttggaaatgacacgctctgtccaggaactgcagtaaacgttctagctgttaatattcttccttctggcagatggtgggtttcacactgagttaagtagcttcacgactgctagtggctggaagcttccagattagtagtttaagccagaaaacaatgttgatacgtcttgagatgtgtataaatcatttgatttggctgggcagggtggctcacacctgtaatcccagcattttgggaggctgaggtgggcagattatttgaagtcatagttcgagaccagcctggccaacatggtgaaaccccatctctactaaaaatagaaaaattagccgggcatgatggcgcacgcctgtaattccggctactcaggaggctgaggcatgagaatcgcttgaacccaggaggtggaggttgcagtgagctgagattgcactgctgcactccagcctgggcgacagagcgagattctgtctcaaaaaaaaaaaaaagtttaaggtgttggttgtgtgtgtgtgtgtgtgtgtgtgtgtgtgtgtgttaagagagccattgtaggctacatgcatgtggtaatagactttaaagggtaaatggaaaatggtagcttacaactgacatttagccaattgaaaagtgtaggccagggtgtagatagcacattcccctgcagtgcctgctgggtcctggaacgaggccttccagcaagtcggttctcacgtcaagggcatgtcctgagggttatggggccttggccatcagggagagaataaggttttctcattttcgacttcaactaatggccatagagttgcttttcttttcatttattggtttactgtcctttcctcatcctcctctatctctgcgtcctcctttatctccacctcttctcctcctcctctttctcttcctccttctccttctccttccctccttgcatttgttcatctttaccacattcattatacacccagcaaaatgtgaaacctttcatttcctgttcctggtacatgcagcaaaagcttgattatacaacattatgatgatatagacagaaaacacgtctgaattgtgttcatggaatatgtagcattcccatggttgtcaattactgtagctcattacggtgagcaagtatgtcttgttagtaagaaggttcagggagttgagatgacggggctgagatgctgcctgctgtctccatggtatgggcaggtaatggtgcagggggcgtttatgaactggtgtggaggtgcctaatagggaccctgtgcttgaggaaagggcagaaggctgatggcctcgtggctgtactcccgggtgcttcttgctgggcggctctcactgagtgggagtgaatgggaagggaaacttcctgatgtgatccttcagctgaacctagggatgatctccacgacagtagaccctgaggagcaccccgtgccacccaccaggagaagcccagaggaagtgataccctccctgacttgttagagtgcttctcttgaaggaaagaaaacccagaaagttctttttgacttctgtcgtactgaaggtatcatcatcttagacaccaatttagcatgaagggaagataatgtgtcagacacttgaatattgttgcacgtctgcttttccaactgaattttcgagtgcagatatatgtgcagtctgtttaatataatgggttttcgatcttgtcctttcttggaaagtaaaatgctttttattacctggaaactaatttcaagcaatagattgcatttttcctgggagtcttgtggtcagttttgtttttccaatgcagattgcctccaaatctttattttgaaaacttttcacacaattggaagacctgaaagaatggtaccatgaacacctcacactcaccactttgacacaaggcttgtttgcattttgtcgtatttgctctttctgtcacacttttgtttgtttttgaatcatttgaaagtaagtagcacatgttattattattattattattatttgagatggagtcgcactttgttgcccacgctagagtgccgtgatgcgatctttgctcaccgaaacctctgcttcctgagttcaagtgattctcctgcctcagcctcctgagtagctgggattataggcacgcaccaccacacccaactaattttttatttgtacttctagtagagagggggtttcaccatgttggccaggctggtcttgaactcctgacctaaagtgatttgcccaactcggcttcccaaagtgttggggttacaggcgtgagcaggagtgagccaccatgcctggctagtgattttcttcctgaatactcctgcacacatctcataagaattcaaacatcattcacccgtctaaccataataccaatatcactcctaagaaaattgaccatacttccacaatattatctaaatagttcgtctatattgaaatttcttcagctgtttcaataacatcttttatagctgtttttttttttaaaaaaaaacaaaatctactcattatgtttgtttctttagtcttttctaaatgcagaggtttttccccccctgtaaatgacacagacttcttgtggaagggtcctgctgcttgtgttggagaatgtcccacttaggttttgctgagtgtttcctcatggcatcatttcacttgtcttttcattccctgcatttcctgcaaactggaagttcaatctagaggtttgattgtatccacattaagtctttttggcaagaacgcttcataagtgttgttgatgacttcacattgcattacaccaggaagtgatcagtctttaacttagaagatttgctctcactctaaaataggatagttttaaaaataggcatcttttttaagggaagtgttctcactctttcacccaggctagagtacaatggtatcatcatagctcactgtaacctctaactcttgggctcgagtgatcttcacaccttaccctcccacgtagctgggactacaggtgtgcaccactatgcctggctaattaaaaaatttttttgtagagacagggtcttgctgtgttgcccaggctggtcttgaacttttgagctcaacagatcctcccacctagacctcccaaagtgctaggattgcaggtgtgagccactgttgggcctaatatatgaatcttaatgtttactctgtcttcacacataactgattgtctagttattaaattctgtgttgtaaatctgacttgcttagcttccagtgtcgaattatctgaagccattctgattttcagcctttgctttgtggctcatttgttctctgaagcctgtgtcttatgtacaaagaaaggtgtaaatactcttcttcgacttttaattgaaactgatttggaaatcatttgtcacaacctgggcaacatagcgagatcttgtctctacaaaaaatacaaaaaaactagcttggtgtggtggcacccacttgtggtcctagctacttgggaggctgaggtgggggcatcacctgagcccaggaggttgaggctgcagtgaaccgtgatcacgccactgcactccagcctgggaggcagaatgagactttgtctcaaaaacaaacaaacaaaacttttgtcaaagatgtaaggccataatgtggatggaaattttaaggggaaagtaaaatatataagcgtgtatgtatagttataaaaagaacctaaagcatctcaaagtccatagtccgtcagcatcagcgtctgtccacagagccagggtccccccttggatgcatctcctgtaagatgaaggcccccctgccctggtgtgatgtgtggccttcagtgatcatcatcatcctgtccgagagtcctgctggctctgcttggagaacctggccactttcctgcctctgctcctggcagcctccgtggcccgtcacttcttgtttgcctgtgaattctctctccagactcgagtgacactttgccttgcaaagctttccccagtgctgtcagacagggttagttctaagtctttcctgggagatctgtggcactctgggcatttctggaaggaaacttatgtgtgtctcttgtccctggaagggacagggcacatcttgttcatcagggcaccgcagccccaggacctgactctgatgccacaagcatttaatgaagacgttcaaagtgaacattcagaatctctgtctcttcatacttcttttcttgtgcttatatttagtatgtagtaacattcatatatggacactttcaagaactaacaggacacaggtgctgtctatggttgaatgacgctgtgttggactcgggctgggctgtgtgttgtgtggacacaggtgctctctatggttgaatgaagtggtgttggactcgggctgggccgcgtgttgtgtggacacaggtgctctctgttgttgaatgaagtggtgttggactcgggctgggccgcgtgttgtgtggacacaggtgctctctatggttgaatgaagtggtgttggactcgggctgggccacgtgttgtgtggacacaggtgctctctgttgttgaatgaagcggtgttgagactcgggctgggccgcgtgttctggataagtggctgtggagcacgatgaagcgtctatcgcagcatcatctctgcacccagatgtggccgtgctgagtggattcctgccccagatcttgggaagaaggttggctttcctcctggtgttggtggaaggcctccccggcgacactgctgcactccactggggcctttcattgtcctgtcccttcctgacaaggaaatggctggacactctcttcatgtcagcacccctaggtgctgggggctcaaagataagccaggcctggaagactcacccagagccaggggagcccacccccaatacacatactcaccaagccacatgctgcggttgggggtcccagaggtgtgctcaggccagcctgtggggacagcaaagtggcctccccgagaagggggcctgtcctcagtgtttcagaggcctcaccttgtctcatgcttgaaatatttcctgaagaatgccatttttgaaatttattttctaaagaaaaaaaatccaaatattgaaaggctctgcttgaatttttgtcagcaattactatatcaagaaaatatttctgatttaggtggctccttcagaatatctgattcctgtgttggcttctgcgttgcctttgcaggcctgtgtctgtaggtgaggttttcctgttcagatggagctctgtggtggtaaatgtggccttccttgttttatgttacgtgtttctctcaacttcatgagatcagaccagatagagaatgttaaagaaaaaatatttcgggcaattagaattgcaagaatgtcaagaagaaatatgtgtagtgaatagcaggctgtagaaaccatctcactgctcagatcttaaaatctgtagccaagagaggctttgaagcacccagggaagatgcatgtgccactctgcattttgtaaaattctgaaccatggactttattgtagtgctcgctttgccgacagctgctttagtcgtcgataatccccaaggatacttgcgtgtgccgttgccttcgtcaccaggacttggaggaaactgcagtgttgctatttgttatttcacgttgatatttccttccacctttggccttgtcctgcggtaattcctcatttaggattcctttgaatagttgggtcatggggagagttctgacgttattttactaaggtgaggtttgctaagccatcattcttacgtagatggcagaaaaagccattcggagaaaatatctgagtctgttcccgccaggttaaatagaaaggggatttgccaaggatctccagaagacccgagagccggtccctgacgttatggtaggcttcaagggggcttctgtagctgctgagcaactgagacagtggaggagtcctagaagacctgccaccgcctcctgaagagccaggtgcctctgccacacagctcacagggtgctcacctccctgtggaacgggggcctcgagtctcagggtctagaattggatcttgtaggtgcatctgatcataggaacccaggtcacatgctggccccttagctgcaggagtcaggacacagtctttttttccccaccttagtaagctatgaaccgtagcataagaaattgtcaaatatatggaaggtgttaagaagattatggggaactacagatggcagatgtctgccgtggttccccatggggcatcttaatggacggcttattactaggttttcagctgtgcaagacctttgattcacccatgcctttcatctctgatacccacttagcagcacatgctgttacctattctctttgaaattgagatttctttcttccttgtcccattccactcttgccacacctagctcaggccttcttattccaccgtgacagcttcctggctaatttcccttcctccattctttttcttcccaagtaaatgttagcccttgtcattaatgttagacgtcatcttcctgaaaatatccatttagccaggtttatgccgtggcagctgcagtggggcccggaggcctttcttccaggcctctgttattggaatccacctcccgcgtctatttggagctatggggcctttggaacggcttcatgagatgcgttggcccaagcagaaggctggtacagaagcagaacaaagctctgagcattctgagagttttctgttgagaaatgccatgggcttatgtcttcagcctgcctgggagccctgcatatttttacttgccttggggttgatttgatgaagcctgtaccatgggtaacatattgctggataatgaagagtggaaggaaaattagccctgaatgaatgactcagtcccatgataatgtggctaattttaatttgcatcaggaatagtaaagctgtggcccagtgtgttatcaaataaatctctaaacagccttgaaatcaatccatttattgaaaattgaaaatcttttttttttttttttttgagacggagtctcactctgttgcccaggctggagtgcagtggcacgatctcagcccactgcaacctctgcctcccaggttcaagcaattctgcctcagtctcccgagtagctgggattatgggtgcacaccaccacgcctggctaatttttgtgtttttagtagagatggggtttcaccatattcgccaggctggtctcgaactcctgacctcgtgatctgcctgcttcggcctcccgacgtgcagggattataggcatgagccaccgcacccggcctgaaagttgaaaatcttgttccatgaaataaattttagaaaattagccagacatggtggcgcatgcctgtagtctcagctactcgggaggttgagatgggaggatccgtttgagccctattgaagcaatagacttcactttgtatcttgaactgggaaggagtggagaaaaaaaaatattagagccctttgctatacttactttacgaagaccaattatttgttggtttttaaggaccagagttcccaggagtaagtgaaacacgactcgatctcttaagtgtgcccaatactgccagcacaacattcctcacaccggtccagcttgctagttaccttggatactcgcccaagcttcagctgactgcgcaggttattttctatatcttcagggtataaaaacagttgtatagacatacatgcacaaccatgaaaaaaatttttgactattgtggtaaagtcatttttatccccacttctgcccccccatgcttatagaaataacatgtttatggtagatggaaagtgcatacacagaagggccaggtacaaagaagaaaagaagaatcatccacgttcctctgaagaggtcagaatcactcatgacatcttgtgttttcatttggtacgaccttatatttggaatcacagttgtgggtacagttttgtaccctcctcttttcagttatgtttgagcatgtcctgtgccatttactattctttgagaacatattttttaaacagctctactgagatacaattcacataccccagagttcacccatttaccaacagagttcaccaacagttgcaacctgaaagtatgtttttgtaaaggacatatactattttatcatgtaacactgtttaatatacgccatttaattatgcccttcaacgtggaattttaggcttccataggatacagtttatcgtatttagattttatgctgttgaatgacttggaattaatttgtaagtgtagagaaaaatgaatcctagggctcagagcactgcagcagatcacgtatttttgctctgtgacaaagtatttttattttcactttttctttttttgttaatttcaccccataaggtgtttcgggtagaggcaaatcccacaagtatccttggggattatcgacgactaaagaacagcaaagaaatggttcctagctcctcacgcagtccttggtgggcggtgggctgactggctgcgcacgctaggcctcaaggtagaagcggttcatttagagacccccaggcatagtcgcatggcttcgcacacccgcaccagggctgaccatttgtttttggaggaaccacaaaaggattcagtatggaattccttaagaagggagtttctttagtttgcttaaaatagttacaactttttttttttaagacggggtcttgctctgtcacccagggtggagtgcagtggtgtgatctcggctcactgtaacctccgcctcccaggttcaagcagttctcccacctcagcctcccgagtagctgggaccataagtgcgtgccaccacagccggctaatttatttatttttatattttgtagagacagggtttcaccacgttggccagagtgatctcaaactcctgacctcaggtgatccgccaggcttggcctcccaaagtgctggaatgacaggcgtgagccaccatgcctggccaaaacagttgcagtttctataataaactttttttcccccagaataaaactagcacctttaaagtgagctataacgattccttttatgaaacttattttgtatgcagttcttattttgactttcagaaatctaaatttctcaagggtctgtgatgttggaactaaactcataccaagtcccttgtgcagtttgcgtggtgcgggaaggggtgagccaagtgaggactgtagcactcacgtgtgcgaaggtcgccgtgggcgaggcctcctcatccctgaggccgaaattttcctcttctcgtttccttttgatcaggatgttctacaggggtggaggcagattttaaaagcagtgatacatagacagaatttggcctaaaaaaagagtagtacttaaatctaaatgaggcctctggctcaaggtaacgagctgagctcatagattcaagcacctctcccctcattcccaattcccattgaaatgaacaaaggaatataaaaatagagagtctcccaagctaacacagttgctgctggtgatgatgatcttgttttggactgcaggttttggttgcagaaattcagttggatgtgcttcctgcgggtttggtgctcactttgtagcagtgcttggggatggaagtgaggggcaaactggcttttccttctcttggacaacttggttacccgcctccccttccctgcgaggtatatctactctctttgctatgtgttctagtttctgactctctttataaattatgcatttgtgtagcttcggctttgctccgagtttctgcttgatgctgtgaatcctaatgagcgctcccgggaattgggtggctctgccttcagacaaaccaggggatagtgaatgttgtgacctgtgtggccagccccagtcttgctttgtgtttattttccacaactctcagttgttgatgttgggaggataagtgtgagccacactcttagtgtgggggacagaaggcagtgattgggctgctgaacatgtttaatttcttcattctgcatggtgacttaggtgtcactgcacgtcagcctgtgaatttatacccaagcttgtttgtgccacctgatcacctgtatctttttaaatatatatgattttatccaatcagttatgaaggaagactctagtaaggaaatcccttgtgatttgctttgaattctttgggaggtgacaggcgttaataggtttttcacctgtgaggtgacatgctctgagcttacaggccttcgagtggaggtgatctggtctgcaggccctgtgtgcaattctgaaacccagaagctctgaacgctggattatttccacagctcatttggtggcaacgcttggcctgagctggggtgagactggacactcttgattgattccatggagagtggaaatgttaacgtggtgagtgttgggtgctgctccaaaccctcctgggtgtgttaaccctcctgggtgtgttatgtgagatggggcagagggatcacattatcctttcaccaagctgaacactgtggaatttcaaaaccaagctggcaccaaaggagcatcaagaacactgcccaggctgttataataacatcaggaccccactgcttgacggcccccagcctctcccacctggaatccaaagtgccgtggagatctttgagccggggcacaggatccttaggcgtgtgctccagcctttagtgggtgcctccaggatggctgggaagaccagtcatgagtcagaacttcagaatctgaaaaatccttagcacctgagaggtcatctgtctccaccccctcactttaaggatgaggaaactgttcaggagggattgaaatttaccgtcatgtccaaggccatgcattgttagtgagcatttatagttttatagtttctcaaaatgatactcttttcaaattcaaaattaacctatggggatataacgatgtcatcttaaattacattgcattggaggaaaatgtcttaaagtcaaaaaacttatgtaatattatgcagtttttggcacattaaatttgatagcccttacattttaaacattctgtaactgttattaaaaaacattaatcaagagtttttgaaacgaggttgccatagaaatgaaaatacaatgccaaaaagacattttaggtatagctaagaatttaaaaacttactaaatttgaggccaggtgtggtggctcacacctataatcccagcactttgggaggcggatgctgccagatcacccgaggtcaggagttcaagaccagcctggccaacatggcgaaaccccatctctactaaaaatacaaaaagttagctgggcatgctggtaggcacctgtaatcccagctacttgggaggctgaggcaggagaatcgctagaacccaggaggtggaggttgcggtgagctgagatcgtgccactgcacgtgatcgtggtcaacagagcaagagtctgtttcaaaaaacaaaacaaaaaacttaccaaatttgaaattaggctcacagtgttaaaatctgcagaggagcaagacgtattttttttggcttaaggatatgtgatagcactgtcttttgcccagttttggagttaaattggtagctagatattagagctaacacgttgttctagttcatgtgtgagtgtattcgcgaggtgcttttcttgttttctttaaaagtataatgcaggatgtagggttaggtgtgtattgtataaacaagatgaatgaaattaatttatttcttgtcttcattcttgtctttgtatagtgtagctactttcacacattccagctgagggccatgccttcctattgctggcctgtaaagaagtcagaaatggtctctctaggtagcatttggtgagtcaggaagaccacacttactgacaggcacagtgaggtgaggcccctagccatcccatgggactaaaggatgattcttgggcttctattaatacttttgtgtaagggactcagagatcttcagagatacttttataattaactagagctactcatttgactgagaatgttaaattttaaaaatttaattagctgcatttgtagaggtggagggaatatgacttgtctaaaatgacagccgaggtagcagaaataggaatcagtcagaggtgttgggaatgccgtatcaccgccctgtgtcggcctctgccgcctccccagccccgagacgcagaggaggaagcagacccagcagccccagagcctcttcacccagcgagcttgccctagtcctggctgccccacttgctcgctccctggacttgcagccgccccttactccctggattcctcgctgggaggggaacgccaccacctagttcatgtccctgtggtgaaggatgaagtggactgtgcgtctacactgcacggctcagggaataagcactagcacagggagtcaccattgatccgaagtgctgggactgagtcccaaacctggctgtgaatttcccgggggcaagaaagaacagggttgtgtgggaagttactgagcatacatcagcccagaaaaacagctctgcccaccttttcctggggcgcacggagcatgtggataaacggggagaaagcactgccagacaagccccagggcagcggcggtggcacttggccacgggagcagcaggtgggtgtctcagattcggcccgttaatgctgtttcttccacgggcttttgctagaggagcctaacatcagtttaaggcctattctctttgcagattagggacaagataagaagccagtggggaaccagttaagctgtggggaagcacaaggtctattagaaggcttcccttcccacagagggaccctgcagatgactgtaggcaaagccagcctcttcctttaggaagcaacttggaacttgcgccagggtttgaatcaatccctctccatattacagggcgtgaaaggaacacccttgatttaaaagtgttgtgaggcaggtgttaacagctgttcaccatggccacaggaagaccacagaaacgtttccaggaaatgtctagttttaagcagtttatgctcaaaggctgagtttgctatacaataattgggatttgggattatggatactgatcacttaaatattggaggatgactaattaaatacagtgacttttgttgttctgatttttagtgctttctcctgataatagatgaaggggccatttgtctcttacgcttcataatggaggcttctgttacatgtctgtgggaagacattcttctcctagtatatccacggaggcagagatgcagttcctttagaaagtgatattattggctgggtgcagtggcacatgcctgtaatcccagcactttgggaggccctgggctggtggatcgcttgaactcaggagttggagaccatcctgggcaacatgacaaacctcatctctaccaaaaatacaaataaaattagctgggtgtggtggcacaccctgtggtcccagctactctggaggctgaggtgggaggatcgcttgagcccaggaggtggaggttgcagtgagccaagattatgtcgctgcactccggcatgggtgacagagtgagaccccacctcaaaaatgaaacaaaacaaaaaaagaaagtgatataattaataaatttttttaactgttaagagaggaggcactaaaatgcttcctttttcttatacaactttaaattctgttttgaatagagaatcttatctcgatgtgataaagattgtacttaaaatcagtcgccagcatcattctgaacaatgaaacatttatgtctcatgaaaatcaactgcaaagatctccactgtcatcattttgttattattagtgttattttagaagttctggtcaataacgctaagatctaaaaccgaaacaggaggaatgatctattggaaagaatgagacagacttattattcttagataatatagctgtatactttcaaaacctgaaaagaatcaccaaaaagcaattacatttaactaagaatttagtaaaggaactaaccatttttcttatatatcagcaattatcaataagaaactgttatggggaaatacatatatttccctgaaacactcatgaaatatctggaaatcttaaaattaaaaattaaaaatacttttattggtgataattttttacattcatataatcaaatcagagtaattgagatacctatcaccttaaatatttatcgttttcttttttctttttattttttttgagatgaagtcttgctctattgcccaggttggagtgcagtggtacagtctcggctcactgcaaactctgcctcccaggttcaagtgattctcctgtctcagcctccggagtagctaggattacaggtgcacaccaccacgcctggctaatttttatatttttagtagagatgaggtttcaccatgttggccaggctggtcttgaactcctgatgtcaggtgatctgcccgccttggcctcccaaagtgctgggattacaggggtgagccaccgtgcccagcctatcttttctttatgctaggaacattcgaattattttctttaggtatttaaaaaatgatttattcatttatttatttttagagatggggtcttgctgtgttgcctaggccggagtgcagtggctgttggcaggcacagtcatttcacactgtaccctcaaactcctgggctcaagtggtgctcctgcctcagcctcctgagtagctgggaccgcaggtgtgcaccaccacacacttctagctgcttgaaatgtactctcaattaaattaatgttaaccgtactgtcaattaaattaatgttaactgtcatcgctccactgatttatggaacaccaggtcttaggaataatcctaataagaaaggcacaggacttactcgtgaagaaaactataaaaatgttactgagaacagttaaaggaacatttgaataaatggagaaccatattatgttctgtatagaaaaatagaatattatgaggatgttacttcttaacgttaagttaaaattaaacttcattgcaattttagttcagtgcaattttaataaaaatcccaatgggattaaaagattgaagaactgattaatttgaaaaaaataagtgaatataaatagctaagtaaaattaaaatttgagggtgaaaaatgacccttccaagtattatgaaatataaagataaattagttaaattaatgtagtactagtagaagtattggttgataggttaatgggatgaatttgattacccagaaatagaattttgtctctgtgagaattaatacatatatctgtgcacacctgtgagtttggggcagattatttaacagggattgacacaactggctagttttatgagaaaaaattaatctttatcttgtatcatataccagaataacatccagacggcttaaagggtcaatgtaaaacagaaacactgtaccaaaatacatgtcttccctcactcagcaggtagttagcacctggtccaggccagggttttgttcaaatgagtggacttgagtctctggcccactgaggagcatccatgggccggagctctgccgggaggaaaggacaggtgtgatcgcagcgttccccagctggctccaccccgatggggagtgtggaaggtgtgttgaggggtatccagagaaggcctccccaagaaattgatctttaaactgagatctgaagagagagtcagagccggccaggtgacccgggggaggggaactcccagcagagggaactgtggatttgagggccgagaggtgagtgtggccaggccgcagtgtaagtacgaggaatgagtagtgagtagatggtccacggagagtgaacaacgcaggcagtgaaggcactctaggagaaccaggcagcatcactgatgtgaacgaatgtaaactaaatcaatactacagcttttctcattaaatgattgatggttttaaataacaagaattttacatctggtttaatatctggtgggagtgtaaatttgtgtaattttttttgcaaaggaatttggcagaatgtattgagtgcgttaaaatgtttatatcttttgatcaaataattccatttctggagatttatcataaggaagcctgagaatagcccttcctgccacgtccctctcaccacctgtcccctttgctgtgaaaccctgccttcaaagaagggcgttactcctgcactagggctggggtagccaggtgacaggcggaggactggctggagggcaggtgggtagggaaggggctcaatgttctgggggacattttaaaagctggaaaaacacataaacgagttccatattgaaatatttatttatttttttctgttgtgttttcagatgaagacagtcagtgttgccttagttttgtgcctgaatgttggtgtggaccctcccgatgtggtgaagaccacgccctgtgcacgcttggaatgctggatcggtgagtatgcctccctcacgcgctgccacaaaggccgtctggccggctctggcctgggcggtgctcgccaagcctgtggtctggtccaggggcccgtctccagctgtgcaaatctgaggggtttttctttctggagtcacatcacctttgagtaatttccgatgcgctcacctgtgattggtagtggagagagtgtttccagaaaaatcaatacagtgatgattattggcttatataattttctactttatttttttatttattattattatttttttgagacagagtcttcctctgtcaccaggctggagtgcagtggcatgatcttggctcacagtaacctctgcctcctgggttcaagccattctcatggctcagcctccttagtagctgggactacaggcacccgccaacacacccagctaattgttgtatttttagtagagatggggtttcaccatgttcgccaggatggtctcgatctcctgacctcgtgatccgcccacctcagcctcccaaagtactgggattacaggccaattttctactttattacacgcccggccaattttctactttatatttgttctgtctggcacacatagtatctatgtacacttaaaaaaaaaatggaatgactgatacctgcatggaaatgtagaagaggtaaatggaaccacttccagcaaagcatcacataatggatcatggcccataataataatggccatcatttgctgaatgcttgtagtgtgtcagacgccactggaagcactttacaatgctcacaacaaccttgtgtggtagggtttttgctaatctccatttgagagctgaggaacatgagacatagagattagtaatttgctcacggttgtcctgtagagctggaatttgaacctatgcagttcaagtccagagactgttttttttttttttaaattgtggtaaaacatacacaacacaaaataccattctaggaattattattattattattattattatttttcattctaggaattattaagtgtacaattgaacgacatgaaataattcataatgttgtgcaagcatcctcactgtccatctctagaaccttttcaccatcccaaacagaaactctgtctccattacacaactcctcattcctgccttcccctagcccctagtaaccgccattccaccatctgtctctatgaatttgtcattctggggacctcatatcagtagactgatatttgtccctttgtttctgccttctttcacttagcataatgcccccaaagttcatccatgtcgtagcatgtgtcagaatttcattctcctgccgcagcctcgcaataactggacttataggcacctgccaccacgcccaggcaatttttgtatttttagtagagatggggtttcaccattttggccaggctggtctcaaactcctgaccttaggtgatccacccgccttggcctcccaaagtgctgggattacaggcgtgagacaccatgcccggccaagatacaatttatatacagtaaagttcacattttttagctgtacatttaagttttgacaaatatgtacagtcatgtaacaaatgccataatcaatgtatagaatatttctgtcacaccaaggaagttcccttgggtccctttgtaatcgatcccctctcatttctctggcctctggaaaccattgatctgattttttccttttacagaatgtcatttaagtggcgacatatagtttgtagtttttgtatcttgcttctttcctttagcagaatttatttgtgattcatctgtgtagctacgtgcattagtagtttttttcctttattccatttttatggctccctcacaatttgtttatccatttactagttgacagacatttgggttgtttctagtttttggcaattatgaataaaattgctataagcacttgatctttgtgtggacatattttctctggttaatatttaggactgtgattattagctcatatgttaagcgtatgtttaaatttttttttttttttttgagatggagttttgctcttgttgcccaggctgggagtgcaatggcacgatcttggctcaccacaacctctgcctcccgggttcaagcgattctcctgcctcagcctcccgagtagctgggattacaagcatgcgcctccacgcctggctaattttgtatttttaatagagacaggatttctccatgttggtcaggctagtctcgaactcccgacctcaggtgatccacccacctcagcctcccaaagtgctgggattacaggcatgagccaccgtgcctggccaagtgtatgtttaattctttaaggaactgctgaactgtcggttttttaaagatctttaaaaataatgaatgtcttttatatttaccttcatatttattgttttgaggaccattcatttctttccgcagttccaagtttctatctggtatcataatcattctgcctgaagaacttactctaacatatcttgcagtgctggtctgtaggcattaaattttcctagatttctgtttggaaaattcttcattttgtctttgtggttgaaaggtattttttcggggtatgtaattttctgttgactcttttagcactgtcttttaaaacagtcacctgttgtgttctggctagcagtttctgagaagtctgctgtaattctttgtttctctgtatattttgcttcatttttctctggcaatcttcaagatgttccctttatattctcagtagctttatctataacctattagttttttgtttgtttgttttggaatttattctccccacccttttttttttcttttagagatgggtgtctctcattgttgcccaggctgggctatacttgaacatctgggctctagtggtcctcttgcctcagcctcctgagtagctgggactatggatgcccagtactgcacctgtgaaatttattctttttgggtttctgtgagcttcttggatgtgtagtttgatgtcttcatttttgaaaagttcccattatcttttcaaatatttattgtttgttttctctctcttctgggactcagctctctatgtattgtgctgttagacattgtaccgcagctcttccatgtgtctctctcttctgggactcagctgtctatgtattctgctgttggacattgtaccgcagctcttctgtgtgtctctctcttctgggactcagctctctatgtattgtgctgttggacattgtaccgcagctcttccgtgtgtctctgtcttctgggactcagctgtctatgtattgcgctgtcggacatagtaccacagctcttccatgtgtctctgtcttctgggactcagctctctatgtattgtgctgttggacattgtaccgcagctcttccgtgtgtctctctctcctgggactcagctctctatgtattgtgttgttggacattgtactgcagctcttccgtgtgtttctctcttctgggactcagctctctatgtattgcactgttggacattgtaccgcagctcttctgtgtgtttctctcttctgggactcagctctctatgtattgcactgttggacattgtaccgcagctcttctgtgtgtctctctcttctgggactcagctctctatgtattgcgctgttggacattgtaccacaactcttctgtgtgtctctctcttctgggactcagctctctatgtattgtgttgttggacattgtaccgcagctcttccatgtgtttctctcttctgggactcagctctctatgtattgcgttgttggacattgtaccgcagctcttccgtgtgtctctctctcctgggactcagctctctatgtattgtgttgttggacattgtaccgcagctcttccatgtgtctctctcttctgggactcagctgtctatgtattgtgttgttggacattgtaccgcagctcttccattgtgtctcttctgggactcagctctctatgttttgtgctgttggacattgtaccacagctcttccgtgtgtctgtctcttctgggactcagctctctatgtattgcgctgttggacattgtactgcagctcctccgtttgttctctcccatgtcacaatgagcttttgttagtctgctgataaaccagccaaggaaattctttttctctgatattgggttttttatttctagcatttccattgactattttagtttccatctctaggggaaatgcatattgcctgcctttccttctagagcctctgctgtgttcatcatagttaccttagagtccttgatctatagttcagaaaacagggtcagccctgagtctgagtctcctaattcctttatcatctcttgactgtaatttgcttttccttgctttttttgtgctttataaattttaattgcatgctggacattgtgtgtagaagaacaatagcgaatgaggtaagttgcatagtctatagtttagtaagtagttaactggggttagaatttgttgttgtaatggttatacccagtgcaacagcactcttagttcttagagtgattagttggtgcttgtgtcagtcaaggttctccagagaaacaggggcagtagatgtgtgcctgcatgtgtgtataagtatgtatgcatgtatgcatgcatgtcttgtgatcttgaggcagaaatttcttctttctcaggaaaacctcagtttggctgttaaggccttcaactcattggatgaggcccccatattaccaaagaaaatctcctttactttaagttagctgattgtggatgtcaccacatgtatagagtactttcactgtggcacctgggtttgtgtttgattgaattgctgagtgctacggcctggcccagtggacacataaagctgaccagcacagtcctcgtgcattagggtgggtacaggcaggccagggggttttcccagggctcctgctccacccctagcctgagctgtgcctgcccacgtgcctcactgagtggtccctggctttgcctgtctcctggcacaggatttccattgctagttactcagcgccaggctgtggagtggtgggagttctctgtggtcctggtctctctttagtcttaggcaggccctgggcatctgggccttgggcgtagtgcggttgcagtgttttcacctgtcccccagtgatggcaaacgtctgcctcgattcagtgtagaattctgtgcccagggcgtgttctgctcctatcccaggagtaggctgttttgcaccttccctcaccccatcctccatgctcttcacctgtgtcttgggacagtgtgttctatgcccatggtgagcaaggtaggttttgtctgtacctcctcccactccccaggtacaggagtgtgtgcctgttcttgtggactgagggtctcctgctttgcttcctaggggaggaggtctctgggggcaggtggacttcaagcctctccacactctgtgctgcctccagcagatgcttctcatgaagtgggggtgcagtgggggtgcatgcaggagagtgtgagtgccccttgtgcctggaccccctgtgtttccacacggatatgcaagcgcacactggggcctcgaggacacattaccatcttagctggtttcttgtgcagacctgcgctcttcaaagatgggctgtgcatgtgcccgggctttctcggagaggacgggcctgtgggattcggtttgtctgccctgcggtctcagctcccttatgagctcaagaaaagtgatgatgtcagtgattattcagctttctcatgttgataggattggagccactctttccccccagctttctacatcctaagcaaaagcagaagttccctttattgctttaacaaaaactacaaattattctcagcctgggcagcatagtaagagaccatgtctctacaacaaatcagaaaattaggagggcagggtggctgattttgagatgacaggcatgcctgtagtcccagctactctggaggctgcagcaggaggattgcttgagcttgggaggtcgaggctgcaatgagctatgattgtgccagtgcattccagcctgggcaacagagtgagaccctgtctcaaaaaaccccaaattcttctcatctaaatctcatctaatctgaattggaaataaatgttgtttttcctgcattatttggctgtcacactatgtgagggtgttttaggatgacagttccctcaccccttccaggctgcttgtcccccacaccccatgatggagcagctgtgttttgtggctgatttcttcagatgctctcttggctcactgctggctcccggtgactgtgctggttgaaattgacttcttattagccaccatggactctttccacttcatccgtccctcgtcacagctgaatgtaatcagttattttctcttcctctacagcaatgcttatgttaggcttttcgaacaagccttcctcatgcggatccctgtgtgtgctcccgggacgggacgcgcaggcccttcggggttgtgtaggtgtcatctgaggatccagttgctcttccctgcctgaggagcctgagcttttatcagagctcaccgccctctcccacacagtctctttgatcagtatttacacaatgttaatgagaatggaaaaactccatgcttctttcttggtgtgaaagatccagcaaatgagatttctaaaacttgagttttaaaagttttcctgcagtttaggaatatcgtctactttctaataatttcaagtgaattttgagtttaggagggcatgtgctttttctaagttggaaaaattttatttggcctttattaaaaaatgggtaggttcctggtcctggtgatggtggttttaacaatatggcataagagaataagaagcctagtgatttgaatcagcacatttgcaggagtgtgtagcagcccacttttattttttagtttatttacttgaaaatttttatttttgtgagataagaccttactctgttgcccaggctggagtgcagtggcgtgatcatagctcactgcagcctcaaactcctgggctcaagccatcctcctccctcagcttcctcagtagctgggactgtagatgtgcatcccccacgcttttaaaattttttatggagacagggtctcactttgttgctcaggctggtctcgaactcctgggctcaagtgatcctcccacctcggcctcttaaagtgttgaaatgaccggcatgagctaccacactaggcccatttttcattttgaaaaaaaagttccaaaagttgcaagtatagtactaagctgtttcctttctgattctctgagagaaggcggctgacatggtgcttcagcacctctgaattccttagtgtgtaattcctgccagccgggagtttctctttccagatgacaacgcagtcaccaaaatcaaggagcattcgcgtggacgtgtgactgccacgtaagcgtccgctgcatgcaggtttgccagtgtcccaggaatgtcctttgtagcgccaggatcctgctcagccatgcgccatcctaacttcctctcactcagtctgaagcagttccacaggcattccgtgaccctcctcaccctggcgcttgaaggtggcagtctctttgttttgtagaatgtctccggtgtctcctaatgattccgtttaggtcatgcttcgctggcaggagcatcacgcagagctgcctgcttcacgcgggctgcaccaggtgatgcggggctgtgatctatccattactggtcatgcagatcttctcacctgattcagctggcgcctgctggacctcatgtgaaattcccctttgtagttgataggtattttcgggaagaagtgctttgagattgtgcaaatattcctttcctcgtgactttcaatttcttcattttgaactcatggcctccattttcattcagtggatttagaatccagtgttatcctttggtgccgagcttgtctccctctggttgttgggaacccattgggccggcttctttggcttctgtcttgtttgcatcattcgtggagcatgtgcttactttgtctcatctagtctttttcccagcctcattcctcttagtggaatgtggtgttagaaactgagatctgggtgccaggtgttctctttgaactggcgtgctattgctcccgggacctctctcgctggacagagcaaggaaatgcatgtgtgtgcatactatgtatgtgtgcatactgtgtgtgtgcatattgtgtgcgtgtgtgcatactgtgtgtgtgtgcatactgtgtgcgtgtgcgtactgtgtgtgtgtgcatactgtgtgtgtgcgcatactgtgtgtgcatactgtgtgcatactgtgtgcgtgtgtgtactgtgtgtgtgtgcatactgtgtgcgtgcataccgtgtgtgtgcatactgtgtgtgtgcgtactgtgtgtgtgcgtactgtgtgcgtgtgcgtactgtgtgtgtgcgtactgtgtgtgtgcatactgtgcgtgtgcgtactatgtgcgtgtgcgtactatgtgcatgtgcgtactgtgtgtgcatactgtgtgtgtgcatactgtgtgcgtgtgcataccgtgtgtgtgtgcataccgtgtgtgtgtgcatactgtgtgcatactttgtgtgtgcatagtgtgtgcgtgtgcatactgtgtgtgcgtcctgtgtgtgcatactgtgtgtgtgtgcgtactgtgtgcatgtgcgtactgtgtgtgtgcatactgtgtgtgtgcatactgtgtgtgtgtgcgtactgtgtgtgtgcgcgtactgtgtgtgtgcgtactgtgtgcgtgtgcgtactgtgtgtgtcgtgtgcgtactgtgtgtgtgcatactgtgtgtgcgtactgtgtgtgtgcgtactgtgtgtgtgcgtactgtgtgtgtgcgtactgtgtgtgtgcatactgtgtgtgcgtactgtgcatgtgcgtactgtgtgcatgtgcatactgtgtgtgcatactgtgtgtgtgcatactgtgtgcgtgtgcgtaccgtgtgtgtgcataccgtgtgtgtgcatactgtgtgcatactttgtgtgtgcatagtgtgtgcgtgtgcatactgtgtgtgcataccgcgtgtgcatactatgtgcgtgtgcttctctctgtacacatttgtctcagcgtttctgtacctctctacatgtacattcatgcctcctattccacctcatgggggttttccatatttgtagctccatcttctgacagtgacaaccttggtatcctttgtccttattgtattggctaatgtggtgcctcctcctgtgtgaaccctcttctcctctctgccattgctgctcctctcagacccggttatcctttgccatttcaccccaatatctgcctttctcactgccctggtccaacacccatatggtcacctttctgcagccacacctctccttcttcctctgcacgggctcagggcccagtcagacttgagagctcattccaggccagtgtggctcccatcatcctgagacagatgccagctttgcccagacccaccttgtggctttaggattgttgaagaagggattttagcattttcaacaagtgctttaggtttcaggcctggtcagccgagggaaggatgatacaccagtaaccaagactgggacgggagctgggctggctggcagatggtggggtaccatttcgcacatggtgaggtgcttgtaggaacctccaagcggagccaccatccagtggaaagtggatctggtgggagaagggggctcattgtagactagaggacccaggggaggtcagcgcctagtacgaactagaccagagggtatcgggcagaggcagggccctgagggtgcagagaggggtgccaaagaggaggaccagggtggttctggatgagtgcgtggaggagcttctggtcagcattgtcaaggctgaggtggtgtccaggctgattgtagcaacctgaagagtgaaggcagatgaggtggtgaagcttgtggggcagcttggccaggaaggtgaggagtggggtactagtgttggggctgggctcagtgatgggtttgctctgccttcctcaagatgagaatgacgggggccatggaggaagccaaaacagggattggtgcaatcaaattacttacaaacatgttaccgtttagaaggcagacctcaggattttatatttggtcttagcattttgaggtctattactagaaatcgagatttttgtgttaatcaagactccagctttattccttccagctgtgctacacatttaactgttttgggcctcagtttcctcatctgtaaagtggagctagtgatgccgtgtacctcatggcagggtgggggaattaactgggagcagagacctggtttggtgcagagactggtcctcacctccgccgccccaactctagtccctacttctaccccaacatcacaacacctcaaacaccccgacccctacgtcacggcgcctcaagcatcccgacccctgcaacactgtcttagtctgttgttgctgctgtaacagaatacccgagactgggtaatttacaaacaacagaaatgtatttcacgcagttctggaggctgaggagtctaagataaaggcactggcaggtctgttgtctcttgagggccctgtccatcttccaagatggggctgtaacactgtgtcctgtcacggtgaaagggacagaaaggcagaagtgtgcgtctagttccctccagcccttttatgaaacacgatcgcctcctgaaggccccatctcttcatactaccacattgggcttccgttccaacacgtacatttttggggacatattcagaacatagcactagccccagtatccccactccagatcacccacacccccgcaacacgccccagtaccgccattccagatcacccacacccctccccaacacgccccagtgctgcatggggagcaggggccaaggtgctgcatgagctgcttcctgaatccgtgcctcttccgctgctttctgtagggctgactacgaaagagggctgcagtgaacacacctcactgagccccactgccgggcatgtagccttgcaggacggccgctcactcagggttgaaggtctccagcagattctgggagtagatgcacggtgctgcttatttcgttttacaaattaaacatccaatatgcaggtagcaatgtgtgtgaatccccagtgctttatgtagaaccctgagtatggggttcatttttgggcagggtggggtggagcggaaggtggtctgtgctgatgtcagaggggtctgagaagcttgaaaaataagggtaactgtgtgtgcctgaaccatgcaggaagacagcactccttccagagatgagggagagcagacgtcatgtctgtgagcaaacaaggggcccatgcccagcgtggctctgggtgtcatggcctccctgctaggtcatccggatgaagcctggggctgtggagtcagctcgtgagaaatgggatccaggtcctgagcgtgctggaactggcgagacggggtcacagcacacacctgcgtttccagccctgcccctgctgacggccaagacctcttttcccacccctgctccgcccccctctggataataagttgctgttctagttcatagaagtgacacttgtcccttttcagagaagcaggggagaggctgttttgttttatggcccgacattaaatactacaacagtaatactaaaaacaatcctgctgaagagctgcgcgtgccccactcttggggaactctgctgtggcagcagagtgcggatgagctgcatgctgagcagggagtgtcatttagcggaaatggttttgtgtgccagctaatggtagctgtgtatcagaagaggtgagaatgcaaaggtttgtcagatgtgtggaaattctgtcatcccaagggaacgtttgggaggtcttagctttgtttttctcttcttaatgcaaacacgtgagcattaagagaccttgggtagatgagctgaaaatagtcgtgatcgcccttggcggcggctcgtgggtttacagagcacttgcacagacttcgtcgttgattcttgcaaccatttgggattcatagaccagtcaagttggttaacagatattgattaggtggaaacgtatatgttaagcatagtgccatatacaaggaactgtaagctgtgctcttgctttcaaggcactgatagtacacctggggaggtaagactaggatccatgcagtagaacagagaccaatacgaggtcaagcttgaacggcctggaaggccagagaatgctgcggtagagacgtcagggcaggcagtgggaggcaagagcaaagagctgaaggaagagcatgagcccacactctgaggtctgaggggctgggttttcgcacaccagctgggctccctttgggcctggggggtcagtagcacccgttagccacggccagtcacagctgtatgctctgtgcacacagctctgtgcccacagctgaaaccttggctctttggggcttatggtttaaaatgctgttttcttttcttcctttctttttttttttttttttttgagacggagtcacataggctggagtgcagtggtgtgatcatggctcactgtagcctctacctcctggactcaagcgatcctcccacctcagcctcctgagtagctggaaccacaggcatgcaccaacacgctgattaattaaaaaaaaattattgtagagacggggtctcattttgttgcccaggtttaacatactgttttctctgccagttccattggtgtctcaaggtggtatctctgcttcccctctgaaggaatctgaaagaagggggttaactgcttggagcccacctctctcctgtatctactttccaaagtgaggacagttttttaaaacaggacatgttcatcccctcatatctgctgaaaatccgtctagctcttggtttttgtataatacagcaataggcaacacaggaacgtaattttgtagctatgtgaggagtgaggcctagtgttagaacggggccagactgtaaaagatctcgctcctgtacggctcccgtcctagtcccacagacgctgcaagggccgcgggtcccggccgaagctttcctgtcccagatgcctgcagctgtgtggctccaagctttgcgcctgagctgaggaagatcacacgcctctcactgtatacaggactaattattacaaaatagacagggatggcattatggttaggaaaatatagactcattaaaaatcatttctaatttcaaagtagcccctttgctattatgtattttctcagtcaaaaatgagttgtttaaggctacacaactaatgagtggcagagtccttgaaaaccacacagagaaatttgcacttcatctagtaggcagcactcaatatgtcaattaaaaatgtttattaagtgtctgctaaatacacggtacaaagaactacaaagattgtccgagcagtgagtgctggatggggctttcagtgtgaacttttcactgaaggatagcacacagaggaaactgcacctaacccgggtgtatcctaaactgatcatacccatggaccccagatcaaggaacaagatgaccattggcccagaagtcttatcttgtcccctttgggtcccctcccccagctgcactgctgggtctccactcttggcagctttccatctaaatggagcacacagcccgcactgtgggcttctgaggggaggggtcagcctgcgctcatcttcagggtggactgagaagagaaagactaggtcattggtggccctgtctgtgcctggggcagcactctttggggccattgggtcagattgaggaacccagctgggaggtgggagagtctcagtagcatcgtgaagggctgcggattgggtgaacatgttagcagtggctggtggagtgccagctctttggaaggtgaaatggataggatgggtaatcaaactgggtacataggaagaagatggagaggtttaaaaagaaaaagctgcaccccttcaggttggctgaatgccagcactatcaataaccttggagcaagtcatttgactgctttaaacttcagcttgcccttctgtcccatgaggtgggttggaccaagttcctttcagtgtaaagttctaagtatcttgaaattcagaggggttatgctgaaaatcttgcaaataggaaaatttataaagaactaaaagttttatgcaaataccatttaccatctccttttccatccacctacccatccatttcattcatcaatttacccacacactcactcgccgctgaagtttcattagttctttcccagattccccttaaataggagctcataaaggaattagaagagaaatgttttataagacacaactacagttttacatttatgatctgtccacttcaccccacatcagactgatactgttgtcaataatatctatcggggaatttaattttagtttatttaaattatacttaatcaaatgctaaatgcatcgtttcatttgacctcattctttcccgtctcttcctctgcttctcatttcagctctcccacccactgccctattcttggaagggaaccatacaattaactgaccacagggattcccagtggataggcggttatagcgccatgtagctggtcacggcctggtgagcagctgacagtggtttcacccctcctgggtgggcaggtgtcctgacctgagtcagggcagggagagtggggcccctgccaggctgtctctactaacgagggccgccatgtctctgtaggatgttgtgagggatgcagggaagtggctgcctcctgccaacactggggagagggtgggatgggagaagggcctggactttccaaggggtgaaatccaaggagggggtactccttgaatgggaactccctcccttcttcctctgtccgtggttcactggagagcatgcatagtgtgagccaccgctgaccgtcgtgatgcatggacagttttctgaccatagatgacagccgcgggccgcgaccatgctggttgctgcagttaagtatgggtgactgaactcaacgccttccagccagccctgtgcgtttactttgctcctcctcatgcatgcggcaaggtcgctctttggcatctgtttgttaaagctgttttttgctttcctttgccttgtttgtgtacttcgtggcccctattttttgtttttcagatcccaatccaatcctatcttgtgggtctgatcacagcacagttgatttgggtcactatgatttttttgagaccttagaactttgttcctgagagaaatgaagaccaaacatgtaacgtctgaagtcacagattacggattataacaaatttaccacaattcttccagagaagttagatattacctggtttttaccaagcttttctcagccagaggtgtccattgaattagaaccattgaattagaatttccagaaggttagggcctggcatctctgttttgaaaagcccttgatgactttgacctatctatgggcgaaggccctttccagttgtaaaatcttattaacgtcatgatttttattttatttttttatcagagtaacatacatatagctaaaaaaataataattaaataatgccaaaaactatacaggtggctcttggagatcctgcgggtttggctctagacgactgcaataagtgagctacatgaacgttttggtgtccagtgcatataaaagttacgtttacactgtactgtagtctgtgaagtgtgcagtagcattgtgtccaaaagaacatacacactttattttaaaaactgaaaaatgttaatgatcactggagccttagcgagttgtaatcttttagcatttaattggctgacagagggtcctgcctcatgtggatggccgccaactaatggaggaggggtggttgctgaaggtaggggtgactatgggaatttcttaaaataagacaataacaaaatttgctgcattgattggctcttgctttcacgcagcatttctctgtagcatgtggtgctgtttgatagcattttacccccaacagacagacctggagtagttggcagatgttttctggaaaatgaatgacatgagcctgtcacattaaggaaaacaactgacagtgtttgtttccactgataaaatttgagatttcaaataaaaaaaataaaatttggaaaccttatacctaccactatgagcctggcaacttcttttttgttgttgttgttgttgtctttgagatggagtctcactctgtcgcccaggctggagtgcagtggcgtgatctcggctcactgcaacctctgcctccagggttcaagtgattctcctgtctcagcctcctgagttgctgggattacaggcgcccagctaatttttgtgttttcagaagagacggagtttcatgttgctcaggctggtctcaaactcctgaccccaggtgatccacccaccttggcctctcaaagtgctaggattacggtggtgagccaccacacctggccgagcctggcaacttcttagtacttaagacatttctgatgagctcatggtaatgttaatgagtgtggattcttaaaaaaatattggggaatgaaatatacaagatctgtatagttcaatgagctgatattttccagatgatcaatgcatgatgatacaaaataatctatgggtaaaaaatccactcaaggtgcagcaaacagcagtgaattttaatgtcatagcatacaaaaagttcgttgatgtggtttcagatactacatctcatataatctgaaggaaattaccacttgataatttttggtgtagtatcaaacaaaaagagtcatgattatgtaaaatagcattttaagatactcttctgttttctaatgatagatatatgtgtgaggtaggggtttccacatatgcagtcactgaaaccatgaaatgccacaggcgaatgcaaaaatggatgagagtcacccatccttgatcaaaccacatattccagaaattcgcaaaaatatgcaaaaatgctgctcttctactaaacttttttggaaaaaatagttatttttgtaataaatatttatgttaaaatataatgggttattgtttttaaaatgaatgaagaaaaatatttaaaaaatcttagctgaatttcacatagagtagatattgatagattcaacaacataaaccaaagctctttgaggttttcaataattttagagtgcaaaggggtcctgagaccaaacaagtttgagaactgctgatttagagttaattgccctggaacccactcctgaaataaatgggtaaatcctggacatgaatgtacatttgtgaaacggattttttttgtgggaatactgagtgcagatgaaaattaattaaaaagtatcacttctttgtctttttctctcctccttttcctgtacccatgagagccatagtttgaacaggaggaagcatatgctgtcactgcagagctgccttctcagagaaagcctgagcaggagcctgagaataaaacagtgcaagtgcgggaaagctgcaggtgccgaaatacaaatgaacgtgggtagaataacagcattcacttgcccgtgatgttaaaacactggccttcacggcgtgtcagcttgtttgagcaccttagctgttcagtaaatctggttaacactgatcaaccttaggcgttgtgttacttttagtcaaaggtgactttgaagtgcgttatataaggagaaactgtggaagagaggcctagcagaggaggaaatgcagacgtaaagaactttctcttttccattgcttcctcagatcctctgtcgatgggtcctcagaaagctctggaaaccatcggtgcaaatttacagaagcagtacgagaactggcagccaagggtaagtgtgcttcacttgctcttccctttccttcttacagggaaactccagttccttggtttccaacactctttggatccaagtgagaattctgtgcacaccctgcccttgtgtggcatggcgcctgcgcactgcgtttcgtgtgcctgcgttctgcctgctggctattggtggctgtgttgtcttgacagcgtccgcattattgtgagtcttgcattggacagtccaacttattttgcttaagtttgttccagatttttagaaaagaaaaagtattcttttcgctcttaaccatggttttaatttttctcaggaaatgtattttcgataatttttctgcaaccttaactagttaacgctattccgcgtgtcttcagttttcacatagttgagaaaaaaacacccaacagtcaaaagataacacttattatatgctttgcctttgattcaaaagataaggttctttttagggagccagttaccaattagtgtgtgggttttttttttttttttttttggcttatatcttacagttttttgtttgtttgtttaaagaaaagtggcttagaatataactgtgtcaaattgcctttaagatcttaagttacttgtaatccacccaaagacctttagcctttcttattaactggtttggagatttaataaatttaataaaaaactaagaatctgggcacttatggaagtgccctatattcagctttgcatgatagatggactcgagttacctaaaggaaataatgaagaatgcaggttgagaaggtgcgcgtctcctgcaagttttactctccccttttggatgaaagcctcatgaaaacacatgatttatggaaccttttgaacacttatttggttggaattttgatttgtggatcatttatccacatgatgtgggatttagagattccttatacattatttacattcttagagtaagagaacagccaaaaatgaattttttcctgcctttaaaaatgcccttaggtcatttctgctgttgcttccagtcgtgagctaattgttaggaagcatctctgtgtcttagggtgtacctttgtgcttgcattgccaacttgtcaagtcaataacagcagacttttgttctttagaaggcagtggcttcatgggttcttgactgatgcctaatggcttgactttttcctctcttaaattggttgcctcttgatggtttgtgtacacatgctgtagcctttttcttgagggcgcagtgcgtttggggatggcatgaggactggagagagatttggatggtggagtcctgtaaaaatgtagtcgagatgcctcgtgttttccatagataatagcttctttgaagactttgaaggtaccctagggtctcagcatggtgagacgggcacttacaggagtgtggggcagagtggcagtattagaagacatggccgtgttggcacatggcatgtcgttaaccaacactatgggaattcagaggaatgcctttctggctacttctggccatctcctgggtttggctttgtacctttgcgttttactagatacctttgtttaaaaaagaatgtaacccaataaattcagatctaccaattgtgttctttctagaatgagtctctgctactaaaactagtttcttcttttccaagaattattagataaggaaatatagcctttcagaatacatgtgtttaatatttcaagatattgtatgtgtattccatttgctctgatttacaattgttttttttgagtgctaagagttgatttactgctggctttattattagtttcgcttggtagatatcagctagtcgatgctagctgacaggaaatggaatcttctaaagtggcatctgttatttttaatctaaatttctgtctacgagcagatctctccatggcattgagaagcggcatcatgatgtagggaaggtgacctttacatgtaggtcagtgatgacagccagaaagatgacagtgtagactcagtacaggatggaggattccctgcccatgacagtggcacagttgtattcggacagcgagcacaggtgcaaaggggtgcagtcctctgaatgatctgtagtctgggaaaatttgttaaagttggccagatttcaagaatggatgtgcaaaataattctctgagtaagagatcgtttgaagggctggtgagatggagaatgtgttaagattacaggatgcttcggaaaaggtaccagcgcaggcgggatcccatctgggctggtttataaagtggaatctggaataaagtatccgctgcagcctagaaggaagctgttcttgcacacagagtgggatcttttgtccccattcaggaagcaaaaccacaacaatggacacctaatatttgcttttcgaatgccaacaccattgcattcattttttagtacaataaaaatgtttaaaaatttcctgctactatccatgagcgggcctcatctattttagaaattagcctaaggtaacggatgtcacaggatacctctgaccggctcccaggtgtgagcgtggggctgtgccatatgcactgggtaataatagcacttgccccggtgcgcgtggcacactgctcctcacagctttccgtgggttacaggacagagggagggaggcctggcatagatagcgtggctctcagtgtggggcagacctcatgctgccttctagagtttgcatgaaacaggaggcacttagcaaactcagatgtttgtgtgcaaggggcctggttcctgactgtaaatcagggtcctttgaaacattgcaaggctaaacacgcaccacttgattgcactctacagggctcttgagtttctgcagtaataaagagaggttgatgtgccatctgcaataaaacaatgggggcgttattaaatttcccagaccttcagtggaaagacccatatatctggttttctctttctctgtgtctttattgcaagagtggaaaaccttgggtcatttaatgaaaatgagattattttcattaaagtttgtcggagtcgttgcctccacgctggcatggatgggagcagagtaggaaatgcctgttttctcaacggtagcgtccatccaggaggtgcagaaagccaaccccggaacccccgtcggctgcaccagaatggtgtctggaagcctctgatgatttccttgctggtgctggaacgcttggacttgttcttcatttttctagcttttgatataggtgattccagttcaaaaggaattgagagaaaccatggtgattatatttttttctgaaggctgccagccactatctggcccgtatttccttgcttaggcccattgagcccctttctaaataatttatcagtttgccactgatgaaatgtttcttctgattaaatttaaggctttgccttattaccttgtaggtgtataaatttgtgttctgccagagattggaggaaaatgccgaccgttgtttcagtggaaaattctgcagtaaaacctcactcattccatcataagtctcaaatgaaagttttattgggaaatgggagtaggagattattataaagctgggaccatacagtgaagaatttatctttttagagaatttttctaacaaattggggctactggcagtttagtacaggatggaagttaggagctggagcctgtggaaaaagacaagcaggaggggcctcgctctctgtgtccttctttccccagagagagtggacaacaccagaagcagaggccacacctctttacttggggtgagctttaattcttctggtgccttaaaaataagtttctatgggaatatctatcatttactaaggaagatgaaacagcatggcggtgcctccactgaccaagtctgtccgtcgggcaggtgtgtctaggggaggaggcggaaggcgctcctcagtcatggagccacgttgttgtaggagctcattctcatcttgtccaggtctgcgagtagtgaaggcagcaagtcctgtgtggcggccgtggggcttccagggagctgagcggtcaggttgagtcagtttccatgtggtggacagttcttacttatccatgcacagccctggtttgtggattacagtgaacagattttgaatgtcagcttcccttcagttcaccgtgcttctcagatgtgtcacagttaatttgtggttaagggatgaaagttggttttaccattagataaacatgttttttatagtgcctaaccccaagcagagtatgttcaaggagagaacaaaacagctcccaagatctggtccattagcccagtagaaattgttattgcattttaatgtaaatgacagtcatcctttcgtggtattgataatagagttgtttgtgtgcttttatgagatgctttgaatgaaccgaagctgatgactatacctcctgttgggaggagggggtttggggagcaagggggttgagaaggccagtggtgggcagttttggttctacttaacaggtgtgtcttttggattttaggcacaagtgttatttgcagaactgaatgtttatgtgtaattccatgttgttgaggggtttggagtgaggataattggaatccaggcgtcttctccttgtccctgaatggggctgctgcttgacctgtccacctcacagggagtgtcatgtggccatgtgtgacaaactgtgaaacccttggtattgagtgctcacactgctaggtgtggtgggaggcgcctagtcaggcagccgggttggctttgaggagcactgcatggatggcttctaagatccacttgtcttctttcccctgggatgattagacaggcctctgctttgtgggcaaagcaattggtatcagcacaagtcactcgcttccttgtgccccccacccccaaatgttttggaatgaattttatagatggatgctgatatggcttggctgtgtccccacccagatctcatcttgaattgtcactcccacaattcccacgtgccatagggggaacccagtgggaggtaatcgaatcataggggcgggtctttcctgtgctgttgtccgtagtgaacaagtctcacgtccctgcacgagctctctcttgcctgccaccatccatgtaagatgtgacttgcgcctccttaccttccgccatgattgtgagaccttcacagccatgtggaactataagtctattaaacctctttcttttgtaaattgcccagtcttggttatgtctttatcagcagcatgaaaatgggctaatacagatgcagtcaagacgcataaatcagtgggttctaccttttcttaggattttcaggctcagatatggataatcggggaagaagcagctaagttgccctaggacagtactccacacctggaggtgctccaaagctattcatggaacagcccaaggtggaccgttactcgctgtgactcctgcttggggcattcacgttgcgacattagttccaaattgacagtccagttcagctggtgaaaatggccctataattgcgattggcagcatcccttggcgtgcggccctgatgccattaccattccatcatccatcccgtcttgctgtctgccctgccgccagccctccctcctcctgcccaaactcacctgactttcttctctgtgggtcctaaggttgggcttcatccaccttgagtttctgtgacaagctgccagtgaggactcatgggcaaaggcagaactgtgggtggatggctcacagcttgcataattcagtacctggtgtgaagcactttgcctgtgtactcattaaatttgcaggacggtacagacaatatcttctggtggtcttggggttaactgtggtgctttgacagtttcacttaactgcttactgcccagaaagttaagaactgttcctatgatcaatgtttttacttatatttttgccttggcctcagcagtgctctcccacttcgtcttccctcctttctagtgcttctcgcctgaaagcttttccacgtgcgtgccgtgttcagtgagaactctgattcatgctcttcagccagaagccttcgtagtcagccctgcccacgcacttcctgccttgccctgtccccagaggccatggtattggaagcagcttcctggaagcaagcttagattatgcgaagcagtttattccggactctttagaccaattgcaccagagcataaaggtgttgtcacctactgctatccctccgaataccttagtgacatgacctataaattcttttaggcacaccaaagacattacagaaagaagaatgaaagaaaggcatggttctgcagcctcctggaggatggcagcctgttgtgactagactcctcagggtttcagtccattagagctggtcccagaggggacccctgctggccagccctgtgttggactcttgctctccgaggccacctaggggattcactagagagcccatttgggattgaagagcacgcgtgttgactagagtgggttgcagcatgggccgcagcctgtttaaacactgcctagggaagattggtggagtccgcctcctcccttctgcctcgtaggtccgcagagtcgtgctgggctcaccgctccttccctttctgggcgggagcgcccctctcactggtaggggagctccctgggaaatgtggtctcctttctaccagtgcactgaggggtggggtggggagagcttaactgtggaaagaatgcgaactggtttagttctggctttgccacttcttagaaatgtaactctggacaaattactatttaaacttttaaaatttgtacatgcaaatgagagttaatggacagaataaaagtatataaagcatttgcaccagggaggccatggtggttggtcatcagatccttacttcccatccctttctgtcccttatcccttcctctccctcatggttgaggtggtggaggcccctcccagaacattctgcccaggagtcttgctgccttaagcccctccccatcctgccttatctctggttttatcctcttgcggggataactgcattcctgactcttcctctattaattgacctacttgaagtgtaatacttttagagagaagtaggggcttaactctgtccttaacaggcctctcgaggatattatctctcatcatcatgttccctttaacaagggagttgtctgtgtgtatgacaaattgcaaatgaggaccccccaccgtcaggctggggactaaaactgtagctcagctgttgtcgtttcacagatctcacgtgccatgtgtgtttcctgagttaacttggggaccgtgatacagagcgatgcggagatggctctgaaggacaggcaggtgccaggcgagggatggaagtgctgcttctaagtcagaaagtggaaggtgtgatgtgttaaagaatggaaagctaaatttggaggtgacgatgaggaacccaccgtatgctcgccatatgcaactaggaagagttgtaaaatcctgctccagccaaattggaaagtgctgatcaagggggaaacgatcaataacagattggagggggacggccacttcaaagtgtctgcggtacttgatttcattttgcaggggaaaccatatgtcacagtggtgttcatgaatttgggtgttcacaagggcttctgtacagctccctcccaaatgtccgcgatttacttgttggtatgacacataatggagatttttttaaaatggacatacgaagcacataacgtcaagttcaccattttaaagtgtacaacttggctgggcgcagtggctcgcgcctgtaatcctagcactttgggaggccgaggtgggcagatcacctgaggtcaagagttggagaccagcctggccaacatggtgaaaccttgtctctactaaaaatatttaaaaaatggccaggcacggtggctcacgcctgtaatcccagcactttgggaggccgaggcgggtggatcgtgaggtcaggagatcgagaccatggtgaaaccctgtctctactaaaaatacaaaaaattagccgggcgcagtggcaggtgcctactgtagtcccagttactcaggaggctgaggcaggagaatggcatgaacccgggaggtggagcttgcagtgagccgagatcacgccactgcactccagcctggggcgacagcgtgagactccgtctcaaaaaaaaaaaattagctgggcgtggtggcgggtgcctgtagtcccagctattccggaggctgaggtaagagaatcgcttgaacctgggaggtggaggttgtagtaagccgagatcacgccactgcactccagcctgggtgacagagcgagactccatcttaaaaaaaaaaaaaaaaagtgtacaactcaattggcttttaacatctttgcaatcttgtgcaactgtcataactgtcataactgtctagttccagaacacttttcttaccccaaagggaaacccaaagcccatcggcagtcatttcccctcccccaggcccaggcagtcaccagcctgccttctgtctctggagatgcctgttctaggtactccacacaaatggagccatacagtatgtggccttttgcgtctgggctctttccttagcatctggaatgttttcaagattcctccatgctattgcatgtatcagtaatttaatccttcttgtgtgtgcatgtgtagagatagggtctcgctttattgctcaggctggtcttgaacccctggcttcaagtgatcatcctgcttcagcctcaactctttctatagctgaaaaacattccattgtatggctagtctacatttctattttatgggttcatctgttgatggacactttcatggtttccaccttttagctatttgaataatgccgctatgaatatgtgcatgctagtgtttgtgtgggcccctgcccactagtggggttgctgggtcatatggtgaccctgtattttacctccctgaggcactcccaatctattttccacagtggctgtactatttgtccatgtctactagcagtgtatgagggctccagtctctccacatcctggccaacatttgtcactttctgtattcttacattgttattattatgatagtcctagtgggtatgaagtggaatctcatcgtggttttggttttcatttccctgatgattagtgatgttgccatcttttcatgtgcttattggccatttggaggagtctctattcaagtcctttgtccattttttagttgggttgtttgtctttattgttgagttctatgagttcaaaatggagacttttaagttgaataaggtataatttctgttgtgaggacttgtttcctttccaaataatatgtgtggtgtctgctgagagcctcatggtaacatttaattcttaaaagagcctttgtcttgatagattggtttcataaaactattaagaggttcagccaggcaccgtggctcatgcccgtgggaggccaagacaggaggatcctttgagctcaggagttggagaccagcctgggcaacatagtgagaccttgtctctaattaaaaaaagaaaagaggttctttgactattgactatactgatcatatatatactgtataatttaataccaatcccttaagattcctgtgtgtttttgttaggagtcttttggttttcttagagctgtggtctctccacctggagtgtatgtcgggagaaagctcctgtcggggtgagtgcaggcagagtggccgaggagctgggcctctgtgaagtctgggtgcagcttggaggctcatagtggactgggagcttggcaggaggggcggtgcatgtccacaccagtgcccggtctccgccgtgctgcggccctgtgggtctctgctccccactcagcagttacgctgcaggacgttccttcccctccctgtgtgtgagggctgggtccttcctttctgatgtagtcatctttgatgggactccatctgcttgggcccaggggtccccacaggagccagctgtgttcacatcctagtggtccctggtcctaaaccacctcctgactttcctctgttgcttcagcttcagctctctgcccactgcattgtgtcgctggattttcaagattaaatcccccccacaagagtgtttgatgcttccctggatggccaggctgtacggccagtgttaaaagacagacaagtgccacccaggggcaagggagtgtgtggttcaaagtccctgagaacagatgccagatgccaggctcaggtggtgccgtttacttccagcaagaggagagagagggtgcacttgatccagtgccgggtgatggtggcccctaggccagggggtcgcaccctcactttgggctacagtagaaggagattcccccaccccgtggggtcttaaacacagaaaactgggggcatgcctgagggccactgatgcaggtgctaaggcacaacagaggagccatggaggcagaaatcgggaaagacccctcccaggtgagggctgcacgggctgtggtgagggtgctcccctcggtgggctctcggcccagcacgtggaagacggcgcagtccactgccttcccaacccagagaggccgatcagctccgcttagcttcatgtggtcctccgtgtaactggcccatctgtgggttggttctgagggagtgaggctgccctctagaatcacctgtgactggagggctgggtggcaggatttaaagcgcatagcagaaccgggaggattacccatggcttgtataaggaagagtctcttctaaagggttgcatgtgtgacaggctccttaatcaacatgctgcttaccccggactggaacatgccctgaagtcaagtcatttttgtgtagaatttttaattataagttttatttttataaacaaaaatcttagctgaagtccaataaaatccaagaagaaggcacagataatcagggagaagtaactcaagatttgaggaaatcaagagtcataaaagagtgctttgcaaaactttgcagataaattggaaaacttgtatgcgatgcataattttctaggaaaatataaatgaccataattgacctcagaaaagatagtaaagaaaaataaatggataaacatagaagaaagagaaagttaccaaaccattcctcttctaatcctcctccctctgaaggatttcaaacttgaaaagaacacaaaattattgaagacttctttctgttgtaggaagatctctaaaacatagtttctttatctattaatttagagacagagccttgctctgccatccaggctggagtgcagtggcatgatgttggctcactgcagcctccatctcctgggcccaagtgattctcctgcctcagcctcccgaatagctgggactacaggcacatgccaccacacctggctaatttttgtatttttagtggagacagggtttcactatgttggccaggctggcctcaaagtcctgacctcaagtgatctgcctgccttggcctcccaaagtgctgggattataggtatgagccatattttttgttttttttaaatttatttttattgatttgtttttatatttttagaggggtcttgctttgttgcccaggctagagttcagtgatgcagtcatagcttactgcagcctcaacctcctgggctcacgctatcctcttgccatatccttttgagtagctgggactacagatgtgtgccaccatgcccagctaatttttaatttttttttttttttttgtagaggtggtgtcttgctttgtcactcaggctggagtgcggtggtgtgatcatggctcattaacctcgaattcctgggctgaagtgatcctcctgcctcagcctcaggagtatgtaggactacaggtgtgagccacagtgccagcttaaaatacgtcaaatttaaaatgcaaaagaagaaagtgtattcaacaggtttagtgtatgcacatatgactgatggagtcagccgttcctgcttgtcatatgtaatgtgtgtagctgggtgtggcatatgtgtacatgggtgggtagatccctagatagatggagggcaagtcggtggatctgcccctcctccactcactcagatgccttagagtgaacacggaagggagacatcagcctgtggcctccttagtcgttctcattttccttcgcctcttggtgtcttgctgtgttgactgattctagttttgaaagcagcatattgggtcaaaatacatttttttttctttgagacagagtcttgctctgtcacccaggctggggtgcagtagcgcaatctcggctcaccgcaacctctgcctcccaggttgaagcgattctcctgtctcagcctcccgagtagctgagattacaggcatgtgccaccacacccggctaatttttgtatttttagcagagatggagtttcaccatgttggtcaggctggtctcaaactccttgtaggtgagccacccgccttggcctcccaaagtgctgggattacaggtgtgagtcaacacgcccggcctcagaatacattttaaatcaggtctgtactgacttcagaatctaactccagaataaaatttgattctaaggggcaacagtaccacaaatgaggcgaagcacagaacatctgtcaccgtgacttggggcagatgcagaatgggactttcacctttttacacaaaacccttctatgtgccttctgttttaaaaccatgattttttttactttaataataggcaactaatttaaaatacctattcaccatgtgtcatctcagagtaggaaggggactgtgaggcagacggagccacttgggacttttgcctttgggttgtgacatttgtctgtaggttctttcacttctgtccatctcatttgtttctgtgccatgcgtgtgacatgatgagctggaaagactttgcatggggcccacgtgagtgctcacatcgaaggggcaagtgttaatcaccctctagttgacagagctgtttcagggatggctagttcctctgtccggaacacttgtattgagtggcagggagccgcggggacactgcccatagcggtgggagagcaagcaggaggggctctgcccagggctgtttcctttgcctttgtttaccagcataaagtattaaaacagctaaattatcatgggcattttaatccaatttctcagcgtttcgtcatttgaagaatagaagtctctttgttttcacagccctgttcttgcttgtttaaatttgaatatatttctattcattcagctgatagaaattctttacttttaaactgagggagaaaaaagaacagattgactagggatcagaatgtgatttcagtgggtctttattgggcccttgttagggaggggtttggacctggggacttggagtctacactgatggcagaagcaagctccagaaaagagcaggctccagctttgcaaggtaaaccttggagagtgtagttagggtgacagccagcacctctccctgctgagtggagagggaatccagatttttaggatcttataacctgatatttttcatgcctttgactcctgtcttggtctgttaggtcttggcttttgatagccaaagtaaccagctgactttccttctttttttttgaaatctcctttactttttcacaaggctgtttctcagtgtgaatatgttgctttcatattcccagagcactcactgaatgcataaaggctaagcaatgcagcagtgatactactaaccagctcttagtttactgggtgacctttggctggttctgtcgagtggccactctacctccagtttgccctgtctggagatgcagccaggactgtagattcccaggggagggctgacttactggggcatttatttactggataggggagtttttaatcttttagttggaatatttagtccatttacatttaatgtagttattgatacactgtgtatctggggttaaatccaccaccctcctatttattttagttttgtctcacctgttctttattttttctcttttcttgatttcttttgcattaagcagtttaaaaaattattccattttctccttctattagtgatgtatcagagaatacataagctacatatttgtttcgtggtaaccctaataaattactacatacccttactgtgagaagtgttgaagttagcacttgcaccacttggccagacagtgcaagaatcttgatgcatttaaccctcctacccacccccctttactttgcatggtgtcaacatcatggggttggagtttctatgtggattttaaaccccacagtatacagtcaatatttatttagatttatctgcttctttacacttattaatgttctttattctttcctgcatttctgtccttctgttcagggtcatgtttcttcaacctgaaaaacatcctttaatatttcttttagggtgaggctgccaacaacaatttagtttctgcatattttacctctatttcatttttgaaggatatttttgctgtgtgtagaattctatgtcaacttttttttaagtttaaaggtgtttttcccttcatctcctttctgttaaaacgtcacactgactgtaagtcttaatattggtgctttgaaagttccctccccgcacccccctgtccagctgatttggtttgtattactttacggagatgttcttagctgtggactacttcatatgtatcctttttggtgctccttgaacctgtggcttgatgtttctaagtactatcacttaagacactggttctctgccattctgtctcccctgctgacgctcattggaataggttagaccttttcaccatgtcctgtacatttctcatgttctgttccgagtttttttcttgctgtaggtcactgatcctctcctttgctgtggggcacagtctgctgtttagccaacctaccaaattcttgattccattgtatttttctattctgtgatttccattcgattctttatcaattccagttctctggtgaaaattttcaccttgttatctcttttcttgtacacatcagctttcagttctagccctccttacatcaacatctttgaaatggggggtgtgtgttgccatcagtctgactgctgctgatggcctggactcagctgttgctgtcagcacagtgtggacttgagggcatgactagacagaggccagtatttgtgccgagagccacagggctcacccgtggagggaatctgagtcccgattgtggaatggtggtggcagcatcacgtcctgcaggctggagcccatgagtggtccccgagagattgcctccgagcgctgttaggagagggaagagctgcactcatgcacacagggtgaccctgggtgaaatgtaggctccatggctccgagggggaagtgggctcagaagagtgggcttctgatctgaatccaagaagggttaggaataccttagccagtttctgtggctgctttttttcttttgaaacaggctctcgctctgtcacccaggctggggtgcagtggtgcaatcacgggtcaccgcagcctcgacctcctgggctcaagtgatcctcccacctcagcctcctgagtagctgggactacaggtatgcgacaccatacctggctaatttttatttttatttatttattttttttcagttggagtttctctctgtcgccaggctggatacagtggcacgatcttggctcactgcaacctctgccacctgggtttaagcaattctcctgcctcagcctcccaagtagctgggactacgggcacgcaccaccacactcggctaatttctgtatttttagtagagatgcggtttcaccatgttggccaggctggtctcaacctcttgacctcgtgatccgccccttggtctcccaaagtgctgagatacaggcgtgagccactgcgcccggaccatctggctaatttaaaaaatttttttgtagagataaggtcttgctctgttgctcaggctggtctcaaactccagggcttaagcaatcctcctgccttggcctcccaaagtgctgggatttgagcatgaaccaccgtgcctggcctgcaggtaatattcttttgtgtatatataagaatttaaatgaggccgggcgtggtggctcatgcctgtaatcccagcactttgggaagccgaggtgggcggatcatctgaggtcaggagttcgagaccagtctggccaacgtggtgaaaccctgtctctactaaaaatgcaaaaattagctgggcatggtggtgggcgcctgtaatcccagttactcaggaggctgaggtaggagaattgcttgaacccaggagatggaggttgcagtgagccgagatcgcaccactgcactccagcctgggcggcagagcgagactgtgtctcaaaaaaaaaaaaaaaaagaatgataaatgagaaacatgtctgagtaagttgataatagctcttcttactaagtatcagataaaaattccaaagagaaagtgttgtgtcgtgtcatgtcatagtttaattggcagttttttccttagtgacatagaagacagtgatggatcgtacaacctttggcaccttagagtttatgaaaaagtagcatctgttctatagaaattatagccacactctgaggagcagagttggggacaagagtggaaggaagagtctgatggtgacacggtctcctgcaggtcttcccagagccccattcaccacccatgatcactccctgccccgtttcccattttctttatattctacccttttgcggcaagggactaacaagggccatgcatgcctggcaacacaggcggtcccatccttcgctcaagccctaagtgacccctgctggccgcactcaatggtaactgactgctggaaggatggtcagccactgtccccaatgcaggcagccccttggtccccccattcccatcgttccccaccccatctccccacccttctctcagcaggagcctcccccataccaccccaagtcagcttcctaaaatgccctgtggctctggctcacctgctggaaacaaggcaaggtcaaggtcaagctccaacccccacccccagcccagctgcccttgggggttttcctctccctctgctgcgtttccttatcttgggcctgcacatctttctcgggctctttttcttctttgtctaagtcttactgccgacctaccacacttaaggttctcttctgctgccatcttctgtcggccctggcccctgagcacgggaccaggattggaagtggcaggggttgagggagttgagttagggtgtaagcgtggctgacttggtgaaatcttaagatttgggggagatctgaagtgccttgctctcaatgtcagtattgattgtggatgggttaggaggaggagaaaaattccaagtctcagcacaaggcgggtggctgtgaggagcagatgcagttcactattgcagagtcggagccggagaggcagaggtggaggccgctgacgccaggccagctctctaggtctcagcagaggagtcgcgcgggagccccaggactcactctccttgctcctagcaggcctcaactaacaacccttctccaccacggtgttgagccgttgatgggggtgatatgagcttgtagatgagttggggagacctggtgttttgcacccgtggcagtggcacgcttcttgggctgttctgctctgctttttatgtccgccgataaggtcggagagtctctccccggcgctcctatgcacatcttgttaagtttcttcttagagcttctgttgctgctgggaaagggatcccccaccaccccccgccccctttcttagtgggttcttaggatggcgcatgagagagttgctctttattgcctcctggttctcccagtatgggtttttatccatccagtggttccaagacagtggctgtgatgaacggagttgccgcgagtctcgtggcatttggaccctgcaccgctcgagattcactgcgctgcacaccagggcctcggtaattcagtcaaaacaacagatttagaggtgtacagaaagggccattctattttccattttgtatatttcatgtctctttaaatctcttaaagcttagaacacccgtttttcatatgcctttctaaaaacttttttccaggcgatttttagatgctatttatgtgtagtaaaatgcgtagatcttgagtgtttagtctgatgagttttgacagttgtatcctcctgcttaatcacactcaaagcaagatggagatcatttccactccccagaaagctccctcagccccctttccagtcagtttctcctggccgaggccagccgccttctgcctcctatcaccagaggctagttttgcccatggaactgaacgccccgatgagttcgtcttgtctgctgcacagacaaaaccaattcacggaggctgcaatattgtagtaaagaaagaatttaactcaaagccttgcaggtggaaggacgggagttttattattactcaaatcagcccctctgagaactcagagactagggtttttatggataatttggtgggcggggctagggagtgggtgctgctgattggttggggggtgaagtcatggggtggggaaaatggtcttctgcactgagtctgcctctgggtggggccacaggatgggtccaggtggggtcagttggttgccagaacgcaaaactctgaaaaacatctccagtcttaggttttgtaatgtgttgttttctacaggagcaattggggaagtcgcaaattttataacctggccacgactcccgagcagcaaggaattatagaaaggcaagctagggatgatggctgggtatcattagtgacatctacatcttagcagaattcaggcccctcacataatcctaatctcatggcctttcatagtcttacaaaggtggtttcagtccctgaaccaggaggggaccagttttagggagggactgttatcatccttgctttaaagttcaactgcaaactaaattcctcccatggttagctgtgcctgcatccgggaatgggtgagggcagccgcctgtgaggttaggagggaggtggaatcagccttgccaaccttttctccctgtcataatcttgcccaggtggcctcacttattttttacctttttctacagtgaccacatgtgatgtattcttttgctcttgcgtttggcctcgttcactcagggtgaggcttctgagactcgtccgggcggcagctcattgctgggtgtcccggagcctgcacatccacgcagggtgcatccaccctccctctcccacaggttcacgctgcacctgtttccagtgactggcttttagggataaagctgccatgagtgttggggtgcaagtcttgtgtggaccatatatttttatttctcttgagtgtatgggattgcaggtcattgggtggttgtatgtttccagttacattttgcaagccactctaaattgacaaaaatgacaaaaatcatctctttctttgcaaagccaggcaatctgcagaggaatctttatttacagtttcctccagcactctggagacatggaagcgtaggcatcagtgagctgggaggtatttggttgtctttgaatgaattattaggtgagatattgacattatttcccctcaaacagtccacattcctgaatggcagggagtgaaggcagcctgtgcttatgtttgtgcttattatggagtgtgcacgtggatctatttaccgtgtggaaaataatagaatgaattgcttttacacattactgggcttaagaaatggaaggtgacatagcctttgaaaccccctctgagcccctccccagtcacagtcccctctgtcttcctgagctcaccctgtcctgattgggccttgtgccttcctctgcttgagactggttctgtgcgtgtgcgtgtgtgcaagcaggtgtgtgcgcaagatgggctggcctgccctgctttggcacggaagcatcctccgctgggtgtttgttctgaggctcatctcacaaggatctgggtcctcaggctcccactgctctgcatcttccccgtgacagccgcgtgggcatttgctcttgaccctgtggtggctgagacagaaaccttggaggagtcactcacttctgttggagcaaaatgcaggcctcctccagggctgcgtctgggagggacttgggtggtggagtgtttatgacttagcgcagagggctcttacgtgcaaaccatcttggctgtggagcgccctgttgcctggaaggtctgccttctcatgggggctgggcttccagactcctgaaatgtgctgtgaggcttcctattctttcttaatgattaaaaatacgatttcttctttaatgcccagcacaaatgcatttagctgtgtttatttttttccctaagtaacagaagcaatcctgagaaaataattcttacactcagtattgattctctgcttcatgtgctagggtgttccccctcccactgaagttgctgctgcttcaccctctcctcctcgatggcctaccatcctgcagcctcgctccctgcgcctgcccccttctccttctcctccttcccctttcggtgcttgctcttccctcctttccttcttctcttcctcaccccactcttcccccttttctcctcctgcctctctttccacctcctcctccgtccctgctggtctcctaagaagcacttagtagcactcagaatccttgaccttggcaggcttgggaagtgttggttaatgaagggatgtgaagacgaagggagtctgagtctccaaaggaatcatggctgttgggagtttgcttgattaggagatgggccgtttattacaatgtgagttgttaactctaaagtgcctgagataaatttatagtgtttatttgcttcagaaggagttggattttttcttacaaagtgaaatatacttttctaaattttatgtttatataaacataatttatgttgttatagttttaatctgcattactcctcaaaaggaacaaaaatgttttggcttttttctccctgagctgcagagacctttttctcctgcttctgtcctctgtattctccccacccctttctccctcctttcttccctctttttaatctgtcaattaaaatatttgaaaggatatcactgagatctttgggcaaggactttacctgtttttgctgttgtcaaccgagggtgcggtggctcctcccacctgctgtctctggtttttactgggcttcctctccattatcctaattaggtggtttgccggttgttacacatcaaagacctgagtttcctggcgaggagggagggaggcatgggagcccctcattaccggcgtgcatcctaaccacactgcttgttttcttcttgagaaaatttttttcttttcttttccctttcctttcctttcctttcctttcctttcctttcctttcctttcctttcctttcctttcctttcctttcctttccttttcatgtcctttcctttccttttcctttcccctttccttttcctttcccctttcctttcctgacagagtctcgttctgtcacccaggctggagtgcagtggcgtgatctcggctcactgcaacctccgcctcccaggttcacgccattctcctacctcagcctcccgagtagctgggactacaggcgcccgccaccatgcccggctaatttttttgtatttttagtagagatggggtttcaccgtgttagccaggatggtctcgatctcctgacctcgtgatccgcccactttggcctcccacagctgggattacaggcgtgagccaccgcgcccggccccccaaaaatttttctttagaaatgatataaagtatgaagaactcttggaagatcttcgtcggaaagatgaaggaagtcttgtttgtctcgtaaccctggaggccactgagtatctctccctcccatctgcctgtgcccgtgtatcctgcgtctgttgtgaaatgtttaccatgccttgactgggacttgtgggctgagcagggaggacaaacgttttatttttagtgactgtccctcaaagagctatactttcgatgcctttcaatatgaaatagtaaaaatcttgccatttgatattacctaaaatattactcttctccaaagttggtttgccaaaataaattatgtttattatctactctttctccttgatattatctaaaatattattcttctccaaagttggtttgccaaaataaattacgtttattatctactctttcttcttgctatgagtttaagaagactcttgttccctctccctcgatcaagcctgctgcagacacagaagatggagactagaagaagtgctaggacaagctaccgctgtcttcagggtgaccctgaagagttaggtccttgccgtgagtataggtgaggccgaaacaagtgacccggaatctaatcacagcctgggcagagtgtaggaagggcgcaaggatgaaaatgactgcttggttggacgcagcaaaatgttgattattggccatatatgcgtcactttgctagttgctgtggatataacaataagtgatacctcctactggcaaagaattctaagtctgatagggaaaataaacatcattcattcattcattcagcaaatgtttattgggattccactgtgcttcagcctctgtgagcagcgcccaacattgcccctgctgtagtggtgcagagcctcgtggggagatgggtggccgagcagtccgagaacccacctaaggagtggatggtaaactgaggcagcgccttgaaaggaagaatgctgtctgtgaagggtgatggcgagttctcttgaccagaagccatgcgaattactgcccgtgtcctctgatcgagccttctaggccactaccgtatcctcagagaaggctttatagtccagccaacagcactccaggaattgtctactcaaggaatgcagtaggtggcacttgttgagtgcattctgtgtgattaggacactgattcatcagggcctggattttcccaataaccccgggaggaaggcgttcccgtctccacgtccctttcccagcgtgccagtgctgatggtaggttctgctggatccctgccccggtgcatgttgatctttccagtacagcttgttgccccccagggaggcagggaagtaagtccataccacattggaagagttagacgggtcttggagaggctggagggggacagccgggggaagctccatagaggtggtgacgtctgagctgggagcgaagggagaccagggctgggcaaggtgggcaaagtgtgagcagacattccagtggaagccagaggagcaggctggactctgcatttgttcctactggaataaggaacaggtgtttgagtggatacagaataaggacttgatcgccttccttgctgacaagtgcatcgtgaggtgctcttttttctactcatcccactttcgaagtttctttttcttgactattttgacttaagatgcccagagttaataaagttgcataacttatcttcccatttaaaagatgtcagtggaagtcatagcaaatagtaagcccttcgcacccatgacctttgtttagctgagtctcttgggacaaagataacaagttgttgacacacgggagagaatgttagtattctttgtggtttcatgggacaaatatggaggctccttcatttgcttgatactaactgcagtttggacttaagcctgcagaggtgattggaaagattttcagtgaaatgagtggtgtaattgtgattgtgataatgcaggtgactgcttttcattcattcggttcccaccggcagcctggcatttagaaaaaagttaacctttctgtgaaatcattttagtgggaaaatccacaagggtctgccattctgtcagcaacaaaaatgccgtgggcagaacgaccttcagatgggattctggaaccacagggggtttaatgcaaacagatgacatggaagctgcacagaggaaacgtctggtttcaggcgcgggcatctaacctgccctgttcttcagtgcaggtttcagataccacagcagtaaacacatttcccttagtgtagcaggcctgaggggtagcggagaggcaggttgggcctccactagacaaagtttatcctagtgagttcttttgggttcaacttgtcaaggagggtggctactgggaggttgcctgataatctccaagtttcttccatctccatccatttttactcattactagcctttataaagtacagagtgagataattttcatcatgttcctaggctggcaggcctgggttctaagtattacttgaggtcatagagcaggcttgtgttctttgtagaaaggcctttgataggtggccgcaggaggtcttcgcgccctgtcccctcagcatgcacttgttctcccagagtcggccatggccattcttccaggcttctggagaaaggacctcctcacaagcagacagcaaaataaaacaatgaccagtgtcagagaagatgacacccccgtctcccatgtttgcacgcctcagcagttctcagccgtatgcctatgcttttacaagtgaaaaccagctctttaggtcacttgcgtcacagggatctcctcttttctgtccagctacctggcagtcattattcctcattgtttattgttagaaaccttttgttcagcagagcggctgccccagggatcacaggcagagcgggtcctgctggagtttagtctcaggacagcggcttgtccgcattcgggtttgagcatgagaatgttgttcccatgatttcagagaagaacaactgttttaaaggtcagattttattctgtccagtattctgtaaaggacgagttgaatatcaatgaaagaaagagctttagtagctgtggcagtgctgtgggtctgctgcctcccggtgcttctcacaccacagaggctggagagccaggtgcccctgcagccagggctttgctcggggacacgcttgccggaggccaggctaccctaagtgtgcaccgagggaggtggtgggacctgcccgttctgctggctcagcaggagcagccaggggctgggggcttctggggctttctagggcgtgggaatgtgggtagggggcatttcccagctgctgcacaggccactggtcctggcctgccttccctgaaagctgagtccaaattcttcttctcttgcccttgcacggaatctgtaagtcacagaacacccggagtgctgcccttgctgcattaatagcaccagtggtttctggggaacttccctgacctcatccctgttgcatacagtagttcattctttcttttttttgagatggagtttcactcttgtcgcccaggctggagtgcagtggcgcgatctcagctcaccgcaacctccgcctcccaggttcaagcgattctcctgcctcagcctcccgggtagctgggattacaggcgtgcgccaccatgcccggctaattttgtatttttaatagagatggggtttttccatgttggtcaggctgttcttgaactcctgacctcaggtgatccgcccgccttggcctcctgaagtgctggattacaggcgtgcgccaccgcgcccggcccagtagttcactcttaaaacgccttgttatgtttctcccctgcgctctggtgacccccagacctctccatggagggacgatcttctgcaccaggagctcttcccctctgtggatcatctctctttcctcttcccttcctttttttcctgatacttctgatacttattcaaataattcattttttttgttcttcagtcgtcactttcatgtttgatttctgaatgcctctttaggcctggcctctgtctttgctcaaattgtgtatttgagacagtctacaacatcactcaggtatctttagatttgtcttgtctgagtggaattcatcctaaaattggaagctttagatgtacaagagatctgaataatagtttaaaaccattaccctcatctgaaagataaggtggtggggctgggacagagaaagtgacttgctcagtgaaatcgactgcagaccggactccgggtttcttggtttcttgttcactgtaaggtttgaccttaagccagtttcttgtcacaactgtctcatttccgaccataatacagagaacatcacctttaaattgtccctcttttatcaccatccacttagtcaccaggtcctacccgtcccttgtccgtgtcgggaatttgcgccttccctctcctttcccactccttgttctaattctcagtctttatacttaagcctcactgtcatgccactgttgccattagattttctgcttctgacctttttaagccttttaaccatccggagcgttgctgtcagcactcgattttgacatgacgcctgcccgctgcttcgtctttttctatttgtaccctatttttttgatggcactcgctacctctcacacactgtgcagttttcgtatttattgtgtttagggtctcttccccacttgactgtgagctgtaggaggccagaaattgtaatccatttggtaacagatgtacctacagctcccggccaggtggtcatccgcagtccacacacgcattcagctctggtatacgatagatgtgtagtgtagcagcacctggcgtttgcctgtagacgacacacagtagttgttgaatttgtgggacccttgataatcagccccccaactcccccccacattcatttctgattactctgaagcataaaccctccccggtagccacaagggtctcctcggtcaggggaatggattctccctggtcctaggggagcacacgctcgtccttgttaccctctctgtggtggagctgggttgcacactggaacttatcctcgccggggtcagtgatcctggaggtcggttgcctccatattgagcccctaaagcacctggccctgggaagagcgtgggccctggagcgtggcccagtatttcctcttctgttttgctgtatcctgaatttctcttctttttctttcatttctcagagtccaagtcacatcctgcttcctctgggctcaccatctctgccgtgttgctccacgggcccctcctggcctttagtgccctctgcagcctgtgctcttcgtccttgtgctgcccggcagccgatggcctttcctccaggctcggcacagtaggaagcgccaatgttcctgataatcaaatttatgggcgtgcgtgtgagagagagagagtgtgttcctgctgaagcatctcggttaaatcaaaacactctgtaattattgggttcttctttcctcttgccagaacactctctaattattggtttctttcctcctgctcttgacatttgatgtgtctatttgccctctctgtcaatagtgctgagtagaatactgcaggcacaagtcatgtttttgtaacgattttcgacagattagcattcctttaaaaaagaacttaagtcggttggggaagggggtccactcatattacaagggggatactttcaaaaatccttcaaataatggtaagagaagcagctttgcatagttgtgagggaacctggggcttactggagaagtgagcacacttctccaggcatgccatctgcagccttccttttctttctaggctgacctatggtcttctggtcactagtcattccatttggcagtagaatcaccttctcagttttgaaataggtgtaaccagtaggggaaaaggattgtggtgtgcgtggtgttctttgcgcacaaagatgaccgtggaatttttgaaggaggcaattattgtcattgtttaatatataactggaggcttaatttccaagtagctgttgtagcattaaatgtccctggctaggtgccagtagctatttccattgtacattgaatctattgcttctttttaaaatacaatggttcgtaggttgatttatctttattttaaagaaagggctaatatcacaaggtaagtttttgagcagatactatattacgaagtgttctgactcggatactggagaggaagagtggccctggatacctcctctgtgaaggtcaggttaagatctctttatgctcacagtataaagattaggtttggctgagagttacaggggagaggaaataacaattgtgtaactcaaattaaagtttgttcactcacattaagattccctagaagtagtcattccaaggctgtttagtgctccagcatagcaaggcctcgggctcctcctatgtttactttgctgtgcaaaggttcttttttttttttttttttaaatggttacctcattgtccaagatggctgctcaagctccagccattgcatatatgaggggacttcaaaaagttcatgcaaaaaaagaattaaaagataaaaataaaaaacaaacttctcagccaggcgcggtggctcacgcctgtagtaatgccagcactttgggaggccgaggcgggcagatcacgaagtcaggagatcgagaccatcctggctaacacagtgaaaccctgtctctactaaaaacagaaaaaattagccgggtgtggtgacaggcacctgtagtcccagctactttggaggctgaggcaggagaatggcgtgaacttgggaggtgaagctttcagtgagccgagatcgcgtcactgcactccagcctgggcgacagagcgagactctgtctcaaaaaacaaacaaacagacttctcaacataaggtctaacaagatcaagacacttttgtaaatgacgataccacccatttaatctgtccctaaagaacggagggttctaggagtttaactgtgtctatacagtctttttacattattttattttttgagacagaatctcattctgtcacccaggctggagtgcagtggtgcaatcttggctcactgcaacctccacctcccgggttcaagcgagtctcatgcctcagcctcccacgtagctgggattataggcgtgtgccaccacgcttggccaatttttatatttttagtagagatgcggtttcaccatgttggccagattggtgtcaaattcctgacctcaggtgattggcctccccaaagtgctgggattataggtgtgagccgccacgcccagccctctttttacattattaacagaaggaaaaatacgtttcctgtaaagattttttaaagattaggaaacaaacaagtcagaaggagccaaatcaggactgtaaggcagatttttaatgattgtttcccatgaaaactgtcacaaagttccccttgttggatgcttgttttggatgcgagcaatgagcaggagcactgttatcactgtggaggtggagggggctccctggtgacactttcctgggcatttttctgctcaagcttaggctttctcaaacactcgtaacaagcagctgtcatcgttgtttggcctccagaaagccaacaagcaaaatgccttgagcatctcaaagagcggttgccgtgaccttcgctgtcatccagattgctcttgctttgatggagccacttcttggtagccggcgctttgattgtggtttgtcttcaggatctgctgggaaagtcgtgtttcatttcctgtttcaattcttcaaagaaatccttcagggtcttgaccccatttgtttgagatttctgtctaaagctctgctctggtctgcagctcatctgagtgcagcattggcagccatcaaatggaaagtttgctcaactgtaattattcagtcagaattgtgtaagcgcgatggagaggtctgtgatactggctgttgtttgtgttgttaattgtcagtcctcttcacttagggcatgaactagatgaagtcttgccttgcaaattggtgtggttggtctgccactgagagtgtcatcatcttggccctccttaaaattaattgtccacttgaaaactactgatttctttggtgcattgcccccatcaactttttgtaaagcaccaatgatttcaccattctcccacccaaggttcattataaacttgatgtttgttcttgcttcaattttagcggaatttgtgttgctctgataagggctcctttcaaactaatatcttatccttcttactgtctcaaactagatcctgtttacacatgttatggaacaagttagtataagtttattttggggcaaaatgttttttgaagtacgtgcatagttttttttcttgaacatgaaaaccctttgtacatttcgcctttccggaaagaagaagtagggaagaagaccccactgttttcctttaaggatgtttcttaaaagttacactcagcactttcacagggaggctggaaaatatctaggtgaccctgtgtgcaaatgaagaactggggattctagttatggaagggtggggtggatactggggaaaacgaacagcctctggcataggcgccatcctggctgatgctgagtttcttcttttctacctgagcttagctaaaatctcgccaccacgcccagaagagaatgcatttgctttggagttttctgtaatccttctgaattggttctaaattggtggccggcgcctgtagtcccagctacctgggaggctgaggcaggagaatggcatgaacctgggaggcgaagctttcagtgagccgagatagcgccactgcactccagcctgggcaacagagcaagactctgtctcaaaaaaaaaaaaaaaaaaaaaaaaaacaaaaaaacaacttctcaacataaggtctaacaagatcaagacacttttgtaaatgacaataccacccatcttgggatatgatcaaatatacactaagaatatggaaatgaatcgtcctgacgtggaggtagaatactcaggtgaccagttgcttccaactaggactcagtcacccctggcttcagaagggcaggagacacgctgtgagaagctgtgagagtgttggagatttaggatgattctcagttcgcagattctttgttcagctatgtccagtctgttttgaagcctttccattttcattttaagttgttttttttcttacaaattctgtatagttatttatttctgatttggatgtctgaagtctttttgtatctgattcagctacagtttttgttggctgttcgtcatggtgcctgtttcctaatgtccttttaaattttgacagttattttcctttgaaattgaagtatgtgaaatctttgaagcttgggatgaagttggcttcttttaggactatgaagtttgcttctatcaagtgcttacaggtcctgacagtctgaggttttctatcacacccgggtcaaggccagccatccctcctctctatttattactaggctgaggggcagaaacttttccttgcagtgccccggtggggtgggtttactttcgggtaaaccttgctctgcgtctgcagccctctgcacacccactcttctggagggatgccctccctcagacaccatgccagcacgggccttgggcgttgcctcctgcccctcaggccgcccatgactgcaacgccccactccagttcatgggctcaggcccgcggaacccggctgctctgctcaccgggctcgggcccgcagaacccggctgctctgctcaccgggctggccccagcttcactgctctcacaccagcacatccgtgaatttcagaacgtgcccctgcctgcttgtctgccccccacctccaagcattttcacttgttagtgagaggaacctggagcctgaatccaccacattgctggacattttgtgcttgtggtctttttattaccgcagatgtgatttccttgcttgtttcttcaagagcctactcttaagaggtatgatgaaatacttttgagagtgtgaatttcactaaatcacaaaatctgaaaggtgtacaagcagacaattctgaaagaaatagaaaatgtagctgagtgtctagtatcaagtgtagccatttctggtgataaattattatacgcattaggtggatagttttgtttactaagaattgaaggtaattctggaaattgataggtcagcaagcctttgcttagtgtgaggctaaggagtttgtcgtgtttatgcaaaatggtaatgtcctactgctgctttatcgatatggaaagttccagtaggttagaagtggttaagtaaagatgaatggcgaatgggatttgattaaatgtaaaagtttctgagggaagtgaatcactgtgtagatggagtcacccccggctattgatttaaatgacagttcagaaatagtatcaaaagaaacaaaatggccagcgtgtcaagaaaccagcagctcttctgttccggggtagccagcaccaggcatcagggcccccgggacctctggacatcagcgctgtgggtcgtcttggaattgacacttgagggcagatgaggcagcaccagctcctgggtgcctctgcacccagtgccctgtctccgcagtgagtgaggctggaccgggtgtgccagcatctggaggggtctgcagggtcggaatactgcatacagttggattttgaggtggagcattagctaattaactgcaaccaaaagtaaagtagcagggtggctgcttctccaggcctggaagcctgcgtggtggctgaactgcggtccccactgcagcagaaccgggcaggcctcagtggcctcaggctctgtccctgtgtatttcatggagaacagagtcagggaggtgcagggctcatcgctagccagggcacagcgggaccaggcatcctgatttgcagcctggtggcctttacctagtgccgcctcatctgacataaagtcacccgtgtgggggagagctgtattttaataatcagtttcaggtagatcccggaaacccaaacatatagaaaggtgagggacttcggttcccacctcctgagcaggtactgcctcgtgccagtggacctgggagggcgggaaggctgctctcaggggcacgctgttgcattatgccatgttgttcttttggttgtttattgtgatgagctcttactgtgataagaaaaataatcattttctcatctttagcagtgaatatacctcttttttaactgccatgttaacgtttgcctttgacagtgtgctctgagagacacaatctatgcttcaattctatgctcttcagctgtcataactcttctccatgtctttgaagtgcagtaaagaaagtgtaacccaaaaactgaacagtaattcctaaacttggcacttgctctccactctggagacattctaggtttcatttgagagggattttggcctgcttaaagcattttaacagcttttcgttggccccagtacaaagtctaaactctttacctgggaggaaaaattgcttttgatctggtccctgctctctaccacagcctcacctcccaccttccctcccaccagactccagcctcacctcccaccagactccagcctcacctcccaccttccctctcaccagactgcagcctgactgctgacatttcagtgtgttccaccttttcaggcgtttgctgggcagttttctcttcctcaacttgttaaattctattcatgcatcgagtcttgccgttgatgtcattttctttggaaactgttcctaaatccttaatcctttctaccttacaaaagaataacaaaataaaccccaagaaagatgtctactcctttattctttcacaggatatgattcctactccatcattgtcttcaactgtatggtgtgttgttgcgatgatcgtggtagcaggattgatatcagtattgctcactggtctctagtcttctagaaaataagggatggggacttccaggtagctgatgaaatggttgtgtcttaggttcctgtctccaaagtatttcctccagaataatgtagaagaacaagaaggagaaaagtaaactttgtaaaagccatgtcctcagtgtgaaagacacaatatactccaacttgaaaatcgtaaaaagaggtaacacccaatccaacatggaattcctgatgttctccatctccccactaccacaaggctctgtccaccttgggttgtaggtagttgacagaaaattataggtacaagtttgcagcagaaaaagacaaaaaggaaggagaaggaccttttgacatatgggtggatggcgaaaggaagaagaatcagcaggggaaatttagtgtcctgtagacagggacaaccacaggttgggtgtggtggctcatgcctataatcccagcagtttgggaggctgaggcaggcagatggcttgagcccaggagttcgagaccagcctgggcaacatggcaaaaccctttctctacaaaaaacaaacaaatagtattgtacaaatgagtttctggtctcgttaattatactattgttatgtaagacctaatggtcgggcatgttgggttaaggccatgtgtactagctttgcaacattgctgaatatctaaaattatttcaagataaaaattaagaaaggaaagcagtggttatgcctgtttatacttgagccagagcaacgcctgactcagaatagacagtcacccattcacgttttctaacttcagattgtgcagttgtttgttggttcttgggtttttaaataatgcatgaagaaggtggaaggagcggcgccctgggattgcagtatcgtggtgttgagtcacttgcgatctttccggttcagtgactcctcagtgtgcgtggattggggccctccagagatgctctctgtctgtgtgtgtcatcgcagccctctgctgtccatgcccgacaagccagtggctttcactgctgtgtggggtgggggcgatgtttgtgtttgttttattccaacagtggcttcgtttctcttccagggcatttctctcgctcttcacaagaagtggcctctgcttcttctgattattcacactgtccattattgattactccttatcccctttctttcctctgcatgaaaggcaggtctctgccgggcgcagcggctacctgtaatcccagctactcgggaggctgaggcaggagaattgcctgaactcgggaggcggaagttgcagagaatggcctgaaccccggaggtggaggttgcagtgagccgagattgtgccactgcactccagcctgggtgacagagtgagactcccatctccaaaaacaaaaaaagaaaggcaggtcttttgtgaattgacggctaggctcacttcctggagggcagtcggctggctcaggcacagggcgggaggaaagaggcttccgcacagccacgttctcctcattcctcacctcgtagaaaagatttttggggggtggtggttaatcatgttactctaagttttcgtttcctttttactcggctcaggaatagtaagatgcctttacaggcccgtttgaatgcatttaaacttaagaatttctgtcatttttccctccctttttgtttctcttagcttattttttgagcctgcaaactttaaatttttattattctgagaatagcttatttactaacttaaatcctgttttgaaaaaggcaggttgtgaaaaagtaaaccataaatagtttatagctgtaaggagttgaagtgtcttcagaattaatatttatgtatttatttgaagctcagtttagctgttgtcattcaaagttctgcctcaagtatgcccagatcttgtcagttacacagcattcctttctctgctttctcttcttcccaattcttccagcatctcaagaggcagggttaacaattccactcccaggctgggtgaggtgtcctctccacggttccccagagcccagagaggcggagggagccccatggtccctgtcctggagaggaagacctcccccagagtccagagagagggatggagcccccatggtccctgtcctggagaggaacctccagttctcggtcagggccaagacccccaagtgggtcacagttacttgtttttcctcttgccctcctcagcctgctggctcttctgtgcaggacctcagactgccaggctcctgctctcttcctccaggcacatcttctcaccagaactccagccctgcacctcagactccctgttcattgtctcacctcagccccatctcaagtctagaaccccctttctttcttgttgacttattccgttctaactggaatcctagaagagaatgacaggatgatggtgctgtgcctctgaagggggtttgttaaaatactcagaatcagcagggcacggtggctcaagcctgtaatcccagcactttgggaggcccaggtaggtggatcatgaggccaggagttcaagaccagcctggccaagatggtgaaatcccatctttactaaaaatacaaaattagctgggcgcagtggcaggtgcctgtaattccagctactcaggagaggcaggagaatcacttgaacccaggtggcagaggttgcagtgagccaagattgagccactgcacttcagcctgggcaacagagtgagactctgtctcaaaaaacaaacaaacagacaaaaactcagaaccatgcctagaaaatactcagggctccctgtttgttagataaattgttagatcagccaatgagtgacatattgcatcttgtatgctgcatcccaggggatttagttagtgacagaggagaaatacagctcctttgcaagtggtcctgcgtgccgaggcaaagatccgcgtataaaatcccacgtcgcacgtatgtgctgggctcgtctgtgaacaggttacatggaccctctctagacccagcagatgggctttgaaatgtggccttcgtgttcagctggcatttggttttcaccaggagacaacagcaaacacacaggcggaagaggagagggagcccgtgaggctcattgtcaatacaggggagacagccactcaggacggggcttcaaggcatgcatgggtttgacagaggtgaggggcctggcgcactggagtccaggctcgtggagggaggggttggtttggcatcttctctttagcacctgccacgtgttctgcggaggccagttagtgtcagtcagcaaaacaccacctccaaatgctggcagtggagtgtctcgctttatttttttattcagatcgataactcctaggaaaagagcatcttttagagtcacctgaaactaaataaagagcagagtgcctgagttgtggaaacactggtgctgtctgggcctcatggcagaaagttgcggggccgcggctctcgttccgtcctcacactgccctgctagagtgcgtgcgtgctgtgtgcattcctcatgccgctgctgtccctggcaggtgacagttcaggggcacctcgcgctgtgggtgagttctcgagtgctgcggggagtgtagggaaggccggtggtgcggtatcgaggaccaattctgtgtgtgtggttcaacatttctagttctcttacaccttcatgaggtgtacgtctcttacaccttcatgaggtgtacgtctcttacaccttcatgaggtgtacgtctcttacaccttcatgaggttgaatttcatttgattcttaaatatttggctgaaaaattagataataaacgtagttacaatctctcctgtcatgaacactgaggaagaatgaatttgtctaaatattctctcggtgtattagaatattggtaaatgatgtggaatcttcctgtatttgatgtgatataatcttatcagttctttaaaatgatgtagcaggctgaccgttggccccccaaaagattagccacatcatattttctggaacctgtgaatattacctcatgtggtgaaagatgtgattaggtccccccccccaccccaaacaaagtctcgctctgtcatccaggctggagtacagtggtgcaatcatgggtcgctgcagcctcgacctcttgggctcaagccatcctcccacctcagcctcccaagtatctagaactacagacctgcgccaccacacccagctaattgttaaatttttttgtaaagtcaggggtctccctatgtaactcaggctggtcttgaactcctggactcaagccatttgcctgcctcagccccaaagtgctggattacaggtgtgagccactgcacccagccaggttaaggttgttgagagggagagcttatcttggattatttgagtgagccctagatgtaatcacgggtgtccttatgagtgagaagcagaggagctttgagtcagacagaagagaaggccatgtgaagactgaggcagagctgggagtgatgtggccacaggccaaggaacaccgaggcgtgcccacggccaccagaaactggaagaggccggaatggatttgccccagggcctccagagggagcgtggccctgctgacttagtgattttgcatgaatacttgagtctatagagtttgagaacaaggactttctcttacataaccacagtacatttatcaaaattaggaaatataacattgattcagtcctgtgttctaatttgtttcctttttttttcttaaaaaaaagaaaaatagcgtcttgctgtgttccccaggctggagtgcagtggtgtgatccatcatagctcactgcagccttgaactcctgggctcaagtgattctcctgcctcagcctcctgagtagctgggaccacaggcacgtaccactacacccagctaatttatttattttttgtagagatggggtttcaacatgttgtccaggccggtcttgagctcctgggaaccaagccatcctcctgccttggcctcctagactgctgggattacaggcgcgagccaagcgctcagctgatcgaattcatttcttagccagttgtttcagctccgtctgtggcagcctccgcactggcctgggagcggaccccggactacacacggctttttgatggcacttcatcctcctcagctttgctttctcagtctggccatttttgaaggatgcgggccagttcagttctaatcctcagtttgcgttttcctcctgtcttctcccgacaagagcagggcaagcatctgtggcaggagggctgcagaagtgatactggggcttcctcaggtgctgtcggaggtgctgatggcattttgtcccatgattggccatactcattttgaccttgattaagatggcgtccccacatttctccgctgcggagttgttttccctttgtaagtaataaggactctggctctgtgcctaccctgttccttgtgctggttttgcaaccatggataattcttgcccacatcagttatgatcgtgatggttgccaaatgctggttttctgattgtatgtttttcttcccttcgcccccattcattccttcattcattcctttatatcattctaaaataaattcttattttatcccatcaatcatctgctactgtcattgtttattttgatgctccagttgtccctgatttcgctgccaccctccaagctcactcctgtccatgtgttttatgtgttctcttcactgttgagcaattccttgctttcaggcacgacaaggtggagcagcctcatattctacccgcatggctcaagtcctggcatcagccacgtttccaaggagccctggttccttttctacagaatgggacttagaagccaagatgtcggctcctggcattgactccctcatcctcaacatgccgctcagttgcctggtgccacaatacacaggaagtaaattcagaattgccgtctcgtaccatcgtaaacaaactttctcacatgaattcactatctgttcccagttattttctgcctgtggactgaggggtggagtcaggtgtagatgccatggtcagagttacttgggtgggctttgtcccctctgttccgggctgttatttgcactgtactcaagttcacgtgtttagtttgtattctgttccgttgcagggctctcttatccttgcttatttcttcttttatgagtatgtaagttattaatgtggttctgcaagtcaaaactgtataaagctagagtcatgtcatctccccaatcctgtttccaggctgccttgtgtttcattactttcaggcatatcttgtctttcttttttttttaaataaggagatacatgtttatttatttatttatttatttatttatttatttatttaatttttctggaggcatagtctcgctctgccgcccaggctggagttgcagtggtgtgatctcggctcactgcaagctcctcctcccgggttcacgccattctcctgcctcagcctcccgagtagctgggactacagacgcccaccaccacacccggctaattttttgtattttttagtagagatggggtttcaccatgttagccaggatggtctcgatctcctgacctcgtgatccacccacctcggcctcccatagtgctgggattacaggcgtgagccactgcgcccagccatgttattttcttatatcctgctcttacatggcaagatagtatactaggtatgctcctctgcactctgctttttgccactacacagcgtgtcctggaaatcactccatgtcagtttctagggactttctcttccttttttgagagctgtatggcacttcattacgtgagtcaacatcttaacattgtaacattttgcaattacagataataccgcattgtataaccttgttcagatgtattttgtattaaggctgtatcttcaaggtaaatttatagtatcactgggtggaaaaatgtgtatgtcgtttttttctagttattgtcaaattcccttcctacctcaggattgtatacccttttccattcccctcggcaacataggagagcgcctcattcggagtcgcccctcattcagggtcgcacctcattcggagtcgcccctcattcagggtcgcacctcattcggagtcgcccctcattcagggtcgcacctcattcggagtcgcccctcattcagggtcgcacctcattcggagtcacccctcattcagggtcgcttgttgcgttttcagtgtatgccagtgtgtgcagtctgggagatgagaaatgctctcggtgtagttttaatttgaattatttttattgtaagtgagttgaggtattgctctgtctcccaggctggagtgcagtggtgtgatcttggctcactacagcctcgacctcctgggttcaagtgaccctcccacctcagcctcctgagtagctgggactacggccgtgtaccaccatgcccagctaattaaaacatttttttttttaatgtaggaatagagtcttgatatgttaacttgaactcctggggtcaagtgatcctccatccttggcctcccaaagtgctgggattacaggtatgacccactgtgcctggctaatatttttgtatattcagggccatttccatatatatatatatatatatatatatatatttttttttttttttttttgctgtgaattatctgacatgtcttttgccatttgcctcatggaatgatttatatttccacgacttttaattcctagtgacagctgctactccccacatcgtggggtgcttcctttgagcttcttcccagctgcctctggctgttgaactccctctagtcctaagcgtaagatggacccccagagtcgtcctgggagcagcactcggaaatgcccgacaagaaccctatttctcctcatcaggtgggggcactttccagtccttagagctcttctgacagtgttggtggcctctgcagagggcagggtcatcctgtgcctggagggacgtaagcatggttagaggctttctagaagggattcaggcctccgacccatctggtgctgttcatttttgagattacgtgtctctaagataaaggattgggaggatgggccatggtttatagagcactggtcactgagtcttactgtgcccagatgtggggctcagcacttgctatgcataaactcacctgagcttcataacaactttttttttttttttttgagacagagtctcgctctgtcgcccatgctggagtgcggtggcacgatctcggctcactgcaagctccgcctcctgggttcacgccattctcctgcctcagcctcctgagtagctgggactacaggcgcccgccaccacgcctggctaatttttttatttttagtagagatggggtttcaccgtgttagccaggatgcataacacctcctttgaagtagacacaaccattgttcccagttcacagattagaaaactgagacttaagtgcgtcactgtctagtgcagttctaccctcacgacaaagccatgtttcttccccgtgaatgaagagaaaggtaaatttacagtatttgcctttcgggactcattggtattctctcttgaaacacttcttactgcataattcagagttctcggcagcgtatccatctcttagaaagggctcttcctgggaaggctggaaagaaaggctctcttctaacgaggccggtgtctcaagcactccactaaatatgaagaggtacttgcttgatttttacaaaatcagctttgtgagaggatgagtggtccagcccctcgcccagctgtgtgagtcctgagcacctgcgcttcagagtaaggctgttggacctgggacccttccatgaaatttattttcaatcttgaatgagatttactttaatgggaggccttaaaagcagatgccatgcgagttaaaatcacacagcttattgcatctatcagttccagtcagagctgatggcaaactcttgttctttcagtaaccagagagtggaatctgtctgtctgtgtcttccataaccaaaatacatcaccccacgcaatgcctcctaataactggggctttgtggtcagggtttttgcagggcaggccccttttctgcaggcaaagtgctaatggccagcgcctacactgcaggcctctggcgcattctctgccgagagttctgtccgtcccacttctcctcactgtctagtcttcttctgaccctcccagcctggttcacgtttgctcttcgttaccctcttcctgtttctttctcctgtctctcctcccaccacaccatccctcacatgcaccatggggtgctccttcagattgtcatctgatcgagccacagtcccactcagcccatgtttgtcaggactctgccactggtcacttgtccacaaggaaccactgtctttgagcttcttcctccggtgctcttagcatctgcccacactgtatctatctgtgtccaggtcttgttttctgtgtcattgtttgatgaaaggcagggactcattcggtgagtgggtctcccctgcctctgccccacaccagcacactgctctgcccttggtgggcacccgttggtgtgtgttgagctgggtgttgtacctcggtgtctgcgtggagaaatgcgaacagtgagtgccacagcacagccacggaatggttgtcatcggcttcagaaggggaatgaaaggggcagcaccgtgggtgttgatgatctccgaggctgcctgtttagagcgtcccttccctgagatggaggcgtagcttcaccgtgtagtgtttaagctttaaaacgtgaaatgcagtgaggccgacagtgagttgtaggaagctcagaaatgggatgcccgcactgccttcaattcaccctccattgtccatcgccgctggcatacccaggtcagcgcctgcaggcccctgtctcaaaagatgtggccggcttcttgtcccggtactgcctgaagcttcacctcagcaccgctagcttcacactggccacacccacctccactcagcagtctccatgctgtagcccaaagcatgtagtggcggttgagtacctgagtgggggaaataattaactgggatgcttttattgataagtagtcagatgcctgttaagtgacatttatgaacactcacgtagcactgctgcctgttagccaggcactagtcaaaggacttttgatgtattagctcatttaatcttcacagaaactagaagttagacactatcctctccactcccttcacccccagccccaaacacacacaattttatagccgaagaaacggaggcacaaagaaggtgaagactttgctaaagtcacaaaactggtataagcatgggctttgtgtgtgtccaaagttcatccctcaaccgtttctctctggatcaataattaaaaggtttatcaagaagtctgaaggtaaatggttcagtattgtcaggttctggataagtttctctgtgttcttgacttttccctcatgatgacaagaaggctgccaccactccaaacatcacagcctcacagttgtgctcaaagggagaaagaagaagggacggccgttctcctttgagcacactgtttcactggcttcctgtgggttccactggcctgacttgatgcctgggacactttaagcatctccggtgctatgcgggctgggaagaagtgagctgtagaggcagccagtgttactctctgctccatcccttttttgttaattttgcggttactgttatttaaactagatgtatctctagggcagtggcaggaatcgactccaaggacactgaccagcttggggctgctgcctggcccaggccggcgcatgttggaacacagactctctgcccttccaccccaagcctggtgggcgagtgagtctgcccagagggagtgcctttttctgctttacacaaggcacctcaaggggtagaggtggcctctcctgcagaacggcagctgccctgttgccgttctgataaattgcaagataaaactgaagtgcaaggaaggggcatttttgattttggatatgactttgcctaaaaatggcaccttaaggtgttttaaacatttatcaaatggtttcatatgtatggagtatgtctgtgcagcattcttaaagtgacaggactaccttatgaagtcagtaaatcctttcatctccccagacagccagaagctagtcagcagatgaacacattcacttgtatgttccccttggcaacattattcctagagaggttgcatctgcatcttggagtccgcatgataaatcatttatgtactcacagaaaccatgcactcccccgtgggaagagttctaggtgtagcaggggcggaggacgccacctgctccctgacatccgtctttccgaagccatcgctggagccctctgctgagtgtgggcagtgaggcctcgtcttacgcatgtggtcagaggagataatgtggctagaagtgctttgtaagcgccaaggattgctgttatgaggaatttactagatttcaggctttcatcagatagttagcgaggaagcgcaaaagcacagcatggtctccatgtttgctgacctgcagcgaaaagtcagaaagctaattggaggccattcataggctgattctaccttacaccatcattatactttttgtctataagactggagaagatctttctgagacatatcactatcagtgttttacgcgtatgaaacatatttttctttccttctttatgttcatttttaaaatttttgatcagtgccctcaagcattctcctattcaatagaaaacatatttttctaggtatgataatctttcagatttttggtatgtgtacctttgctaaaaacacatttaatatttctacctgtctggacaccttttaaaaatgtctggctgcaccttggagaaacgcttcatgcaagcagattctaattaaagtagcaaactttactttaccattaagttatatgtaaaagcattctaggggagagtcttttaatcattgaaacattttcaaacgtgtttgctcatttgcttctttatttgtttttatggcttattcatttgtttatttttaaactttttattatgaaaaatttcaacatatacccatcatctatcttcagtcattttcagctgccagttccagtctcctttcatctgtgcccccacccagtccccccttcccactcccctggctgattaggaagcaaatcccagacttcatgtaatttcacctgtcaatatttctgaaagaaatatttactttctctaaagataagtatgcttctaaacacacacacacacatacacacacacacacacacaatgtttgtttgaatcaggatgcaagtgagatgaatgtattgtgagttacttcatctattctgttaatccatgtaattaatccaaaagtcagtccctcaccccagcactctctgtgcacctgtctgcctgtctctttctgcagttgattggttgaagaaactggatcatgtagcctgtagaatttatcgtggtctcgatctcgtcagtggcttctccccccttgccctgggtgagccacactcacctctgctccttggatttcctctcggtggtggacacagccgggctcccctagattctggttcagtcagggaatgtttcatgtgtggtgctgtgtccttactttaggatatctgatagtccctctgtgatattagcagctattgatgatcattgtctggatctatttattagagattatgaaaagatggtgttattgtttcattcctttttttgcaacaggggatctcacttggccacccaggctggagtgcagtggcgcaaacatggctcactggagcctcaaattctcgggcccaagtgatcctcccacctgagacttccaagtagctgggaccacaggcacatgacactatgccttgctaatttttaaatgtcttgtagaaacagggttttgctatgttgcccagactggtttttaattcctggcctcaagcaatcttcctgcctcagcttcccaaagtgctggggttacagatacgagccactgtgcttagctgtccttatttgttaactggagtatctctatataaagaaaccctctcatcaattatttggatagctcaaggtacagtcatagaggaaagccagcatcaatacttactttcctttattaaccagttttcaaaatcgtgtgtgggcttctctcaaaggtgactagtaaggggtgtgtgggtgtgatatgtgtgtgtgcatgtcgtgtgtgtgtgcatgcacgtgtgtgcatgcataggtatgtgtgtggtgtggtgtgtgtggccaccctgttgaaggcactacctactgtattcgtttctcactgcatctctcaaaggtgactagtgtgggggtgtgtgtggatgtgagtgatgtgtgtgtgtgcacgcatgtcagtgtgtgcgcataggtgtgtgtggtgtggcgtgtgtggccaccctattgaatgcatgacttactctattcgttcttcaccgatgtccacgtcgttccatctttgtgttggcccctgagccttgtgatgcagttctcgtggtcctcaattgcttcattttgatatggtatgacaagccagcatgttctgtgccattttgtacttcttctaccctaggcctgaaatcagccacgtgtctgtctccagggagtcttggtttccttccatgggaagtggtatggagagcttaatctgggctccagggctgctcattgacccttgttcagccccctttctctatgggtgtttcaaagataaaatacgaaggcgctcttacacatccaggttcaggtctgcaaggtctgcttactctcatgggtcctacagctgtatctgcttctttccacatggagtgctcagattgttcatgaacaccaacgtaattacccattctcttatcctgcaccacacctggcagtttcagaaagcaacaccagcactgccactgacgcggttactgagagccgctgccgaggcatagccgctgctgaggcactcgcccttccttctcaggttaggcacagatgtcgagtgacattaccctgtatttttatttatttatttttgagacaggctctcactgtggcccaggctggagtacagtagcagaatcatagttcactgcagcctcaacctcctgggctcaagccatcctcccacctcagcctctcaagtagccaagactataggtgcacgccaccatgtctggctacgttatgttatgttatgttatgttatgttatgttatgttatgttatgttatttttttgagatggagtcttactctgttatccaggctggagcgcagtggcatgatctcagctcaccgcaacctccacctcccaggttcaagcgattctcctgcctcagcctcccaagtagctgggattacaggcacatgccaccatgcccagctaattttgtattttcagtagagatggggtttctccatgttggtcaggctggtcttgaactcctgacctcaggtgatccacctgccttggcctcccaaagtgctaggattacaggcgtgagccaccgtgcctggcctaatttatttatttatatttttagtagtgatgaagtcttcctatgttgcccaggctggtcttgaactcctggcctcaagtgatcctcctgcctcagcctcccaaagtgttaggattataggcatgagccactgtgcctggctggattactttttaaaaaaattaattttgctttgtagttatgtaaaatatttcatgagtccaaagttaaatacacaaaatgaagtttattgaaaggagcctggctgctcttcctgtcctggtgagcctattttatcttttcttctgtaggtcaccactgaaatgttttaataatatgtgtaccacatgtgatgacacgtatgcgtaaccttgggtacatttatatacgcacacacgcacacagtgttttctctttagggaagtgctgtatgttgtacatggtttcttctaccttgcttcttgttgctgtattagactggaatccacgtgtcctcattggaatcaaagcttcattgtttcctctaaagcagagtttctccagcttggcccgattggcatttggatcagctaattcatgattgtggtggtcgtgtgctcatgtgctgtgcggacagtcacaggatgtgtagcaggtccccaggccattgccatcagatgccagcagggcccacttctcccagcagtgccgaccgagcctgtctgcagacaacaccagtgcccccgggggcagagttgctcccagcggagatggtgtttctcgggttcattggggggattctgagcacccatttcagaagtggatttggccccatctggaagcaatagcttttctttttggactttgaataataaaccagctattctagttcttgtctgcctcttctgcaaattaaggaaggaaggaagaattgttactgaataatacataaaggaaagagtcgatgattttacaaatttcacgtaactctgcccttactgggcagacacgtgttgagaacattacgagttactgtgaccttgtagtccctttgggttcggtgtacgcaatttcctactctcagcatctgccagcccagactctggcagacttatgccagccctgggtgctgtagggtcagccacccccttccacgcagggtgggcgtccagatggtgctgtgggaaacagcgttttgccaggggccagagagctgactcagatagtgacctggaaaacagactgtggatcaggtgggcacgggcctggaacagggtccctgaaacacccagcaagaggctggggaatgtctggagagcccggcatggtccggagcgtccacgcagccagcagctcacatcctcttgctcctggcggccgatgctctgcgcagaaacgggcttggtctgaacggagagggacattgtgaacttgaaatgaaatctgacaagaaattagaaatttcttcagaaagtaaagagcgctgtcaagaatgcgagctgaagatttgcgtttacagctgtagagcaaatacaggcggctctgacatctcagcttttgtttgccactgctgcagcctcaggtgcctcatctggggcttcattcagagtgggtggggaggcgacaggtcgaggcagttgccccgtgctcacgaatccctgacacagctggtgacctctccaggtgacctcttcaagcctggtcccaggggcaggcatgcccgggcatggccctcgcagatggctttgctggcctggtctggcaaccgttgaataaatactgatttcccacccaggtgaggcgcatggtagatgtttgttctgtgcattgcgttggtcggcctccacagtcgcacagtctctcagtggagtgagagtatcttccatatgtggggccgtggtgctgaaggcttgtgcgttgagtgcctcctttcctgtgaatgtgttggttctggtgaccagggtggagcctccctgcgccccttccttccatccagcatcaggttcccagttctctgcctgccaggcaggcgtgcacatatggagtgtctgggaacctgcagctgttgatcacggctggtggtagctccgcacttaagtaaggaggagtgattttcccgaggagatgtggtattggtcggagttgctgggaaatcagcagcactgagtgatcaggttgtcgtgagctcctgcctccatccaccccattctggcggttcctggcttcactgcctcttgaagacagcctctctggcactcatgggcatgttggccttctcgaggggaaggggttgagtaactcatggcctgttagtgtgtgccagagactcagcaccacgggcagacacagtgccacgggcagctatatccaaggagggtgagggtgctccccagaagcctctgggcctccgtgggtgtcatcagggtagtgagcaggaagcctgggggctgagctgggctgcctggctttgacatgggcctgtgcggggctggctgtgtggccccgtgagggttactgaacctctctgtgcccagcctcctgtttgtgaggcaggagcgatggcagtgcccactgcatggtggtaagagtgaggcgggtagaatgcatgtgcccaagacagaggctgccccgacccgtgctgtgcgggtcactcacccccacattgtctgccacgggggcccgagcatttccacacgagactttcacatcagccacccgggcagggcccgcgttagtttagttgtttgtggaggagaaaattgaggtttggttttgttcatgacgttgccaggtcgaatggctggtgaatcattgatttggggctgagacttaagtttcccatctctgggcgggacctgtgctctctccccgtaacagtggcctctgttacagaggggcaggtgggtggctcacgtgtgggctcacctgcgtcacttctctccagctcacctccactgcgagagtgcctggggatgcctgccagccacccagagccagcgtcttcccaagcagctgttttacaggaaacaaagcaggatgaccttgggcttcctagtctctgcacgttaccccgaattccagaataatcgtgagaaggagccagtggagtggtgtgacttttgtatttatagacttcttccaaaggtcacctcttttatttctgaaaaacaagtcgcttgaggcccatctttacagagtgacaggagctcaggatgcagaggcaccaaggccagggaggagcgttgggggtggctggagctggtgggccaagggccgcagaccacttttgccctgcatggcctcgtggctgccttttctacctgcgtgagctggctttgatctaccccggacccatctttctgtgaagagtttgcagaggatgctggttacatcttagatggaaattggccgtgtctctgctgtttctgagtgtgcgactctcagagccaaggtggcatctggcgactggccttgttcttgtgagtccctgtagggcaggatagatttttccggcaggctgcagcctggagttcaggcttcctctcccttttaaatttcaaagactcagggttccatttaaacagacaagataagtggcagctttgttttgttttgttttttcattaagagattttggagggggaggaaaccagccttacagtgatagcatcaggaaaagattacacagaatggcatcttattatgaaatattgaaaacatttaaagagcaaataaaatatgcaaatagagtgggacagaatttgtactgcacagcctcttgccctacatctttcccaataaaaatttaactctgaggtccatgttgggacaaaaaaaatgatactgggatagtggagctcggctttcgttagttcaaagcgagcagcatattaatccaagtaagcagaattcccatgtagattcattccacagccttttcttgggtgatgactctgtgcccagaagcaaggggctgactgggacctgagaggcctcttcttagtggccatggcctcccggggcaaggccggctggtgcgtcagagcctggatctctgcagtgggcgcagaagggacacaggaattttctcttggcctctttgctggacttgcagcagggatgccgccgaactcagccgtttgcaggcgggagcacgtgagtgagcgagtgtgggatccagccagcccccccaagcaccaatacaggagcaaactccatgcggggcccacagccagaccaggtgtgtcaccttgaggggaacatggtggcacccaggcaagggtgcccatgaccctgaagccccagagtgggtgttagtgtgctcattagctcttttagttcttccatccacagtccaacagatggtggcatgttagcagctccgtcgccccctggccccatcacgtagggtggctgccctctgccagcaggagcaaagggctagtgtgacagtctttctggtaccagcacttggtgggtcctgagctcttgtccagcatccaagcagaatgcagatgtgcctacagtcagagagtgagcaaggtgaggggttttactgagtgatgaaagagctttctgcagagaggggacatgggggcggtccccacccgaaggtgggaaaatccctccagtgtgtcttagtctggggcttttgtgggctcagaataggggaggggcaggctgtatgtagtattggaaaaggcaacatttgattggttaaaaggcattattcagaaagaatcaattgggaaagggtgggcaaacgggaataggagttttgctctgggtcttgggttttatccaggacctgccgtctggtctttcagccttcaggctgttatttggcttggaggtaggtttcaccagggacctgcccctgtctgcctaggcatttgactacctcccatcggtatcagaagcaccttgtgagccccagggagctggtgaggaccttgtaagggaggaggagggcggcgtgataggtgcaggtggcggcgtgataggtgcaggtggcaccgtgcacagccacgtcagggacttgggaacgtctgggccaaggagccaccttgtgcagaggcatggagtcatgagagattggccacggtgggaacgtggtgaggacactgggctgagcagagggctcgcaggtggtgctgggcagggagcctgttgacccacccacagagggtttgtctcaggggccggtggcctgactgctgtgcgttaaggaggaaggctctgacagaatggggggacttggagaggggtcattttggaggcctgaaggtggttggggtgtttgactcccatgaaggcagaggtggtacagcgaagtcagagggacacatcctgtgacccactgggcaccagggagatggcaggagcaggagctgagggtagtggtgaggtttctgctggcagagtttggtggttgagtttctgctggctgatttggtggggccagcgagtagacaaggatcccagacgggtgggtgcggggcaaggtggggaatttgaccacagatttctcttgaaggtgccctatggggaaacggtgttgtgaaagtaggagggtgaggaacggaggcgactgagggtccacagaggaggatgggccagaggcagaggtgacaggccaggtaggcgagtgagcaggggagccacgtgaggccagtgcgggcgcaccaggcactgggccccatgcggaggggctgccgcccacccccacccaggcctcactgactcctgtgggagccatctaggtacagcagccacgtggaggatagcgtgaaaagtgacgggacggagcaaagaaagacaccagctcctcgtttgcagaggtttctgcaccgttgtcaccagcatgtggtcatggcctgctccccgggggccattccagccattgatccacattgtcctccagccaaaggaaacaaagcgggaagtggaaagagctggagttacgtgggggcaccttccatcctaggccggcagctggtcaacctcctcagcctcgtcaccgtttaacatcctcccttttgttcttttctccttaatctttatgtttggaaagatttctatagacaaatgtgccgctgcttctccatagccttatctggaacaaaggaaatgtcttttattaccattcatgcaggtataatccgtgaaagacaagcctgttctgccagtcaccaagtcagtccttttccttctgtcttgctcatggaaggctgtcccggccctcacctgactagtggtgcagctcttcagggggtagtgcccatccaattcctggggaaacccaggcgagcctgctggccaggaagcgccagcttgtgtctgattgctaggttaccctgggtgcttcctggatgttcaggcgcccgtgattcccccagcatctgccttgagcttatgtgcatggagcagcagatccctttgtctgggcagttagattgtctgctaaggaaagtgggtgttggagcaaaagccttgcttcactgctgtactccaacccatcaaaatggaattgtttaaaatgccctcaaaataaaaatagagaccccaagctcttgataaaacagctttctctggagaagctcatcgggctgtgtaaactccaataggaagtatttattcatcatttgtatgtgcacaaatatttatttaatgtcaactgtgaaggctgatgagtaaaccagcaggtagagtccagtaccctggtgcagtgatggggagctagaggtgctgtgcacagtaccctggtgcagtgatggggagctagaggtgctatgcacagtaccctggtgcagtgatggggagctagaggtgctatgcacagtgccctggtgcagtgatggggagcaagaggtgctatgcacggtaccctggtgcagtgatggggagctagaggtgctgtgcacggtaccctggtgcagtgatggggagctagaggtgctgtgcacggtgccctggtgcagtgatggggagctagaggtgctgtgcacagtaccctggtgcagtgatggggagctagaggtgctgtgcacggtaccctggtgcagtgatggggagctagaggtgctgtgcacggtgccctggtgcagtgatggggagctagaggtgctgtgcacggtgccctggtgcagtgatggggagctagaggtgctgtgcacggtgccctggtgcagtgatggggagcaagaggtgctgtgcacggtaccctggtgcagtgatggggagctagaggtgctgtgcacggtaccctggtacagtgatggggagctagaggtgctacgcacagtaccctggtgcagtgatggggagctagaggtgctatgcagcctttggcatggcttcctatccagtgtctggaagagcatccaagaaggatgctttcaacatgataaaagacaagggacatttaacatgatacttgaagaatgaatagaaaatgaccaggcaagacttggaataggacatggagaaaaggtaggaagaaggttctgggcagaaggctggaaagtaggttagaacataatgaggcaaaaggcttaaaagatcctttcttgtggctgaagtgtagactctcagagattatgtctagtgatcaggctggagatcttgcagggactcgtaggtctttctaaagagttttcaaagttagtgggaagacatcaaaggtttctaagcgggagaaggacctattgagttttggagaatggatttggagtgaaacaaggctggaggataagttgggaagttactccaatgatctaagaaatagataagtggtggtggtgatggtggtagtggtggtgatggtggtggtggtgatggtgatggtggtggttatgatggtggtggtggtgatggtggtggtggtggtggtggtgatgatggtggtggtgatggtagagatgatggtgatggtgatgatggtggtggtggtggtgatgatgatggtggtggtgatggtagagatgatggtgatggtgatgatggaagtggtggtgatggtgatgatggtgatggtggtggtggtggcggcgatgatggtggtggtgatggtagagatgatggtgatggtgatgatggaggtggtggtgatggtgatggtggtggtgatggtggtggtggtggtggtgatgatggtgatggtgatggtagagattatggtgatggtggtggtggtgatggtggtgatggtggtggtggtggtggtgatggtgatggtgatggtagagatggtgatggtggtgatgatgatggccgtggtgatggtggtggtgatggtggtggtggtggtggtggtggtgatggtagagatgatggtgatggtgatgatggaggtgatggtggtgatgtgatggtggtggtggtggtgatgatgttgaggtgatggcagagatgatggtgatgatggaggtcgtnnnnnnnnnnnnnnnnnnnnaacatcatccttttcgaaaccagaccatcatcctttttagtataatggattggaattagaacaagactaaagctataagtataggatggcatccaactcccttgatcaaagatattgatagtggtgttggtgatagtcgtagtgatggtcatggtggtgatggtgatggtgatggttatgatgatgatggtggtgatggtgatggtggtggtggtgatgatgatgatggtagtgatgatggtagtgatgatggtgatggtgatgatggtggtggtggtggtgatgatggtgatggtgatggtagagatggtggtggtggtggtgatgatgatggtggtgatggtgatggtggtggtggtggtgatggtagagatgatggtggtggtagtggtggtttggtagtggcttgacctgggtattgatagcagggatagaaagaggtggatggactcagtcaggattgaagaggtagactcaacaggatgcaatgattgatgacataaaaatggaaagggtgaaagacaagaaggtgtcaagggtgattcttgggtttctgttgtccagctgggtgattctcaggtttctgttgtccaaatggttagtgaccccatccatatggattgaggagagaggggagcaagcttaggagggaagacacagaagatgtgcactggacaattcctctctgctgaaaggcctcagacacactgatggattgcttcacatctgggaacaaatgctgtgaagtctctgtgtcctcagcggctccacctggttgcactagtgtggaatcatgggaaagggcacaggttatatattcttgccatttattctcacggagaccataatgctcattccatatcaaccgaaaggtagcatttgccatcactctttttggcttttgttttgtttctctgtattttacttgtttttcatcctaacacccttaagggtgagggtaaacaagggctataggaggcgaggccttccagggaaatgccgggcagggaagaaggtcaggtccgcctaaaggtccctcctaccaacatttccctggaaatctttgcatcctacttgagaaggagaggggtagggtgaaactttcactagaccccagatggggccagaactggcctgagtcctgaaatgacatttgttcctccaggacagttctgagagtgttgcaggcatttcggtttgttggatctaaacttgacctgctattcattgctataggatgggaggatggcagcgatatcacttgtactcacagacccagcctagtacgacgccagtgtctttgttagaaactctacagatgtctatgtccagcctgccccagcggcacagggctacccctggtgggattttgtcaaaggggaagacccaccaagtagagcccctgagcccctcctcttcccaggtggccgtctctccttgatccacaccagcggcagtttgtgcagcttcaccagagcttctagcgggaccatgccgccacgagggccactgggagcagagtccctcccatgctcagggctctccagggtctgaagtctgcacttgtatgagaaggagctccaataccaataaaagtctacgtggaaaatgcagaatctgattgcagtagcatttcttaggccttattagcatataaatttaccaggtgtcattttaggacaagagcccgtcactgagaaggaaatgaaatttggagctgcattttccttcattaaaccaagggcccatttttgttttgttttgttttttgttttgttttcttttcttcggttattcattcttttattatcttctgctgtcacatcctccaaaactcctgtgcatatattttcttgcaccttgagatttggcatttcaggaaaaatgcctagcacaataggctgtagtttagagacttgctttgtcattttatatgtccagcagaaattgtcgtaactcccccggatgatcagatgctcccgtgcctctcctgtctctcagaccacacagctattatccctggcattctagttgtgagacaaaaccttaacacaatgtggtgacatttaatttagtgtttctcatttcaaagcccttaaaaatattaattaattcccatgaagccccaggaggcgtattattaatatctgtggcgcctttcatgctagtccattaatgtgccttctctacgcaataggtaagaaaatgaagctaaatccgtttttcgcagccccatgggataagaccttcacagagccagggtcagaaatgacgaatccttaattttattggtgtccctgaataatctaccccgtggccttctgtgtggcgtggaagaacagcactcctgttcaggagcaatctcaggagacagcgaatgattttcctgtggagctgtgacttcagcaatcctagttcgatagctgtgttgaggagagtagaattgagaaaaactgccgcagcagtaatgtaataagtgagatggagcaggaggcacttgacaatttcactagaaaatctcccagcgatctgtgggccctgcagtgaacccagcccctgcagatcgatgggcccgtgctccagggagacagatgtggagatcagcaccgtggcttgttcttattttggggtgccttatctttccgtgcctttgttcttcaccactatgcatgggggatttctgtagccttagcaaccagaaagcagggtggatctgtggaattagactccgaaatctcgagtttagttgacagcgctttttccttccttctgattgcctcgccgtctggcaagctctgcatgtgttcttttctcacctgtatctgcagcccatgactccggaagtctttctgactctgaaaaacatatcctgtgttcactaaggggaagtggttttaatgtgcatgaaaagaggctggcaggcgctcaccccacctggaccctagaccctggagaaggggtgggaagttagcttcagtggacgttcctgataaacgtgagctcaggtggctcacttcccctggcctgactgcagacttgagccaggaacacccattccgccttgtgtgtgagacccaggaggatcaaggagatatcctttagcatccattaaaaaaaaagttttttttgagtcctacctctccatttttgctcttccctacttgagctgtcttaaagcatccctggaggtaggaaaatgcatagaccctccttcccagggccccagtactgccggaggagcctcggtgatggctgcacctctgccctggggcctggagctgggctaacgctttcttggaaaacctctaattgtttctaccaagttagccaggacactttttaaaaagcactttcattaaaaatgcataggtatttgttttaatttacataaaggcccagaccaaaatgggatgtggcctgctgcttagactggccattatcacgcctctgattcagagaaaaacctaaatttcatgtttatgcaggtcttatagctgatgcgtttggtttgaaggagcaggtgaactaggtcctctccaggacttggtgcttttttgttgggtgtggagagacatgggcgagatggggctgttgctgctgcgctgatttgaagccatctctccagactgaacccgtcctacgtgtccgccattctttctacctatccacctgaagacggaatgtctagctacctctacttcagacttattttctaatttagaatgtacttacttgagtggatgtggttttggagggcctgtagccaaggtcgtgacagctgaataaaatgtttccttctttgcccccagaactgcgctttcatttatcagctgcccttggtgtgttgtatgggatcagccaacattcaggtatttagaacattaagactcagtggcctggttctgtctcaccaagaacacaaataaacagttgatgaatccatcacatcagtgatgaatccagaatgtgtccatcattttcgtaagtcttagtatgcagagaatctcagatagcaaagcagaaaggatgatgtcacagacgccttgggtacccagcacctggatgcagctgtttgtacacacatactttctgatattatgttgacagtgacttacaccacttcaacctcaggcaggattctatcagtttctttactacaaattgatttgtttctttaataattattgtaattactgtcagtaaaaatctgagtatgactcagcaattagttgctggtaactgagtgtgttgtaatgctggggaaaggatataaaacttgtattttgaacagaaaggcacacatgtgggtgagcagtgtttaccaccacagaatttaccgtctacacagaattgagatagctgcacatgaatgtatagtgagcagtgtaagttaattcagagaaagaaaaaattatttcctgctgaaagggttcaagaaggaattttgtaggagagctgggcattgaacaggctcctccagaacatgtgggtcagattggccaccgcatggctggggtcccccatgggccagtgatgcccacctatgggagcaggtgacacgctgcctcccaggccacgcatcgacacccctcctgtcacgctccgtgcttctctgagcacttcctccttccctgtggccctgggctccctgtgggccagccctgtcctggcagagccccctgtgcgtgtcaacgcacatccttcatagatgaaaatggacttgaagatcccgcgttatcagttggttagctctctctcaagtctccttcgtgactctgctttatttttcgagcagcattctggttctgagcgaggagacactgagaggggagaccactctgtggctctaaccccgcctcagaccagggctccgcactgtcctgcagtggcacagggttgctagccttggattagcttttggttctctaatgggctttgcttgcaggtacaaaaatttgggggaacctggaaaaactcttaaatctcctcatctgaaagatattcatacatctactgatgacttccaaagtacaaggtctagaataccaagaggttttatgttgtcataaattagagttttaatgtatataattaggtgaaaccaaatgtgtatcatatacaacagagtaaccgtgttgcaggaattgggcctcgttttcctgttgttttcctcatatctaattctttttctctggaaatgccagggaacctttctttattttctttatttttatttttcagtagagacgagggatctgactatgttgcccaggctggtcttgaactcctggcctcaagtggtccttccaccgtggcctccgaaatgctgggattccaggtgtgagcccccgtgtccggcaggggaacctttcttaagcatgaatggtgtgccctcctcagggtgtgtcctctctgcttcctttctcagtcacatcagcaggtgcttcgtgtgcatctgtgtgcccagcctgggcacagcgggagcccaggccttccttcaaacgcagcctcccctgcacgttccaaacacttactggcatttttcttcaagtgatgatcatggcattggccttacttattttagttgtttttaaaagaaagttttaaaagtttatcaaagtgatgaacatacacatcactttttaaaaacataatccccacccagaggcaaacccttttagctatttgttctagtggcatatgttggtgctgctttgcactgactcatcaactcagggcatcttccctgactgcctggtgtggccccagcactttcacacccgttgttcccctccccaaccccagaaggtcgtagatttactctgtcggttcttctttgttgggagttcaccatgaaaagtactttgcaggaaaagagcaatgatagaactggagtagctcctcgcatgacccacctgtgcccgttttccagcatcctgccacccagccaggtctgtctcctccttggcccgttctcctcactcaggttctctggaagttggcacagttttactaaaataaaatcagcattcatagcattaggactatgtaaacactgttctcaagcaagccaagtcatgtgtacttgggtctgattctggactttgtgtgtgagttccctgggctgctggtctccgtgcccccagcctcgctgtcttaatgagaggccctaggggagcctgcagtgtctggcaaggccaggttgccctcagggctttctgctgccatgattttctggcccttcgtccctgtttgtttttccctgtgaccttcagtagcagcttagctccttggggtatttactgggaatgcattgaatatgtgaattaaacgagcgagagctgacatcttaagaatgttgactcagcccacccaagcagggagcatcttcccatttgttcacgtcttctgtgttttccaggagagctttgaaaatcttccatgtctgtgttttgcacatttcatgttaaacttattcctatgcattcagtctgctctgtggctttcgagatggggttttctttgccatgatgttcctttgtttattatttgtgtatatcaaggctattgattgttctctgtcagttttagattctgctcattcagggttaagggcccaggcaggaggcggagggaggagctttcagcagggcgattccttactcggtctcttcactcttctgccattgctgccatgtgtacattgcaggctccttcatttgagcaaattctctcttccatgctccagatgttttcagaaggaccgcgtacttctgagaaacacttggtaccccagtggcagctgcgttcgccttggtgttgccatgtgacaggcattacttgtttatctcattgttgttcctagtagttctcaatgtttgttgaatgaatatttataaccatcatgtgtggcagttcttatgtagtgttttgatttgtttttttgagaccatctcactctgtcactcaggctggagtacagtgttgtgatcatggttcactgcaacctcaacctcctgggcttaagtgatccttccacctcagctgggactacaggtgtgtgccaccacacctggctaattttttttttttttaattgtagagatggggtctcattctgctgcccaggctgatcttgagctcccgggctcaaccagttctcccaccttggcctcctaagctgctgggattttcggcatgagccagggtgcctggcattacctggttttatagatggagaaactcagagccatgtgtccaggaccacacagctattaactgcaaacccagaggaaagggtaggggatgagttccaggcattccctggagtccgtggtaaatttcttcatttcttctcctgcaacaggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaaggtgggtgtgccttccagcttccttcccgtttctgccaaaagccatgccaattgcggtggtcggagcaggtcctgcccatccgtagcttctgttaagccattgatgtttactgtgtttcaacaaacccaaatgccataactgaacggaccaggtagtcaggcacaaggaggggctgtttctgtggcagaacgtgttcatggaatgactgccttgaagtgtggtgcgtgtggtttatgttccctctgtaagaccagcagttgtttgtaattctccgaggacagacctcgagagtgtctgccttctagtttgaaaaaattgcacaatttctcaatttcgttagaatctttctttaagcatcggtgattttcttagaaaataaagtgttttatatattctaaagggctaattccaagctgccctgcaggtgcaggctctgggcttccctcctcaaggtcagaatcaccagccttttgcaattccgttgcccaggaccagatgaagtgcttgctccccttctgtagctgttgctgtgggtggtgggtgctgactgtcatcctcatcctccagggtgtggtgggtgctgactgttgtccccaccctccagggtgtggtgggtgctgactgtctccccatcctccagggtgggaaccttggtctgtctcagagcagccagctatgggtctcactgcgctctgcgtgatgcatgaaaagcagttcttggagggtgcggtggccccatatgtgcctgagcgtgtctgtgagggcactgatttggaatccagcaaatccgagtcccagtttcggttgtgctgtcagcctcctgggcttctgcttccttagtgtggacaccgcctcctgccatcatagtgaggactctgactccatttcttcacacactgaactctcggttcccgcctaccgtcccgggttcgcagctagcattcggcacaggtggtgaagcagtgtgggcccagagcagagacctcgaggaaggcttctgaccctggacactgaggagtagccagcctcggaagttagaaaggtatccacccagctcctcccgcagggcacagggcagtgccatctctccccgtgtgtatctggataccagcttgattttaattcctttcgttaaatattgagtaaattcaaaacgatcgttgtgaaggaagtaggatttacagaagcaggatgtaatgaaccaccaggcgtgcaccacaggcccctggcgtgtctttctcagctgcagtctctcctttccctgccctcccctgtggcgcctggcacagtgaatttgaatttgtccttccctggctctcctctgtggagcccccggtgtgctggctctcaggcacggcgaatccgggagatcgctgctgatacgctgggcggacgctggcgcgctcttccgcagtgcgctttgctcacttggtcggaggctctgcagattcatgccaccgaccccaggggcctgcagccctgcctcttcccacattcgctgtcccctgccgggaccccgcccttctcagtgccttccctgcagatgggcattgggctggttcccatcttgtttctgctgtaaaccgcatgagtgtttcagctgcccacctttctctccagcactgggtgttgtcacaggttttttttaatgatagactgtggtgtgctctgattttctctgataaccattaagatcgcgcaccctgtgtccgcccgccggctccctgctgctcaaagcgcctatctgctatccacttctctctgcagtgggttgccttttcctatcggtttgagggaattctttgtattccagacagtaatgatttttatgaattgtgtctctcttctcagaatttatgatgtgattttttttcttcatcttcttacactcctgataacttacaaaacttttttttttttttgaaacagggtctctctctgtcacccaggctggagtacagtggcatgatcatggctcactgcaaactctgccttctgggctgaagcattcctcccacctcagcctcccaagtaggtgggactacaggtgtgcaccaccacacctggctaagttttgtatttttgctaatttttgtattttttgtagagccagggtcttgccatgttgcctaggctggtcttgaactcctgagtccaaataatcctcctgcctcagcctcccaaagtgctgggattacagcgtgagccactgcgccccgctcccagttgtgctttttatttgtccttcttgtcttggtgtgctggccgatgccttcagtggagtgaagtggggactgggtggggagcggggagggaggcatctttgtttctcttgtcctcgcagagggagagtttctgtgttcagtgtatgatgtttgccccaggctttttgtaaaacaaaaacaatcaccattatcgaattaagaaagtacaattcttaatttggttttttaaaaaaattgtgactagatgttgatttgcctcccttggttatttgtatgtgtgtgtgtgtgtgtgtgtgtgtgtgtgtgttaaagtggtcacagtacttttctcccttaggctggtgctacgttgaatgatactgtatgaccatctcctgttatacacacctttctttttggattaacctgtgttatgatgaatgatctgtttcatgcatggcttattcagtttgcagccattttgtttcatatattaaatctgtgttcgtgagtgagattggacagggattcttctttgtcttgctgtccttgcctaggcggagtaatcaataactgtggccttagaaaataagctgaggaatgttccttctttgtatatatacttgaatagtttttgtgatgtttgaagtatttgttgtctgaatgttgtggaacttacaaagaaagctctctgggtggtattttgtttgtggagagtttttgacttactgatctagcttctttcatggttaaagggtttttctgttagctttgccaactgacttttgcaggaccttgtccatttctactaagcttcccgatgtgttgacataaactggctcacaatacccctttagaaactcaccagtatcgggggtatctgtgagtgaggtgccttcctttgctcttggtgctgggtatatgtgccttctctcttttcttgttgattattcctgtgaggagtttatgtaccttttatcagtcttttcaaagacccagcttttaccattgttgaccctccagaggatggaaggaacagtaggatgaatacctttatactgttcccctgttgccaatttgacacttttttttttgtcccctgaaccatttgaaagatgcagacatcctgacactaagaacgaggatggctttctgtatcaccacattaccgtcaaattgctcaagaaatggaacatcagttctgtgtcatttactatagagtccatgtttgtattttcccaagtgtttgcaaaatgtgcactaaattagtaggcatttttttacttgttgattttgttgtggacccagaatctaattaaggtccatgcattgcatctgttccttatgcgtttttagttcctcttgcctttcatgttatgacattgactttttaaatgactttttaaaatttaaaaattttgtcttcttttgggaagttaacatatagttatacatcagtctttttttttttttttttttttttgagactaagtctcgctctgtcgccaaggctggagtaacagtggcgtgatcttggctcactgcagcttccgcctcctgggttcaagcaattcttctgcctcagtctcctgagtagctgggattacaggcgcccgccgccacgcccggctaatatttgtattttcagtagagacggggtttcaccatgttggccaggctggtctcctactcctgacctcaagtgatctgcctgccttggcctcccaaagtgctgggattacaggcgtgagccaccgtgcccagcagtcttttttaaaataatagacatcattttttttaagagcagttttaattttacagaaaaattgagcaagtttattgagttatatacttccttcccctcattttcctctattgttaatatcttgctttggtttgttatgttttttacaattggtaaactgataatgatgtgttataattaatgatgtccatatttacactagggctcactcctagtgatgtacatgctgcagattttgctgaatgtgtgatttcctgcaaccaccgttaggttgccacacagagtagtggtgtccttcaagtcctctgtgcgccccctcatcttctctcccctagcatttggtcttttccagaatgtcctatagttggactcatatagtatgtagccttttcagacaggcttctctgactcagtaatatacgcttaagactcctccgtgtctttttgtggcttgatagctcattttttacaattactgagcaatactctactgtgtgaatgcaacactgcttctttatccattttcctattcaagggcattttggatactctgaacttctgacaattaggaataaagctattattaacgtgtgcaaatttttgtatggatataagctttccattcatttgggtgaatacctgggaatgggtttggtggatgattcggttagagtatgcttagctttataaggaactgtgaagctgtcttccaacatgtctacgccgttttgcattcctgccagcactgaacgagagtatctgttgctccacatgctcatcagcatttgatgttatcagtgtttggattttagccattctggtgggtatgtagtaggatcttattgttatttcattttcaatttcgtaatgatgtgaaattgggcgtctttgcatgttcttatttgccgtgttatatcttctttgatgaggtatctcttcaggttttttgcccattttaagaatcaggttgtttttcttgttgctgagttttaagagttctttccatatttcagatgccagttttttgtttttgtttttgttttgagatggggtttcgctcttgttgcccaggctagagtacaatggcgtgatcttggctcactgcaacctctgcctcctgggttcaagtgattctcctgcctcaacccccgaagtagcagggattacaggcacccgcctccacgcccggctaattttgtattttttttagtacaggctgatctcaacttctgacctcaagtgatccacctgcctcggcctcccaaagtgctgggatcataggcatgagccaccacacccggcctggatgccagttctttatcagatatgtgtttcgcaaatatgtccacccagtttgtggctgcttgttttcttttcctagtagtggatgttcgctttttgacgagtttggaccagtgatcctccagtatgtcccacattctagtttaatttcttcgctttttcacaagtttttgtcaaaccagattaaaaaaaagcatgatcaaaccttgtgctgtccatagtagatgtattttaaatacaaagacatatgaagtttgagagtaaaagaaagggaaacgatatactatgccaatactagtcatagaaaaccagtgtggctctattaatcagagaaaatagactgcaagatgaggagtattattgatgataaagagggccatttcctcatgataaacaggccagttcatgagccaggcacacaccatcctgagtgtgcgtgcgcttaatatcagagtttcaaaggacatgcagcaaaatgaacagaattaacaggaaaagtatgcaaatccataatcatagttggaggttagaagatcttcttttagtaattgatagattaaactgatagttaaaaattatagacaaaattgatagttaaaaaatttttttttgagatggagtctcgctttggttgcccaggctggagtgcagtggcgtgatctcggctcactgcaacctccacctcctgagttcaagctattctcctgcctcagcctcccaaggaggtgggactacaggcgcccaccaccacgcctggctaactgttttgtatttttagtagagatggggtttcaccatgttgactgggctggtcttgaactcctgacctcaggtgatctgccggcctcggcctcctaaagtgctgggattacggatgtgagccaccgtgcctggccctgtaattaaaaactttcttattgagaaaactctaggcatagtatattttttctagtccaaagcaaaagccagtattaatgtaaaagacctagcaatattatcaatcaccccgacttaattaacatttatacagccgtccacacaactgtagaatatacattctcaagtgcatgtggaatgttcaccatatgctgagccataaagatgtctcaataaagtttgaaagattaaaatcatagagtatattctctgttcttgaaattcaaaattatggaatatctggagaagccccagatacttggaaatgaaataccacatgagtcaaagacaaaatcataaaagaaaataaaaaataattcaaacctaaagataatgaaactatgacacccaaatttataggatttaggtgtaacagtgcttatggaaatgtacagctttaaattcttacatagaaagatacattttagaaatatatttaaaatgaaaatctgtttttttgaaacggagtctctcgctctgtcgcccaggctggagtgcagtggtgccatcaccacccactgcaacctttgtctcctggattcaagcaattcccctgcctcagcctcccaagtggctgggattacaggcgtccaccaccgttcccagctatttttgtatttttagtagagatggggtttcgccatgttggccaggctggtctgaaacccctgacgtcaagtgatcctcccgccttggcctcccaaagtgctgggattacaggcgtgagctactgtgctcagcctaaaatctaatattctgccttaaggaaacagaaaatgctgagcaaattaaactcaaagcagaaggaaagaaataacaaacagcagaaatcaataaaatagagtacaggcaacagagacaacatagctaaaatgtgttttttttgaaaggatcagtaaaagttgacgaatctctacgtaggtagatcagtgaagaaagagagaaaacactttatcaacatcagcaatgaaggagaggatatccccacatatcctataagcattaaaaaggtaagggaatattattaattttatatacatttaaatacgtaattaaatggacagatgccttaaaatacaacttaccaaaactgacctaaaatgaaatagaatatctgaatagccctatatcaatcggcttctttccaaggccatgccaggcatttaatccctgtgaggccaggggctttttattttgtttactgctacattccaagctcttaagatagtgtctgttaccctagcaggtgtttggtaattgtcaaccacatgggtgggtagatgaatggatgtttttatttttatgttttttttttttcaattttttatttttccataggttattggggtacaggtggtgtttggttacatgaagaagttctttagtggtaatttgtgagattttgctgcacccttgtagtcttttatccctcgcccccctcccacccttctccccaagtccccaaattccattgtatcattcttatgcctttgtgtcctcatagctcagctcccacgtaacagtgaaaatatacgatatttggttttccattcttgagttacttcacttaaaataatagtctccagtctcatccaggtcactgtgaatgctgttaatccattactttttatgactgagtagtattccatcatgtatatataccatattttctttatccactcattgattgatgggcatttgggttggttccatgattttgcaattgcgaattgtgctgctataaacatgcgtgtgcaagtatcttttgtgtataatgacttattttcctctgggtaaatacccagtagtgggattgctggatcaaatggtagttctacttgtagttctttcaggaatctccacactgttttccatagtggctgtaccagtttacattcccaccagcggtgtagaagtgttccctgattaccacatccacaccagcatctactgttttttgatttttttattatggccattcttgcagaggtaaggtggtatctattgcattgtggttttgatttgcatttccctgatcattagtgatgttgagcattttttcatatgtttgttggccatttgtatatcttcttctgagaattgtctattcatgtccttagcccaatttttgatgggatttttttttcttgctgatttgtttgagtttgttgtagatttccggatattagtcttttgtcagttgtgtagattgttaagattttctctcactctgtgggttgtctgtttactctgctgactgttccttttgccgtgcaaaaggcctttagttaaattaagtcccagctatttatctttgtttttattgcatttgcttttgggttcttgctcatgagatccttgcctaaaccagtctctagaagggtttttccaatgttatcttctagaatttttatagtttcaggtcttagatttaagtccttgatccatcttgggttgatttttgtataaagtgagagatgaggatccagtttcattctcctacgtgtgacttgccagttatcccagcaccatttgttgtaaagggtgtcttttccccactttatgattttgtttgctttgttgaagatcagttggctgtaagtatttgggtttatttctgagttctctattgtgttccgttggcctatgtgcctgtttttataccagtgccatgctgttttggtgactatggccttatagtatagtatgaaatcaggtaatgtaattcctccagatttgttctttttgcttagtcttgcttcggctatgcaggctgttttttggttccatatgagttttagaattgttttttctaattctgtgaagaatgatggtggtattttgatgggaattgcattgaaatgagtggatatttttactgaaatgtcatctgatcaccagatgtggcatgcacccctctccttgactctttagtcctcctggtgtggtctgtttttctccacagctttttcccagtcttatgtatattgtctctatgtcaccattaaaatgtgagttccaggataacaaggtctttgttctatgaaccgctttatcatgggtacctaaaaccaagcatctcagaacataggaaatggtaattcaatgttcactgcattctacgctaatgtcataaaagcaacagaatgatccctagagccaagtctttcttggttttttttttccccactgtgttattccattagtttatcctttcataggtttattttgcacatcacgtggcatgccaccggagacaggcgcgtgttcttccagatctagacagccataagctgcactgtagagcatgcagtcctgttgccgagtctttcagccttcagataggctccctccatcaaaacgaagcctgcagcattacagatgatacactgtcggtacacaatgtaagatttaaaaacatttaaacatgctagttttaactatacttttctttttgtttaatcaccatttattctgttgctggttgttttctcagcctcagcagaaaactgaggttcaggccttaagcaaaatccgggctcagattttccccatgcaccgccctcccttgcattcccctgtctgtgtttcaggcaattaggactggcagctgtagccattaagaattcacgtagcggaacgtttatcgggagaaggattaatccactactcgaatactcccaattagcttttagaccctgtctgccttttcttctttgcaaaaggagaaaggtttttcccacttgatacattttttttctctgctttttagagttccattgtgaccagaagctatttccaccctttgctgtgtacctaggcacaaagctacaaggcttttccctgtgtgtacagctcatggtgccctctctaggtaggatgagctttgctccaggttatctgcctttccttaatttactgaacgtaaagttggagttttatgtggttttgcatttttggtttaggataatttttaattcttcagtggtcttcctgtggtgtttacaacctaacccctaccctctgccaaaatcatcctcaaaggccatttttgtcttgcactatgttctacccttacccctccggacattaaatagggacataaaatggatcttatcatggagagcacagacggaaagcaaagactgttttgttctgattgttggttataagtctagcttaaagccgaattgcatgatgatgtattgtgataatgtagggaaaatattggccccttcagagagagagagagttgtgccagcccagccatggtgggcaggcaaggttggagggggcctcctggagaaggcggtgcttgctcgggctgagtcttacagaagagaacaaaggcaacagttgtccctgagaggggactggaggggatgatctcagaggaagtagatgatataataaaccagcatggtattcattggaaactacaagcagttctgtgctatgggagcctggagcctgaattgggtttcaaaagaaagaaggccagaaagtgttccaggctaaggcatagagcacctcgcagactcttagggatgtgggcttagataaatccttttgatgccgtgtgaagcctggctctggggagaaaagactggctagagaaactccaggtagaaggccgtcgtatacaagaggccagtggcggcaccctgagtcaggctggtggggcgaccctcaggaccttcctaggacaggtggaggttgagttagagggagcaggtgagacctggactgtgaccaggcaccagaagcgagaagaaggagcttgtgggcatttgttctcaggttgtgagtaggccggaggtccatgagtatggggtcgtgagaagtaggggcagacatgctgcgggcggttcccaaaatacagtttctagagccgaagaaggccaagagagtgaaatctggggagcagaagaggatcctggcaggtgatggggaggagaattgggagaaaatggcatgggggaagccgggaagggtacctgtcagcccgggggaacagagatggaattgatatccattattccaaggagtctggccctttagcaagaagagcactttatattccaagtgaagcagtcctgttcaaaataagcagctccccatttctgagaagatgctgagtacatcttctgccagagaactcagaatgtgaatcagaattctcagccctattaaagtggcatcctctcagggctcgttcctgtaaagccccttaagggcacagccttcctttaaactctcagccaggaactgtggtctcatctggatttgccgccgcagctttccctggactaaagatggacttgtgccaccattctcagaggagggcaaaggacaggggtcagcagattcctcctcctcctgaagggggttcttgaatacatatcatccagaagcagggggtcgtggccccgaaaggtcaggagtggggggaagcggtacttgtgaacagacaactcgggagtatacatcaccagtaaaccccagtcccgtaaaatccgtaaggctgcaagcttattgtcattggtggtggtgtttttggtacttcctctgcccttcttttattacagttaaataattattccatgagcaattctaaataaatattatttaataggatttattggttttttgtttttttaattgggattgtcattatcaaatagatgcctcttgtgttggtatacagttaattgttgcttctgttgaaagatggatcatgggccgggcacggtggctcacgcctgtaatcccaacactttgggaggccgaggcgggcggatcacctgaggtcaggagtttgagaccagcatggtgaaaccctgtctctattaaaaataccaaaaaaaaattagccatgcatagtggcgggcacctgtaatcccagctactcaggaggctgagacaggagaatcgcttgaactgggacttggaggttgcagtgagccgagaccgtgccattgcactccagcctggacaacaagagagaaactgtctcaaaaaaaaaaagatggatcataaagcttttgaaatacactattatcagaaaaatacgtgatttttaaaaagtgatatttatgtcagaccacaattatcatttgttaaaattgttactttattcgtcttgagaatctagcggtgtccaagaaaaagttttatggtaaacttgacctttcttttctgagaaattctagcattttgtgtttgcttacagtagtagaaggccattaacaaaaactccatttctttgggagaagtgctggaaatgtttggagtatttctttatgagagcttaaactttaacaaacaaatgatttccttgatgccaagagatacaaaacctgagagtgcagctgcactgacttcgcgggtgccctgcatttaaaaccacggtcatagcgctgcggtgcccatgcttgagtgcgcccagcatcacctgcaggctcacggagccacagactgccaggccctccctgagcctctgcttctgtggccgtgggtggggcctgacgatttggctttcttgggtgtcccacaaaattgctgctgcggccgcttctgctgctgtctgggttgtctgcctttgagaacccctggtatggacagtgtggtgtgagaggcaagcaggatattcatcttatggtttggggtcactctgcttcttacgtgtcgggagagacacttccccgaccccttgttttccatctctaattttagccgtctagggcagaaacagtcccgggtaaacaccaaggcctcgtgggaggcacctaggaggtgaggaggggctacgtctgccgggtctccaagcaggagtgagaaccagctagacaaggggaggcctgggagtgcgagggggctctggtgacaggaagtagtcccctctgacccggtgacactgtggggagcaggtgatgtggttccagtgctctgtcatcctggggtcagtaggatgaaagatgtcgtagcagcacaggcagcactgtggaaactgttctcacgactgtgagtcattgaggctcctggacgcggcggaagtgcaagcgggaaaaaggatggcaagttgagtaacctcaggggtaagcaaggaggtgtgagaatcactcacttcctcggcagggcctgcacgcacctggtgcaggagcagcagaagccatgctggctcttcctgctgcgtgtgcatctggccctggaaagaggcacacccagcagcgggctctcctggctcacccggggccgtcagggcgctgcagtttgcaggagcatcctttgggctcttacctcagtcggtggggctgggcagctgggtgtctccagcccatcatgctggaacatgctggaagcttcctcagggtactcgggcttattttggtagtcatacacatgaaatgcactttgggggagaaggatgaaatattttggttaatccactgaaaaaatgaatgttggggaacacagccagctttcctgttatttattaataggcttaagatagccagaaggacatttctgctagaaagttattgccagctgaaaaagaacaagtcttcattattatccaatttggtatatatatatatatttcaggtttttatgaagctaagggcaaaggtcagctgcttcctattccttgtggattgtgctgctgatgggaacttcctttgacttcacaaatacaagggattggaagtgcattctttgttatctcatatgtaagatgaggcttttaacacgattttcttttagttaattttaaaatattttattataaaattcattttttttcaaatggtgcagataagcataaaataaacaataaaagttcttcctttccttccctccaagcctttgtgtggcacgttcttggcatgttgcaaagtgccgtcatcatcatcatcatcattgagtttggaagaggaaatgataagttttatttttcccttctcaaatttttgaatttgaggtgtcacaggcaatcaaatgaaaataaccaactctctgtagaggtggtagttgcagctgaacatttttgggacttcaatgtttaggcagtatttaaaaccagggagttatatttgattgcctgggagaagatgtggaataagaagaatggaataggcccctgacgataagtttttaaggggagggtggaagggaggggtcccaagctgggaagctttggaagaatgagctgaggcagccggagacctggggagagagtgtgtgtttgaggggagacggcgcatagatgtcaggtggggcaggaatggaagagaccatgggatgcagcatgtgaagaggtgactatgtgttcagtaatttctggagagcagttaggatcaaaactaggtttgcatttttaaaaaacaatttgaaataattttaaatgtacacgagagttgcagaggcagcacagagagttcctgtgtgtccttcatccagctacccagtgtcaacctcttacatgacctcagcacagcgatcaaatctaggaaacatatgttgttacagcactgccaaccacacacagcctccttggtgccagcagccttgccgctgtaatcctctgtatgtcttgtggtccagcccaggcccccacccacattggctgccttgtcctctggtcctcccagcctgggatggttcctcagctgttcttgtctttcatgaccatgacattgtaagatgctgctcaggtgttttggaggatgtccctcactttgggtttgtctgatgtgttctcatgatgagattgaggatcaaagttttgggaagaataatgcagatgggttattctcagtgcatcaggtttgggggtgcgtggtgtgtgtgattcttattactgcagataccaaccttgatcactaggctgaagtggtgccttgtgtgtttctccaatgtgaagttgttattttcttctttataattcataagcatttgaaggagatactttgagagtatgcagatatcctgtttctccttaaactgccatgccctaattctaacattcatgtgtaattactatcctggtgttctaatggtggtgctgtacctccctatttccttccacgtttagtaactggaattcttctgtatgaaagaattgttgcttctcttgttgtttatttacttggttgtttgtttatatccatatggagccactaatatttattttacttcttgggttataatccattattattatcattatttattttgttactgaaattgtttcaactttgaccactgacacaccttctagcattttctctaccacagccctggatcaaccatttttccaaggatctttggcttttttgagagtggtatttagaaaccaagatgtggcctctttgtgtgctcgttactactggagcattagtgttactaggcctaggccctctccgtggacttagctaagtgatgcatttgtgtgtagtaagctgtaaacacatgcatattgatttgcgtatctatgtacaggtgtggaaactagattttaatgactaaacaggaggtaagggactagggactggaatagactaatctttccagaagtttggtgatactactgaataacactgttttttctagctttctctgtaatacaatttttgcaataaatacatagagagcatgtgattagaggagcctgtctgttggggagacctcgaagaaagaacaaggctaagcagggatgtttagtttctgcaagaggtaacttatgtttgtagataggagaaagggggttgctgaagaaagtataaatcagtggagtaaaggatgagaaatgggaaggtatgagaagattaattcaggacagagatacagcatttgacttggcaagcccaagcactcttctctgagacgtgggagggaaggagaggtgaatacaaatgtggtggagctttgaagctggacatgagagctggttccccttggagcctgtctcctgttaagtgagaagccaggccatgtcctgagaggtgggggccatgagtgccaggatggaagggtcaggagagaggagacatggcaacccaccccttcctcatgtttactgcctggcatagttggcatttttctttatgttgaggaaaatgctgctatgatctgattagtaggtgctaaataccccagtttgtataaagtaggatggtatctttgcagggctaatgaaatggccaaatcaggtttgggtaaggccacctggagatccatgtccttcagctgatggcagtcttcctgtgtatcccagctatccacagagatgcttgcgagttctaccatcgcaacagcggcgaggccaggttctcccatcccaacagtggtgaggccagaaatttccaggctcatcacatctacctgctcagcctgtggtgggttggagttggggttgggacaccccacctgcccttccagagggcgactgtctgcacctgcccagtgtgccccccgttccctcctctgcagtgtcagagctgctgtgcctggatctgaggaggggccgtgggagaagaagccgcccccacgacacttgcgcttgccttttcagctggagcacggggtggcggcaccgtgtcgttctgcccacctcacccactgggatgcaaacttgctgaggccagggcttcttcctgccatgccttgccaccacgccccttgcctcccctgggacatgccgttctcttctttgtactcatctgtttggtatgtgaggggttttgcgttttgtcttctgctctgtaatttaaagggataaaacgctcacatttaacttaagccaaaacccagtttcagtctttccaccagaaatccctgagatgtagaattgtgggaagctccttggaggctggcgggctgctgggctgcccctctgtgggaagacagcctgcaggcttcagtgggctgggctctcccggccatggctgccttggtggctaactcaggctgcggcgacagactggtgaggcaggcggactcttcccctgatgtttaatataacctgacagataaagtggattgtaatgaagaaattatctaaaacccatttctatttctttgtttgaaaagaaaacatggccttgaatatgattcttggagaaaaagaagagacgctttgattaggaattattctctgtacttttagttttggatcaagaagaaatgaaaaccattggccacaagctcttgagtgttccaagcagccttccgtgtatacagggggcttttcaattctgggctggtgtgggttggtgcagtcaggatgacagaggaatattccacaggacaacgaggagtgactctactgtgggcgttgtttctgcccctgcagccggggctgtgaggctgcaggctgccctttgctggtttgcaggggccataattctggcctggagcttgacaaacgacccaggacctctgagatgggaaatgaggtctgcatcccgtgttctaatcaggattcgctatcaaaggtcattttccacactgtggcttaatagagttggttttatattccctgagggatacagacttccaaattgttgcagtctcactaactgtaatgtatacagctcatgtttgaaaggaaatcgcctctcctccaaggcagcggttctcaaccagggaaacttttcccctcaggggacactgggacatttggcaatgtccagcaacctggagattgtcacatctaggtgtgggggtggctgggtggtgctgtggaagattgtgtggtgcacagggcagccccacaaggagcggcctggccccaaatggccctggtgctgagagggacagacgccgctcacagagaagcgaccacagaggcccacatccaagcaggcttcccagagcaggcggggctgggaaagctgttctgtggcgcagcatcccagtggctgttacggggtgaaagcccctcttagaatttaaagtcctagagcagagaccaactggggccatccatggccctgtgccgtgctgcctcctggacgcacgctaggaggtggagatggtccagccccagcaggactgggccacgaggaccctgccggtaacctggtgctcgccgcccacagatcacggggcgtggagggagagactgccagtgctgtcctagtgcagcagtacctcatggttatgacggatcatcttcctgaactttgcatctcagacatttaaaatggagattttgattttgattttggcaaatgtggaaaatagatttcagctcaaaaagcaagacctgagaacatggtgtgttaaaatatctttcatttcatgccactttgcagccctgggaccctcggggttgtacctagaaggtagtaaagatgacagcagcccccgtttcactgatggtggcgcagaggacgttgtgaggtggctgtagggtcaggtggctgtagggtcagggctgggcaagttgtattcagatgctgttcgctaagcccagaacattataggaggtaaataaatagcacgcagtgttctgggggtaaaaagatacacccatgtcccaggctgctgccaaaatcctttctcctgtcagcgtggggggtgatcctgcccaattaaaggacgtcttttggcccttctttcccttggcagcagcatggaagtgggtgggggaggagaggagcatgcttcccccaacccctggggacctgtgagcgcagcctgcaagctccggctccaggaggaagcgtgctcaagtgcacctctgaccacgtcacgctgcgagaacgtgggcgctacacctccgaccacatcgtgctccgagaacgtggacgctgcacctctgaccacgtcacgctccgagaacatggacgctgcacctctgaccacttcctgctccgagaacgtgaactctgcacctctgaccacgtcacgccccgagaacgtggacactgcacctctgaccacatcatgctccgagaacgtggacgctgcacctctgaccacatcatgctccgagaacgtggacgctgcacctctgaccgcatcatgctccgagaacgtggacgctgcacctctgatcatgtcacactccaagatcatggacattgcacttctgatcatgtcatgctctgagaacatggacgctgcacctctgatcatgtcacgcttcaagaacgtgaacactgcacctctgaccacgtcacgccccgagaacgtggacgctgcacctctgaccacatcatgctctgagaacgtggacgctgcacctctgatcatgtcacactccaagatcatggacattgcacttctgatcatgtcatgctccaagaacgtggacgctgcacctctgaccatgtcgcgctggccagaatttggctgcaggacagacttcactggaaaggaaactgggccatgtgctcagctacaactgctttagaagagagagaaaatcagatattagcctagcagtctctaccacactggcatttagataattttcagctttttttttttaccagtcaaaacatctcatgtacaaatgcaagtatttctataggatggatatctagaagtagtcagaaggaatgtgcctttaaaatttttgttaagtacttcccaattgccttccatacaagcttcattaatttacattcccaccattgatggatgagtgccctgcatcctcccacaatggggcattattcacattttatcctgctttccactttgctgaataaaaacagaatggatgaatgaatggatgggcggatggatggatggatgaatggatggatggatcgataggtagatagatagattctcattgtaatttgcatttctaataaagagcatgaaacttagaatcatttttgattcatttttcttctgtgaattgcctgtttgtatgttttgcctgtttgttttcgttttgtcccttgttgatctgcagcagaagtttatatagacacatctaaaaaattctctgtcatgtactgtgtacctcctttcttctaaaattgctagtcattgatatgtctttattagaattatagatttttttatcttactgtatcagtcagtctcaagacttattaggttttgtgacttgcttaattaaggcctttcatatgccaaaataaatgaaaattttcctgtgcttttacatttaggttttcagtccactctggggtgtgtgtgtgtgtgtgtgtgtgtgtttgtgtgtgtgtgtgtgtgtaatctcagatagcaaaataccaaatggctggttagagtttccagcatcagttattgaattgttaattccttctttgcagatttaaaatgctgtcctcattagagttacgtatgtgggtctatttctggactctctcttttctgttgatttgtttgtctccctcactaataccatcctgtaattaccatagatttatagtatctttaatatctggcagtgtgagtccctattcattattctttattaatttttttttgctcttgtgcttttttttttctctgtactatataatcatcttgttaaattccgtgaatggaaaaaacccagaaggtattttgattaggcttggactgactttctggattcattaggcaagaattgacatctctagatccttcagtgggtttatttacagagagcatttccaggtgttctattatagagcagtgattataaacagtccaccaaacgcggacagttttaacaacatgtttggcagagcacaggtagaatggggtcctgcccacgatgatgtacgtgtctccacacaccccccacacatctgcgtcgttggtatactgtatcatcatgtctgagatataacttacgtctgagatgtagctgatgtctgaaatgtaacttttgtctgcttctttgctgtgcacggacaaagcttctgcaggcttcctgcacgccatacttccccaggctttgctggatctggccttctgtccctttcctcttgagttataaacaatcctgtaggcagtaccagcggcaggatatgtggcttagctgctaagaaataaactcacttttactgtgactttgatttttgccaatttctgggaatttgatttctgccacagcttcactacttacactcttgatgtccaaggaaaggtaaataatgaacgtgttctgtggagaagaattccttaaaaatgttagctttgcgttcggattgtaagtgtttctcaagtgagatgagaacattctcctctgcatttaccagaatcactagtgtctgttcaggcgctgaacagtatggtgtgttctgaaaaatgtttcactcagcagattagtgttactaggttattgttctgtgactgaaataaatttatacagccaaacccacttataccccttaagtatgatctttcaaaagtcatctcaatgacaaagtgcttatggacctctctgaaattaaagggacagtggcatgcaaatttgaggacccggccaactcttagagctcccctcccttgtaaatgatgtgtgtgttgtgttatataaacccagagatgtgacagagttaaaggacaaatggagacacggagtgaagagcacgtgtgtgagacagctgtgggtccatggagggaggccccgcggcgggaactgaggcagccatggggtacatgagggaagccccacagtgggaactgagacagctctggttccatggagggaggtcccgcagtgaaaactgagacaagtttaaggagttgaccagcagctgaacccagcggcagctgcggaggagcctggggctagggatgatgactttggcagccacctggtgcgggcgctactggagtaaagcagcatcagaggagatgtggagaagttcagtttgatggtttttgttttttgagactgagtctcgctctgttgcccaggctggagtgcagtggcgcaatcttggctcactgtaaccttcgcctcccgggttcaggtgattctcctgcctcagcctcccaagtagctgggtttacaggtgcccttcaccatgtctggctaattttgtatttttagtagagactgggttttaccatgttggccaggctggtcttgaactcctgacctcaggtgatccacccatctcagcctcccaaagtgctgagattcaggtgtgagccattgcgcctggccagtttgctgttttttatagttttgtataaaggctacctcagcgtctctccagccaccaggctcaatgtgtgtgccttttgtaacggtgcagtactcaccagcagcccatattcctgagacgcacatgtaacgagcgcactttgtgtgttttctagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtgagcgctctggtgcttggagagcggtgctgggtttggttttgttttccctgggggtggggtttgggtggggaggttgggaggtgttggacatcctctgaatggagcagggctcagaatgccaagggcaggatggcatattcaatgctgttgagctagggaggcactcagcacactttatttttgaaacataatcttgttctgttgcccaggctggagtgctgtggtgccgtctccagtcactgcaatgtctgtcacctgagcccaagcaatcttcccttctcagcctcctgagtagctgagactacaggtgcacgccacgccaccatgcctagctaatttttgtagtttttgtagaggtggtgtttcgccatgtttctcagcctggtctcaaactcctgggctcaagcaacgcgtgtgcctcagcctgcaaagttctgggattacaggcttgagcactgagcccggcccagtacaaacctacagacttatttttacatctcattttactcagtgtcatttttaatccaaacattaattgataacattcatagggtcgatttgtgccccagcagtctctgcctccaagataaatgtgaaaataaagcagacacatttattttaggagaaatggacccacagcttcagttccaccagtgcctttgttcctgccccggtttctttttctgttgtgttaaaaaaaaaaaaatccccgaaaaccactaagctaaaatgatagaaaacaaacgaaaacagctactgttgtagcgcccacttcaaaaagcagaaagcctgtgcaccgctctgctaatgaagagacattttgcttggttgttttaattaatatttgatgtttgaattaaacagtgaattctgaggacaaattgaagaggcagtttcgattaagaggcctccatcttgtggcctgcacaagagtgtcagaatgaaatattctgcagcctcaagggggtcatgagttctactggttgcagtataggaaattctcaatttaggagcaaaaatgatcttgagtatgtttcctcaagcctttttgaatatattcaattttaatgtattatgttttcacatttcatcatagaaaaatgctgaaacaatcagtaacaaaatttgaaattctgtttggtagattttcacattaacatgtgtacagttgaatattttataattattaattctttatgtggaacaccgcaaaagagtgactgataagtataatgtggtttatccatgaaaaaggatccacatgcaacaagtttgtttgttttgttttctatgataagggaaagaaagatcaaggtttgtatcatcagatttttcccttgctttcaggcatttcatcttggtttacccaggggataggttatctaatgagcattaagaaactcaaagcattgagaggtaatttatttttccttgcatcaagtaataaatatcgcaaaaaaaaggtgatttttttacatttataatatgtaaataaaaatgccaaagaatcctgcctgagttctacaccagatttatgggctggagagtggttaagggaaagaccaatacatcagcctcagttaattaaaacatgttaaatagagacccgctcccctttcagcagaagaccagcacctccagctcatgcataataccaaatgcttgcattccagcgctttgagcatgtgctccggcagtgctgtgtgtgctctctgtgtgttgccagggattaatcagcctaagacactgttcatttcatcaagtgtaacagaaaagattcccatgcatcttttttaggaaaaaaaaatgtttgactcattccacatgaaagagatcagatgaaaaatatgttaactgagttggcgaatagatggcaaggcaatgcgataccgtatgtctttaattagctctgatttttatcttcgttctttaattacaatgtagatcagtcttgtgtgtttctattacacttactattattggctattgttcacttggtctcttataaaaacagtggaaattaaaatgataaaattagctcctagctaatagcttaatgttcattttagtaatttcactatctgctagagaaacagcaatcctgtgtagcctgttagggtttttcttttaaaatattctttgcctctttacagctggtcaaattctttgtaaatttacaatatgttttaatactttttattgtataacatgtgagctgaaagaaattgacaggtgaatgatttgttccagggtttaaaaaataaacaattgattaaatataatgcaagaaaatggttatttggaccagaaagcctccaaataataaacattaacacaaatatgagtgacataaattttaagagatggtgatcagctttcatattcttagtggcacagtgcttgtcctgggaccaggaggtttatttattgtttacttctctctcagaggagtgctgtaggtagagtagaagacgacttcatcaaagcacagatacagtattgcacacacttcaaaccatcagagccggaaaatgacatatctgtcactcagtaatccttcttatatttttattgtgtcatatttctttgtaatttaaaaattaaggataatattcaagtctctccgctttcagtcttcttttataaataagtatattttaccaaattagtatatgccatggtttgaaaaatcaaataatacagaaggtttatgatgaataaagtagtccctggccccacgctttctctgctgagactctatgaccaaaggcacctccttcccctgtttccatttctagttcttctggagggtgtctccttccctgtagatgacatgctgagaccactgcttcttgatttgtcgtttttagattatcagtgggctttgtcttagggtacaaaccaagaacagagctgccattaagttctgtttaaagaagggagaaacgatgtggaagcctgttagcaaagaagtcaattatgtgtagattacatgctggtttaaattcctatgtgttatttgtattcagtagtgaattctaaagagaaaattctagattgaagaggctgcgtcactcacgacgccttcttgcgttccctcttattcactctattgggtttctttatactttgtaaactttgtggtttcaagtaatatccttatgcttttatttctagttttatcagtaatagctcatttcttccattttcaaggctcttagcttccttgtactttcttctgccttttttcttttacagcttctgttatctgcactttctgtgattgtctttcgttctctgaccacgattaacacctctgtgcttgagtggagattgattctataggaagacaagcattaaaccttgtacctgattatgaccacataaatattgctcgctcagtggctagagtactgtgatttccatttttataactgttttcgtttgtttgcttttcctggacatttcctcttttcttcttgaattacctatcgttaccacttcctccactgatagatccacaaggagagcggagagcacagaaggcgccctctcccctcacatcttccaagctctcctgcctcgctcagccgatcgtgcctgtggcctgctccccggcgtcagctggctcccctttgtaattctccaggatccgtccctgtgtctagatcccacttcttcccctctctcgattttctcctttgttctcctaggggaaatcctcaagcactgccctaagaaaggatgtttggcagtctgagaccatcagtatttgaagcagtggaagtaatgaaaaatctcattactgggttttaatcaaatagcagtttgtctttttcactaataaggtctctgaggcaaatgatgacttttcagcagtgccactggggaccaggcatccttagccggctggctttatcctcatgtttgcaatatgcccaccacatctgcaggtgtttcatctgcttgggaggcaggaggaaatggggaaggggcagtgctggccacagctgtctctttataaggaagaacagcccgccctctgtatctgtggcttccacatccttggagtcaactaactgtggctccaagacattcggggaaaaaaaattgcattgtactggacatgtacacttcttctcaccattgttccctaaacaatatagtataacaactacgtttacagcattcacatggtagtagatgttataagtagagatgatttgaagcacaccaaagtctgtgtgtgggttatatgcaagcaccacaccattttatatctgtgcattggcagattttggcatccatgggggtctaggaaccaatgccctgtggatattgagggatgactgcaacaagcagacttcgctttagaccgagttggccagagccaggtcacgtagcaccccaggtgtggttgaggggtgactaaagggagtggacttgggggtggctgtgagatgatccaatgaggaccatcagccacattacctgggtaatgtcatcattctaaccacatccattatcgatagtgtagatatggaattttaggcaattttcactcttccagtggtagccctgttactccttgcagtggatgagtagatgttcttgataagtctgccacctccatccagataaatgccataagaggaatatttatagtcatcgtacacagtatatgtattgactgagttggagagagagaaaaaaagagaattcaaatgttttttaacaacttttatctggatactaaatccttagcctgtaaactagaaaggaaggtgaagtcttaaagaaacagatgctcttggaaacggagcccatgaagtcttgtccgtcagtttcttctagaggatatttctcaagggcagtcacagctcaccgtcactgaagacggcagtcaagcccggagtcaaatctaggcgagtttctcttctttttaatgggaggccagtagcgagttgggcaggcggtaaagataataatgcctttcttctgctgggacagcacgggctccactgccccagtaagtcttgttctgcacgtagccatctgcttttggtttagggctggagcataggcaagtttttggtgggagccatggaaatagcctgagaatgacttcctggagagcaggttgctgtgtgtcagaagagtcttgtatgaaagttcagccctggccggtgcggtggctcacgcctgtaatcccagcactttggaaggccaaggtgggcagatggcttgagttcaggagttcaagaccagcctgggcagcatagcgaaaccccatctctacaaaaaatacaaaagttagccagctgtagtggcacgcatgtgtcatcccagctactctggagaccaaggtggaagggtcgcttgagctcagagctggaggctgcagtgagccgtgattgtgccactgcacctcagcctaggcaatagagtgagaccccatctcttaaaaaaaaaaaaagttcagcccatgggatcatgggcacaattcacttctccactattcccccgcactctgcaaggcttttctcaggatgcttccgagtaactcgtgtttgtgtggtgtctctaaacacaattgtgtggtccagtcctgccacctgtagcagtacactcccaaagcacagaaacctgtccgacggtcactcactgccacagcgagaagcttgcttgggtccacagcatccccaaggctgcagtgacttaaccgccccccgcccctaccaatgtgaaaacctatacttaaactgataggtgatacattggcctcctgcactgatccccgtagctaaattttatgtcaaataaatattgtaattctgccaaaaatgactaacgtctagaatcttcaagtttcctcaaaaatattaaatgcatatctcacagatctaaagtactcatgttctgaaatcttcttcatttctttgctactcttgtagacaggcacactgcttggctggcatggaattctgcagcaaaaggcagttctcctgctgaaggttgtggttgtagtgattgctgaataccatcagttagttctttgggtacctctcaacaggtgtgtttcttaatcactgtttcctaaattggaatttgtgtgtgtgagtttgcaaatcttctccacggactcaccgtcgtcatggcatttgtgattcagaggagggatctgcggtgccgattccacaggagctcaggctcgcctgtatttctctttcaagcaatgattttcataagtgctttcccctgtaatctcatagttttgtcatttgtaggcagtagggacgtgagctgacatgtgttaggtcacaactttattaattttcaagtgatattaatttttaggtttgaagaagatgctttccccttttctaagttgtctctgtttcctccagcataattttttttcctttggttaatttagattattctctgtcatactggaggtatgtggtgattttattgtttgtcatatttaagaatgaagagaagctgcccatcactgcgtgtctgtgacaggaggcgttggctagagggccttgctcgatgggaagtagggggcgctggctgctgcgctggggactcatggatgcccccatgccgaggtctttatttctctgggctctaaatgactacaccagctgcctttaattttccccagatatgtcagtaactctctttagaggaaaaaaacccaccaccagcctgagtgctttccggcaggggcgcggtggtggaggatcattgcagaacacctggcttcaggcacacaggtgagacgccggctgtcctgatggcaggtcttcaggtaatctgtgccttccagcccgcaccactccaggcttgggcatgggggctgccttccacttcccttctctgcatgtgctctggacactttcagttcctcttttttaacaaaagttggccaaagtcagttttgcgtaccttatactttatttatagtaagctgtaagaacccatacttgtgaaggttttcaaaacattagaatatctgctccctggtgttaagaaatgtgtaatatagttgaagcacatatattcattctttctctctctttttctcccccgcccccccgccacactcactctaccaccaccacaatgaccaaggagaagtgcatttttcatttagcagaaatgctgccatttccactgtctatagcagaaggggagttcgtccaaaacatacagtagaaacccctttaattggaatccacagaacggccatccccaaagccccgctggggagaatgaagccactgtgagaggttaagagggtgggggggcagggctggcccttggagtgggctggcgagctgacttgccaaccagaaaggaaataggtcacgggagaaatggggggaaacacaggcccatggaggatgaggtccacacctgccagtgggtgctgggagggcagccccggggggagcaggcagcaggagatgcccagcccggccccgtgtacctggcaggcctcagcctgtggacaccctcgcctttggtttgtgtgacatttcacagttggtgggacatttgtgccgtttcatccatctttagtctgcgcagctgagctgaatgtggccgccaaagcttttgctgcttctctgtgcccatgcaccatccctttctgtggtttgcacggggagataaaggtcttttttgttggcacctttcgtaactccgagtcctagaatttggaggcttcagtaaaaagaaaagtgatttctctgcataaaaaatttaagaacccttaccgctgatgaccttaaatgaatttcacagacacaacgaactgtgtcattagcacaggcagcttccagggtgcaactgaagttcccctttcttcacaaatgcttcccccagcctgaaatcttccttggctgaccgcatacggcaatctcctacacagcggccttgacaatcatgtgttgtcttgtagcctctcttctactgtcataagcttactttacatttgttatgtaaacctgtcaagaatgcctcacgttaaattgatgctcaggaaggatctatagatttggcttgataaatacatatttgaataaactacctttagttgtcttctttagatgtatccatgatgcattaaatatatttgatcttcaattgatttgtatgaaatgtgagaagaaacaaagaaaacttgattagccataattcatgaaaacgatacactgtttgcagttgtcataaaactgggagctttcccaaaattcttagagtttaacctttttttttgtttctaatttcatctattttaaagtattgtctgaaattgcttgatattctggaccacagatgatggccagcaccatgggttgcagactgggacactgtgatcccagcaggacccatctgcctggccctgcttgctgtcgcgggaacacctctgccgccaccacggaggccgaggggctcgccctgcccccgacgcggaggccgaggggctcgccccgccccgacgcggggggcagatgtctttcacaaaggatcctggtggcacagggcagtggagtttctggctgaaggtggagcctcatgagaggagaggggcaagtgggaagtaagtgctttcactgaacactgaggtcagaaacacggaagaggtgttcattctcacccatcctctccagcatcacacgataagtccgtctgcgcagaaggcaagggcaggaaacaggcgtagagatcagaaaagaagttaggccatcttttcttgaagatgaagtgatcacctgtgttgaagtgtcagctgttaagtatcacagtgggatttacaggatactccctccagcagcagccaatacacacacttttccagcgtccatgcggcattcatcaaggtcggtcacatcctgggtcataaaataaacctcaacaagttttaaacagcacagcgtgtgttctttaaccacaagagaatcagctacacgtcaataaacacgagaaaaaactgtgaaaaaaattaaacaacgtatttctaaataatgggtcagaagcctcaagggaaattaaaaaaaaatacatagagttagatgaaaatgaatatacaacatatctgtatttataggatgcagataaatcagtattgaaagagaaatttatagcactaaaatcttatgttagaaaagaggaaagatgacaaattattgatataaattcctacttcaagaaattggaagagtaaaataaactgaaagcagtcagaagaaaggaaataataacagaaatcattaaaattgaaaacagaaaaacaatggagaaatattaaaagctgattctcagaaaaaaaatcaataaaatggatacattcctagcaatactaacaaaatagaaaaatcaagagggagatggaaaaacctctacagatcctgcagccatttaaataataatgaacaactttacactcttaaattcagcaactgagaggaaatggaccaattcctcgaaaacccccagctaccaaaatccaaccaattgaatattctgagtattatctgttcagcaatagataacctgaatagtcatagaatcatgaaagaaattgaatttgtcatttaaaattgtctgaaacataaatctgcaggcatacatggtttcactggagactattgccaaatatttaaaaagaagaagcagaacaccagttttgtacaagctcttccagaagatagaagggttgggaacacatttcaactcattttatgaggccattattatcctaatgccaaaaccagacacaccgttcaaaaaaaataaaaaacagcaaaccaatatctgtcacaaacttagatgccaaaatcctcaaaacaataatagcaaatcagttctagcaatttataaaaggaattatacgctgtgacttagtgagtttttttacgggtgtagaagtctagttcaatgtttaaaaattaattaatgtacttcataccaacagactaaagatgaaaaatcatacgattttaccaattgatgcagaaaactctttcatgcgagagaaaacaaacaaaaaaaaaactttcagtgaactaagaatagagaagaacttcaatttgattttttaaaaaatctgtaaaaacctaacagccgtccttttacttactggtaaaagactgaatgtttcccccttaagattggaagcaaggcaaggatatccattcttatcactgttattcaacagaagtactggaagttctagccagtgcaataagacaagaaaaagacatcattggttatcagggaaacgcaaatcaaaactacagtgaggtgctacctcgtgccactagggtggcagcaataaaacagatgggtaataacaagtgttgatgaggatgtggagagattggaatccttgcacactgctggtgggaatgtaaaatggtacggctgcttcagaagatagtctggcaaggttctcaagatgtgaaactgagggtctccccgtgacccagcaggagagtggcatgcactctagaatagcgcttggcccacactgggcactcagctgacccctgctggcttggctaatgagcagagtaaaaacactcctccctggcagtgtgggggccttccgagtggagggtggtgctggtgtgggggccctccaggtggagggcagtgcaggaggccatggcaggcagtggcagtgcttggactaaggtggtagatgttggcaaggcaattgtttgcatctggggttcgttgtgaaggaagagtgattcgctctggatcagatggaggacttaggcaaaaggagttaaaggcaacaccagtgttttggcctgggtggaatggagcagctgtctcccgagccaggaggaccatgaggctggagggtggatggaggtcttggggtgcaggacacaagagctctgctcaggcaatgtggggtgtggggtcctatcagagatgtttgttcagcatctcctgtaaattaggaagggtgacagggcatacagcagcacgcaagtggacaaaccctggctctactttcctgagaatgcatcagaaggtggtcggtgtcatcctagaacagacaatggctgaagccacgggatggtgacgagcccccatgtggttcgtgtggctggagaggagaggccagtcgaggcctgcgttcggtggtgtgtgtagagtctgggaaaaggagaggcactgacagaccggaccagagaagtagccgggcagttggagggtaaccaggcactcgtggcatcaggaagtcaggaaaagcctcaggaaagccttctagaagtagggacagttagctgattgctgtgctgttgagcggctcacacgaggaggactgaggatggaccgttgtatttgtgcacacggggccattgctggatttaacaaaagcagtgtcaacgcagggtggtgggctctcatgtgattctaaactgttcaagagagggtgggcgatgccatgtggaagctcctgagggaggtttgttttcgtcacatggacattatgagagcatgtgtttgtgctaatgggagtaacctggcagagagggaaaagctgatgtgtgggagggagagagagctcctgagggcggcccttaagtaggtgtgaagggaacaggatccattacacaaggggaagagctggctggaggcggagcatcgacggtggtcattccagaaggggatggcagcacatgcgtgcagaggccaggtttggaggaaggatgcagacgcacagcacaatcaagtttaggaggagcaggtacacacacacacacgtatataagcacatgcacatacagacatgtacacatacacatgcacatagacaacacatgcacacatgtacacgtatactcacctacatttacatacatgtatgcacacacatagacatatatgcatatagacatgcatagatgccacacacgtacacacgcacatatacatacatgtccacacatataaacacacgcacatacacacacagtcatatacacagagacacatagacaccatagacacacccacacacatacacatgcatgtgcgcacacatacatgcacatatagacacgcacatgtatacatgtgcatacacacatgcacacacctatatacacatatatacatgcccacctatacatacataaacatacacatatacatgtgcacacagaaacatggacatgtacacacatgcacacatacacacaggtacatgctcatacatgcacatctacacactcacctatacacacacacacacacagcttttggtgccatgccgcagcacattcctagtgcttcacatacgttcctttctaattggtgtttgttttagaaggtggagtgagtacatgtgtctggatccagccttattagattgtctttgcgcactgggaataacacccactttatgctcagctcttactagtgtctccagctttccctctcctccttgttaacagaattggaacccttcctgtcttcccgtctctctcctgaaattagccaaggctctctctcttatgactcagttcattagagaagtaagcagaaacacagcagctgatgatgaacaaaatgtttccgggggtgaaggcacccatctggcagggggcagggcgctcttgcaggttccgccgtgcagagaagaagccacaaggaccgagggaggcctgaaggagatgtctaacctgagccgtagaacgtaagaagttgccagcataaagacaggtaggaaaggcatgtcagtgacagaggcaggagaacacgtgacccacttgtgtggggagctccagcagcgcgttcggagtgctgggcattgccaggtctgaaagaggtcatcagttcttgggaaaggtgcctgcgtgggctagaaatcatggaacaaatcataaagccaagtagtactttaaacccagatgctactttaattaactcactttgctactttgccctcggcagcaagggtttgagggcacagccctggctactagcacagccctggttacgagcacagccctggttactagcagagccctggctactagcactatcctggctactagcactgtcctggttactagcacagccctggctactagcactgtcctggttacgagcacagccctggctactagcactgtcctggctactagcacagccctggttactagcagagccctggttactagcagagccctggcttctagcagagccctggttactagcacagccttggttactagcacagtcctggctactagacacctctgctagagactgcccaaagaatatgccatgagttagctctttctccccctcctgccactggtcagctaagccttccccctaaaaatcactttttgatatagagggtgaagaatttccagtatctcctttagttgactgtgagagaaattagtgtaatttctaattgaccatcttcacagagttgtagaatgatcacagagcatttagaagctgtgggttgctaatagctaaatggctttgaaataatgaatgcttcatttgggggaactcggggtaattgtgacaaaccgttgttatgaaggggctttagctagccttggaagggcaggctggaggcttctccacgtccttggaagtctccatccaccagaaggagctccttctgctctctcagcctggatgtgatagttgccagcaataggcgcaacttggtttttaaattaaaatctaatatttgatatacataattctatcaacaatatattaaaaatatttctgctttgcatctgctctttttggtacactgtgtgtcacatgatagatgccacattaatatctttgactattaatagagttggataagtaatacactgactcctttagcagcctcagcctttctttgaactttgcaaacatggccattgtaattaggtgttgttgaattgagaataaaagttactttaaggcagagctaaaagtgttaccgaggagatgctattttcagaaattacttggtaaagactcctctggagttgttagtaccgtatctcattataaagatgcctcttatatgtatttgagaagggaaagaaggagcccagtgttgacgttttatttagaaaatgtgaggccgggcgcggtggctcacgcctgtaatcccagcactttgggaggccaaggcgggtggatcacctgaggttgggagtttgagactagcctggccaacattggtgaaacccagtctctactaaaaatataaaattatccagacgtggtggcgcatacctgtaatcccagctacttgagaggctgaggcgggagaatcgcttgaacccaggaggtggaggttgcagtgagctgagatggtgccattgccctccagcctgggtgacaagagcaaacctccatctcaaaaaaaaaaaaaaaagtgcagtgcaggtgatccccaccacccccacagcggtgctttctgcgggtgatccccaccgcccccacagcggtgctttctgcgggtgatccccaccgcccccacagcggtgctttctgcgggtgatccccaccgcccccacagcggtgctttctgcgggtgatccccaccgcccccacagcggtgctttctgcagggagcggacggcaggcctggggcgtgctgcccgcttacctcatgaactgcgcgtgcactgactccacattacccacacgtgggaacaatgcagcagatgtcttttttggatccggttgctgtgtatcgcatcgcaagacttttctggatccttcccaaatcctccagaagactctggagagcattggaagatgagagtctttcttgtgtttgagtccctaggctccccggagaaacccctttgggtgcacgctcaccttaggcttgctgtttgggaaaaccatggctctgggctggaattggtcacttttaggcctgggcactgttcacaagcttggccaatcacaagcactcagccttacacgcaggcctgtttctgaaagatagtttcaattacggggtcaatatcttaggtagatgcaaaaccaaaacagtgtataggaaataactcatctgttgaaatagtttttttttttcccttgggttagcaatcctgaagaacgttcattggcagaaccctttggcttgaatgtcaggatgttttttaaaaatgctattggttctgggtgggtgcggtgggtcaggcctgtaaccccagaacttcgggaggccgaggcaggcagctcacttgaggtcaggaattcgagaccagcctggccaacacggtgaaaccctgtctctactaaaatacaaaaattcgctgggtgtggtggcactcgcctgtgatcccagctactcaggaggctgagggaggtgaatcgcttgaacctggaggtggaggttgcagtgagccaagattgcgccactgcacgccagcctaggcgacaaagcaagactccctctcaaaaacaaaaacaaaacaaaacaaaacctgttggttctaatacccctaaagcaaagagctctcctgtgtactcgtccatgcacccagtagtgtggtgggaaagaaggaattcagcatgcttcctcctgggcctggcagacaggtaccaggtgagtggagcactgtcattgcctgtcacttgctgttggaacctctgcagccagagggcatgtcttcttgtctatacatcaacgtactttggggggcttcttaaataggtggggtttctgtcaatgatcacactgaatggggaaatgaagtttctagtaggcatatttgggataaagctctttctacatctacctgtccgactgctccctcggcaaccacagaatgcttccagtgtccagtgtgctccaggaggcattgggccaagcgcccgtgcatctcagggtgcaggctgagataggcacggcagatgcaaacccagcagcgtctggaccacgggagctttgtctctccaccggacaagacacagacttcttggtccctaaggaagtccccttcaaacctgctgagttctcatgtggctcctgtacactggagactcgccccaccaccccatgccatcctatgttctagtgctgacttggaagaaaggtgggttggtatgaaaagtgttagatttcagaagcttggcacaaatggttggcggcgatggagggactgcagtgtttagaggccatggtgggaggacctgttggatggagggactgcagtgtttggaggccgtggcgggaggacctgttgggtggatggagggactgcggtgtgtgtttagaggccgtggcgggaggacctgttgggtggatggagggactgcggtgtgtgtttagaggccgtggcgggaggacctgttgtggatggagggactgcggtgtgtgtttagaggccgtggcgggaggacctgttgggtggatggaggggctgcggtgtgtgtttagaggccgtggcgggaggacctgttgggtggatggaggggctgcggtgtgtgtttggaggccgtggcgggaggacctgttgggtggatggaggggctgcggtgtgtgtttggaggctgtggcgggaggacctgttgggtggatggaggggctgcggtgtgtgtttggaggctgtggcgggagagcctgctgctcagttctcaggactggttagaaagtaaatttaacgtaggagcaacttaacaaaaagaaaagcttttcattttgggggctttttttgtttgtctttagagatggctttgctctgtcacccaggctggagtgcagtggtgccaccacagctcactgccaccttgaactcctgagcccaagggatcctcccacctcggcctcctgagtagctgggactgcaggcatgcaccactacaccaggctgattttaaacaactttttgtagagacaggggtcttgccatattgcccaggctggtctcaaactccagagctcaagcaatcctcacacctcagcctcttgagaagccaggactacaggcatgcaccaccacacctggctaattaaaaaaaaattttggagtgatggggtctttccatcttgcccaggctgatcttgaactcctgggttcaagtgatcctcccacctcagcctcccaaagtgctggtattacagatgtgagccaccacacctggttatataaaaagaaaacctaaaactagtaaaccacgctgatattttttgctatatttctgctatatacatgtccttttgaaaaggaaaataggaatattgaacttagtttttgcgtaaagggccatttcctcccacttaaagttgtttcctttttaatcctctgccagccattcttacgtggccagtggtagtggtgctgattaaaataacacaagtctgccagcagtcccagacagacatcgcaaatggcgccttccacagttcaggactgtgtgcttcactccacggaggtctgcctcagatgcctccctcccagcccctttccggaggccagggagagtgcgtttccaccaagcgcaggagtcagcacttcctcatagccttcccgtgccctcccagcaccaggcacacatggccgctcccacctatcccatccacctgttgtgacgcgggtctgagtagctgcaggtccacgtcgttcctggacccatcatctggcttagtgggcctgtcacagcagacctggaaactaattttctgtgtacagcaggttgcattgccgatgctattttagcttatggagcccagagcccaggaaatggttttaaacatgattttgccttccctcttccctcttgtttaaaaaaacccactccttgatggttcttggtgattgttgcgtggcatgtaaatatccctaatgtcaccgaactgtacatttgaaacggttaacatggcaaattttatgctacaggtaatttatcatcataaaaaaaacctcattcctctagaaattgcagtttttattgaaaaagttaaattatatttattattaagtatatgagaatttgatttgtactctgggtttaatgttcctgtggtagaatgggttattaataaaactagcagtcattagtaccttccagctgagaaatttgagatgttaaaaacaaagtttgtcagagtcagatgacagtgcgttctgtaccatcaccgtggtgcgaggtggctgtgagtgaatacagctctgtgtgtatttcattccgaaagcactgggcgtgctgtctggagagggctcggcagctttcgtgttggcgtcgtaggtgcttggtggagattcagaaggacccagatgggataatggggcaaaagcagccctaaaatcaggggcagtgcccggcactctggacgcatgtgctggcccagctgcagggcagtccgtgtcatctttggggactctgtgtcctcgtcgtcacagctcttttaacatggagctgaaacctcatggggttggtaaaaagcagatgaaatagtatatgtgaagagccgtgagaaatactaagaactacgcaactaaaagtaaggagcaaggaaggagcaaaaatgcagacacagacacattctctccccgtcaagccggggagcgcatcacagccctcggtgattaaaagccacacactctggacacatctcacccccacccatattcatcgtcacttacaatattcatttacaatagtgcctcctcttcatggaggcctgccacagtctgagtaaacaaaagtgatcttgtccctgtggtattcacaaaacaagccctaggaattgtgtaagtcacaaacagcgtccaggccctggatctgggacgaccagtctctgtcatgcgatgctccggccctcatgctgaccgcttggtccacgaccccgcattagcaggtggcgctctcagtctgaagcctcgttctgtaccttgttgttccacgtccccagcctagatgggcagatgaggttggcccctacagcagaatgctttccgttacagccgaattataggtatttgtagacacgtgaatgaaggagttctgcaagctgtgtggcccggtatgatcggcatttttggggttttctgttttcattcctttagctatctacatgacatgcccaggcatcacatttcagggtaactgaagagaaggcaatgcagattccatctcacagcctgtggtgtgttcttcttgttttgtctgttccctgtctctttctgtccctttgtttcctgctaccctttcccctctcccctctccccacaacaaaggaccagccttgatgatagtgcaggagggactttgcaagccaagctctcccagggcccatggggcctcccttccagcaggtgggccctgcatgcagcccacagtgtctgaggactctgcatccccggaagggaggcattgcttgtgcgcagctgctgtgcctcccccagctgaaagcattctgtttggtggaactggttctgatattttccagctcttctcaattatttccaggagcaggcagagcagtgtgtgtacataatccctcatgtgttatacttattaaattttactggccaaaatgccaggaattcttgtgaacttcattatttctgaaaacgacagcaaaacctcttgtggattaccgaaatggccacatgcaggcaacgtaggtagccagggaaaggaatcacaatctcagtgctagtataattagtccttggtggtataaggatcctgttttgttgaatgctgtggttttttggtaaaacaggaacccacctggtatccatggcagggtatagcaaactcgtgtatcagacagtcctgtcattttttaaacctttgaatgtaatgcattatttaaaaagaaggaagagttacactttcagttagatttcatttggtaaaaagtgaaattttctgtgcattttagtagtaaacaacaattcacttagtgcctttcttcctaaaatggcactgtgatatcagcttcacatatgatacttttacgtgacaaaagtctcattgaaataaataccaaccggcattactatccctactttaaagagagattaaattttgaattcaaaaacacctcacctttctccctgattacaaaattaatgcacatttgtttgtagaacatttagagaaatccgatgaagatgggaggagataaaatccccctaatcccccactcggggatgagtgctcgctctgtctgtttttcagtctcttttgatgggtcgctttagtcagcccactcaaactcacattttgtggtttgcctttgtgttggtgatggagttcacatcatataacctgaacgtcttcccatgtcattaaacacaacaaaataaggttaggatagattaagattgaacgtttaggccgggcgcggtggctcacgcctgtaaatcccagcactttgggaggccgagacgggcggatcacgaggtcaggagatcgagaccatcctggctaacacggtgaaaccccgtctctactaaaaatacaaaaattagccgggcatggtggcgtgcgcctgtagtcccagctacacgagaggctgaggcaggagaatggcgtgaacccgggaggcggagcttgcagtgagtcgagatcgcgccactgcactccagcctgggcgacagagcgaaactccgtctcaaaaaaaaaaaaaaaaaaaagattgaacgtttaaaacaaatcgtaagacaccatgaaagacctggtggacagtgatacaatcctggggtaagtagggtcctgcaaagaggaaaaccgggaagaaaacagagttgacagagacacaaccaggctgtgccatcagaagggccttgggaatgagacggccaggtttccaggcttacagtctgtctctggagacagttcagcagcgacgcctctctccagaggactttccagtgaaaactcacagcctgagttgatttattctttccttctgtgtcacagctgcagcttactatttggttgtgaccagcagctaaatcacactctcttttcccgaatgttctgcccttcaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggtgagtggcccctgctgtgcccctgggacccactcaactgggctctcccgcagggaccccaacccatgtgggccccaggcattcacctggtcccaggagcccacgtgacagacatgagtgtccccgccttctttttgtgtcattcgggattccaggtggaggtttgggttctactctttgagagctcaagatccttcttccttctgatctgttcgtgggcagctcactgctttgcgatttccaagaacaccctctccttacctttgttcactgcggaggcgtcttagtaccaggataggtcatactggaaactggactttctttcaggggaagaaaaggctgttatgaaaaaggaagtcatttaattccttgcttgagttgaagcgtaatctttcaatgtatttttagcaatgaaaaaagagccatgatttttctgtctccatcctttttaagttatagccgtcgggaacataactgaagaaatgtgtgtgatattccaagatggtagaagccgcatttcagccccaacatccccggcagaacgcacagtgggatatgtgtgtttcctgcctccaaatccaatattctcccctagaccatcttgccagtctttaatatctcctttcccattttatgttttgctgaaaagcttatatgtcgtggctgttaccggctagtagataaatacctctcccttgaggtgccgtgcgaatggtgcagctgtgcagcagacaccgtgctgtcggccgaggacactcttgaggcttctgtcaagatggcctaacactctagacaagtctcctgccttctcacccacagccctgggcagacacggggagctaacagcacagcaaagtaagggcccccagggacaccctgggaggggccagaggggcagggcagcctgaggggggaggaaaacttggccttcctgctctgcctctagccaagtccaaattgatcccagaccccagggctgggggttcatgatgttggggtgactgcagcgcagccctcacattaactgtccctaggcctccccaccaaacttgagggctacaggtttccactcagggagagacctccttttagtgttactcaccccaaaatagttggagatgaagggaagagggctgggtgtggtagctcacacctgtaatcctagcactttaggaggctgaggcaggaggatcccttgagcgcgggagttttgagaccagcctgggcaacatagggagaccttgtctctaaaaagaaaatagaaaaatagcaagtgcagtggctcatgcctgtaaccctaatgctttgggaaggtgaggcaggcagattgcttgaggccaggagttcgagactagcctggccaacatggcgaaaccctgtctatactaaaaatacaaaaaaattagctggatgtggtagcacatgcctatattcccagccacttaggaggctgaggtactagaattgctcgaacctgggaggcagaggttgcagtgagccaagattgtgccagtgtactccagcctgggtgacggagcaagaccctgtctcaaaaaaaaaaaaaaaaaaaagaaacaaaaaaagaggggagaggagctgtctggagggggcagcagagagggatctgcagtgtttctgctgtccagccagtacccccaccttacctggctgatgcagacttagcctgaaagggccactgtcctctgcacccagcggagcagagctcacttggcaaaactagacacctgagtagcacagccactacgcagagagaaagctgaaccagggttattgtaaaacaagtgtaatacatacaatcaaagaaataaaggaagacacctgtaacaagatgtgagaacaatgctacagttttaatgccttcccccaaatgtatgtgctggaaacttaatcccccacgcaacagtgttgggaggtgattgcatcatgagggctctgccctcacatttaggttaatgtcactgtcacaggggtaggttagttattgtgagagcaggttgtgataaaagcaagcccagccccttgtgttatcttgcccttccaccttctgccatgggatggcacagcaagaaggtccttgccagatgccactctttgaccttggacctcccagtctccagaactgtaagaaagaagtttctttacttagatgaagagaagctgcttgaaaagtccaagaatacagttaagtaggaggaataagttatagtattccatagtagagtagggagattacggttaacagaaataatttattggatatttcaaaatagcttggagagaagaattgtaatggccccaacacaaaagatagaaggtggagtgagatggtggaatagaagcctccaccagtcttcctgcagcaaggataccaatgtaacaactatcagcacacacagaaagcaccttcatacgaaccaaaaattaggtgagcgctcatagtacccagtttagcttcatgttgctgaaagaggcactgagaggtagaaaaaacagtcttgaaaagataaatgtttgaggtgatgtatgagttggatagatcccagttaccctgatttgatcattacgcattgtatgcacggatcaaaatatcacatggagccccaaaatacatacaactatcatatatcaatttaaagaatacaaaaaaaatttgttataaattactcagtctgtcgtagtctattatagcaacacaaaacagacagacagacaagaaaaagtactataaaagaagaacaaagcagaaataggggtaggtgcactgtaatgtttgaaataaagaacacagtagacaggacccatagcaggagagacactgctggagccaaatgaatggcctggaagactacagtgggggctcacaggaggccatgggaaagggtcgagatgggaaacagaaaagccaggagatgcagagaagggaaatagaggccccagtatgcagactgggggcatcccgtgttgagagaacaagaatatggcagagctgaaaatacctgaagatctcggaaatgcactccccaaaattgggaaagctggaagccctccaactgagagggcttgtgccaaccagaaattaatgggagacctccgacctcagcacatccagtgaggcggaagaccctcttgagggcaccttccctgacgccacgttgtttctgaactgctctccatccttgtttgtttgctctgtaatgtcgaagtcctttctgaacgcagatctcttttcacgtaccagtttatgaggcacacgttacagtgtgcctacctctatttctgcttgtttctcctttcgcattactttctcttgtttgtcttaatctgttttgggttactataacagaatacaacagactgggtaatttaaaatgacaattttttgtattctgtaaattgatatatcatagttgtccatatttggggggtccatgcaatattttgatacctgtatacgatgcattaatgatcaaattggggtaactgggatatccatcacctgaaacatttatcttttctttttaagactgctgaagagacggtcttttggggcctctgtttctcttctctgcatctcctggcttttctgtttcccacctctgtcctttcccacggcctcctatgcgcccctcattgtagtcttccaggatattgtagggcttcagcagcctctcacctttatgagtgttctttttaactctctgtactgtatgtctgatccctgtccaaagaggcttatgagtgcccatttcacgttaccccaggaagagattggtccacctgactcaggagttcatccattcattgcccaaaaactaatttattcagtcccgactgtgtatgtaataagacccatgctaatcactataggagatcctaagaagcatattgccctcaacaaatgtctcctctggttgaggagataagatgtggcttgaaaattcatgatttcaatggatgcttcatgcaagatgaaaatctgaacccttcaaggcaatgtgtgatcaaagaccaagtgaccttatggcaccaagggctgttgtgttcccagaggacagagaaccatggctaagggccacagggtttgagaaagctgcttggaggaggtggaacctgagaggaaggtttcgtcaggagtgcggttgagctcagagagtggactgaagtccaagtccattgtggggtgctttgaatgctgcccagaggaccttgacttctcctgggactctggcacaagagagcccctgaagctgtttgggtagaaaaatgacttcatcagaaccgtgttttagaaagaggatccaagtgatgatagggagaccttggtgaccattaggccattatcatatcagtgcggtcttgagctggtaaaagattagggcagaaagatagaaaatcacccaggggcctgtaggctggagcttctgtagacgcacagtggacactgccgagaaacaggcctcatttctcccatgttcccgtccccgctcccggtttcctgcatgactgctttggtgccccctgactccagaatcaacaccacaccagctctgcctttagactctgcccagaggctctgggctggatactgtatttggtgcgaccctctggggcatttttgcaagttttcaggcagatgggtgggggagcagtgaaggaaggaggaaaaaagacaaagcacaaggggaaccggaaatgacatcgctaccttcctgtgccttccctgccgccccactccagctacctgtcactaaacccagtgcacttcatctagttgacgggtttctctcaggcattttgtttttctgccatgagtgggaaggacttggcttccctccgcgcacagctgtgcactcccaaagacgcctgggccagatgtggcagtgcgtcctgtagtcccagctgcttggaaggccgaggcaggaggatcacttgagcccagaagtttgagaccagccctgggaacacagggaaaccccatctgtaaaaaaaagtaaaataaagaagtatgctttcactctgagggctgctggcctcgttatttctaaaatgggtgcctgccctctgagtagggaatgtgctttctctctaccaaggcatgatgtgtcatcccagtagcccctgaaatccttgtaggagttaggacatagtcagatttttaaaagtaagcatttagtaggaagtgcagtgaaaaacaaactgatacagttaccataagagggactttgaaatcaatatgccacagtggcagacagtggtcatcagataaccactgcctggaacaattgagcggtgtctcaggtggcggctcttttacaataaactgctttctcccatattgaagtgctgaaattaggttgaacatgacattttgctaggtgtctatggcctgtgagtggtaatggactatattcattaaagaattatcaagtgaaatgtgtagttttgtgtgagctaagttaaaaaccaccagggtttttttttttaatggaagagtgagatagtttgtcagacagtaattacgtatgtttttagggttttagttttattttttcattttgaaaagtcaatttttctaattaaaaatgaaagatacattcttttcagaaaattactaaaaagttaaaagtagaaaaaaatcatccaagattttaccatctaaggacaactagtgttcactttttgatgtattgcctgttggtcttttttctgtgcatgtacattttgcactgatgtaagtggacagaatttacgatttcatatccttaacccttcgcattatactagagttccctgccctagatcattagagactcttagtaagtatcattttatatttcactatgttgaagttccatgttttatttagccggagcgtagggctttgggatttaggtgccaggagtatgcgggtgggaaggttcagcctggcactctgatgggagtcggcagacctggttctgtgaaggggcagacgcacttgggttaggcttttcgggccacacagtcccaagtctgctgttgcagcacgaaagagccacaggcaatatataaacaaatgagcatggctgtgttccagtcgagctttcttttttctttttttttttttttttttttgagaccgagtctcactgttgcccaggctggagtgcagtggcgtgatctcggctcactgcaacctccacctcctcggttcaagcgattctcctgcctcagcctcccgagtagctgggattacaggtgcccaccaccacgcctggctaatttttgtatttttagtagagatgagattttaccatgttggccaggctggcatcaaactcctgacctcaggtgatccgcccgcctcagccttccaaagtgctgagattacaggcacgagccaccgcacccagcctcagtcaagctttctttaaggaaacaggcagttggccagatttggcccaggagctatagcttggcacttcctgctccagaaaagggaactaagattgggctgcagatgacggctgtgcgtgtctgccggtctgcaggtgacctggagaagggcgatgctcgggaaggtggattccctccctccctccctttactatgtaaataagagaaacggtttctaagcacgctgccctcattatgctggcacagctgctacagaatgcggtgtgctgggtaaacaacatacagctttgcttcatttggacaaaatgtgtacatgtgtacttggtggcaagcgtatttatgaatcttatttgatgatgaacttgttggaagacattgttctctaattttttttcatttttgcctgtctttttcatttttggaaactgatttcaataattccaaaatgagcaatgacattactttccacataaatgattatcttactcaccatatacatcaatacactgtaagaatccaaaatatattttttcccttggctgttttctacttctttgattgagtggcataatatcattttagatttattacgcgtctatttgtatactactgaaaattataacccagtgggacttcatttgctgtgggacttgctataaaacagattgatgtctattgcactgtgctgcatgcactagtattgtctattaatgaaaatgataaacattattttggattgaatagaggtcaaaaaacttacttcctttctttcaattaagttgaaggatttccaggactgtaaatgttaatgatagagcattaacgtgtatttgtcagcgtggaaagtttcgctcctgcattgcccgcaggagacggaagatgcatgggtttcctggcgcgcaggttgggtggaggctcagcgtggctctgtctggccaggctaagtggtttgcagtgcctgtctcatttcagacatttgctgtgacatttgcttcgtattttttcctgatgactcaaccaagaatcattcagaattacctttagaaacataaattcttgtggttttgatgatagagttaaccatgtgttctccaaggagtcttctaaaatacatctgctttgccagagaacacactttcttctgcccgttcagtgctctcgggtcttttgccgcttcctttcaacaacagtccgatgactttgtcttcctgcatatgtgcgaagggagaggagctcactggtcctcccagagggtgaagtaaccgggacacattattgaataaaatgctcttttgtagtatcccactctgtatcttagaccttagtcgtaggcaagtttaatttggaatttgcgtctggagaaacggctttatgacgtttccaagtagagcctcagtatcatggatctcacacagtccccgcggcagcttccaggccgtttccagaggaaaatattttttctccccaaacaagacagtgttctctcactgttccagtctcttgacatatactcaattaagatgaatatcataatgtattgtaatagagctcccgttttaaaagatgacgtgtaaaaaccacctgatggatgcggtaagaaagggaattgaagcagatggaggggcacgggctgctgactccccggctgaaccccgtcctcgggtgctgcaggaaagagtgagattgatgatcctggagggagcccactcagcagcacagccggagactttgctggtcccttgagatggctgagtccccactgggggctggggtgaggggtgaggccggaggagacagtggagctggcgagggccccagggtgcaggcaaggctgagggcactcggctctcctcccactgcccttgataggcatggcctgctgtgctgtgtctggggctcagaaagatggaaaataagagggtggaaagaaagagtttgtcctaccgcccttgtgaaaagagaagtaatccaataataaataaaagtgataaaagacaattggaaatatgaagaagaaacaggaagaaagaccagttggaagcattaagtataaaaaatataattggtgaaataattgaagagatggattgaaaagcaacattatggatagagccaagaataaaccaggaagctgagaagcttgtttgaggagttcccaccaaagggatggagctagaaggaaggggagaaacatgagaggcagagacaaagtttaaatatctaggaaataacattttcttctctctaaaaaaaaacgtagaaaaggagaaaagacaggcttagtaaatagaaagtgtgagatacgatggctaaaatgttttgaaataaagttgtaactgtaaacgaattgaattcacctctcaaagggccatgattcttgtgttggttaaaatcatgatacagcagtctcttgtccatgagacacagatttaaagcaaaacgtttaagcctgggcaaaacagcacgaccctgtctctactaaaaatttaaaaattagctggacatggtggcttatgcctgtggtctcagttcctcgggaggctgaggcaggaggatcagttgagcccaggagttcaaggctgcagtgagctgtgattgtgccactgcactccagcctgggtgacagggtaagacccagtctctaaaaaaaaataataataataaaaaataagaacatgtatttcaaaggttggaaatcagaagatgaaaaagagaaatacgagctaaaagaaagctggggtggccagtcccaatatgacttaaagcagaagctgagataaattattgagaggggcaaagaaaaatgttgtattgtggtaaaacgaacaggaaagcaggaaggtatatactgatgatgactgtgtgcacctgacaacgtggccttgaacgagataagatgggagctgaagtgtggatggaagcagatgaatgagaagtgtgcttagatacagagacaccaagtacagacaaaggaagcaacgtaaatacgacttttgtcaccgaattaattagccagacctcacagaggcacacaggaccatacatccaacagggaatgtggacatatgtggaccattcacaaaaataaatcatgcgcccgactacaaagaaagctttactaatccggaagaatcagcatcgtgtgaactccgtggcagaccacacgcaatgaagctagaactcagtaacgaaaggacagctttaacaaaagtctgaaaactaaaatcttaaaatccttggattaaagaggaaatattttatattttttatttttttttacatgtacacacttacacatttatttgacttcattgtagaactttgacattaatcccaataactaatctctttatacatattgtttcatcctgacatcaacctgaacagggaaaattgacttatataagcacatagctactatagatgtctttttagaaactgattattgatatatagcagagaaacctaaaatctctttaactaacttgaagtcctgaccgtatgacttcttttgttattttattttattttattttattttattttattttattttattttattttattttattattatacttttaagttttagggtacatgtgcacaatgtgcaggttacatatgtatacatgtgacatgctggtgtgctgcacccattaactcgtcatttagcattaggtatatctcctaatgctatccctcccccctccccccaccccacaacaggcccagagtgtgatgttccccttcctgtgtccatgtgttctcattgttcagttcccacctatgagtgagaacatgcagtgtttggttttttgtccttgcaatagtttactgagaatgatgatttccaatttcatccatgtccctacaaaggacatgaactcatcattttttatggccgcatagtattccatggtgtatatgtgccacattttcttaatccagtctatcattgttggacatttgggttggttccaagtctttgctattgtgaatagtgccacagtaaacatacgtgtgcatgtgtctttatagcagcatgatttatagtcctttgagtatatacccagtaatgggatggctgggtcaaatggtatttctagttctagatccctgaggaatcgccacactgacttccacaatggctgaactagtttacagtcccaccaacagtgtaaaagtgttcctgtttctccacatcctctccagcacctgttgtttcctgactttttaacgattgccattctaactggtgtgagatggtatctcattgtggttttgatttgcatttctaaagaggaaatactttaaaactgataaaatactcacagccaaatgttagtaatagcacatttgctgtttgtggggtgtatgtagccaaagcaggcgaggatttaatacatttagtcagaaaacaaagattaaaaaaacaagaaaaattaaatgtttgccttaaagagccaggggaaaaatgcaataaacagatgaaaaacaaaatgaagagagcgaatctgaaagatacaggcagccctacgctgtccgtcgcatctctgcatccatagggtctctgcttcatttcctgggagtcctgccagtgtgggagggggcgtccagggcctctgaacactcttctcacagattttcatctgggcacttgctctcagttcttcctttcagagagccagttgtctcagttcttgatacttgctgacagcaggctttgggaggtgagtgcttcattttgactttgcaccgtccaggtcaaaggcttcacttctctcacctctgctgagccacttacgcttgtccaactgtttcttaacgtttggttgacattttacagttacagggataacagtagctagcatttgtcgagcgtcactggagccattccactaatgcactcatctaacaccacacgcctgtaaggtttggactggcgttagtgctgctttcaggatgaggaagttcaggttgcttggagagtagctggtggagtcaggattcaaagctgggtgcccaggctcccgaactgacagcctcaactctgttgttccgcctctctctctcctgcccagcgtctctcatttgccatgatttccttcctggggctctccgtccttgtcctgttctttttctctcgttatggaggaagttgagatcactatcatctatagtctgtcacgtctaaatagaggttaccacgacttacttaacgtggtaaaggctacatcagagctcttcagcaaaccagcctagtggggagactggagacgtcttcccttcgaagctgggaacaaggcaaagattctttctcgcactaaaacagtattagaattcctgacccccagtaagataactccataaccagcagaaggaatgtgaacatttgtaattatctgtttacagtaagggccatctaacatagttcactgattctagcatgtactttttaaattttttttaagacgtgatcttgctttgtcacccaggctggagtgcagtggtgtgaacacggcccaccgtagtctcaacttctcgggctcaagcaatccccccacctcagccccccaggtaactgggactacaggtgtatgccaccattctgactaatttttgtatcttttgtagagactgtgtcaccatgttgcccaggctggtctcgaactcctaagctcaagagatcctcccacctcagccttacaaagtgctggaattacaagcatgaggcaccatgtctggtccttttttaaaaaatagagacagggtctctcccttttacttagatgggagtgcagtgacacagtcatagctcactgcatccttgaactcctgggctcaagtgatcctcctgctttagcctcccaaagtgctggaattccaggcatgagccaccacgcctgatcccagcatgtgcgttttcacacttaacatatctggggtccagaagcatcttacaataagtaacatacctgtttagttggcagttcttttcctttgttaatagtgtatagaaatgcttgcaaaggtccacctagaggtgtgcactgtaccctttcttactgctgtttgtaagctcactgtttgtcactagggaaagaaacaggcaccattacttaactaggtgttcatgtaccggcaataattgatctcaaaatttaatgctatttatagtttttaattaaaaaactctcaaatgtatggtctaagtttttctttaagtccagaaaaaaagaatacattaaaccctaagtaagtagaagaaaagaaataataaagagaagagcaaaaataaacagaagttgaccccaaaatttgtaaaaattcatgaaactagttgatagtttttgaaaggttcattaaaattgtcaaaactttttctagagtgctcaagaaaaatagaaggaagatacaaatgactttcatcagaaatgaaagagggcacatccttactgatcctacagatgttaaaagaataaggggccaggtgcgggggctcatgcgtataatcccagcactttgggaggccgaggcaggtggatcgcttgagcccaggagttcaagaccagcctgggcaacatagcaaaaccccatctctacaaaatataaaaattactcgtgtgtggtggcatacgcttgtagtcccagctacttgggaggctgaggtgggaggatcactgggaggcattgaggctgtagtgagcagtgcagtgatcacgtcactgtggtccagcatagaccacagagtgagaccctgtctccaaaaatgaaaattataagtaaataaaaggagaataagggaatcattttaatcatgaaggaccatatgccagtaaattcttcatcttagatgcaatggataaattctgtgaaagacacaagttatcaaatctgacagaagaataaaaagaaaatttggataggatatatctgttaagtaaattaaatttctggttaacaaccattcaaagacaaccccgcacccagatatctttactagtgaattttaccaaacctttaagatgaacagaatagacagacaacctttgtgaaatgtttaaatatctgctgaccatattaagttgctgtcccaaggctcggtgtaattagtaatggtaaaagctaagaaaatctttacaaggttactgcctaactgttgactaatttgaccaaattttatgcacctggggccttttacaaatcagcttacttccctaagaaaaagtgttacttgaattttttttttatgattttattttattttattatttttgagacagagtcttgctgtgtcgccaggctggagtgcagtggtgcaatctcagctcactgcaacctctgactccctgtttcaagtgattctcctgcctcagccttctgagtagctgggattacaggcacgtaacaccatgcctggctaatttttgtatttttagtagagatggggtttcaccatgttagccaggatggtctcgatttccagacctcgtgatccgcccgcctcggcctcccaaagtgctgggattacaggcgtgagccaccgcgcctgaccacgtgaatttttttttaagagcagcttgcctttatatttttggttcacgttgggacttaccttctagtcatttactgttggctcacatttcctcttctcccatgtctgtctaacgggagaaccatggagtgcgtgatctcacttggggtctcagtaggccgcttagtgagtcccaaagacttttgtgagagtttgaatgcatccgtgtgtaatgtatctggaggactcaagggtagcaagtatacacagagtatccttttaacataaaaggagcattcagaaaagaattaagactgtgcagttcagcccacagttgggctctcatagctactgagttattcatgtaatcctcggaaatcagcttgggtgaaatactgcacgggaaagagtgctcagccccggcctcactcctgcctgtcccaggcctcctcactgtccgtgtctcatgggaagaaagtcatttgttgtctcctgcttgatgtcatcatcactatgttccagattagcttcaggacttgtttgaaatcatacctactaatcgactgacttatatccccatcacacggtgacatattaactgcttatttgcctctttgtatcttcttcttaaacttctgggcattttagtggcagtttggcttcttgtttgatttatgtgcctaagcgtgctcatgcctccatatttaatcagtgacgttaggtcacattgcatgcaaaaactgtcagtgcattcagctccgtatttaatagcaggcattcatgacccttttttaaataaaaaagcgatcatttgatttgtgctaaactggacagtatattgcggaagccattttcatcctcattttacttgtgctgagatcgaatcgataatgcctcttgatggcatcattgttggaacgccagaaccgtgctgtcacatagacctgtatggagggtggcatgtgtcccacgccagagccatgccatcatgtaggcctgtgtggagggtggcatggtgtcccacgccagaaccaagctggcaagtagacccataaggatggtggcatggtgttgccagccttgttgtaaaatggtgtgaattaatccaggagacgttagcctcttctttggtttctcgttatttgtactgctaagtaaatgttgtatatgtatgttcagtacatagaacaatttaaactggattcagaagccatttcagtgcactctgagactgggcattaaaccttgctttaagtactgtcaccacagtcactgagaacagcccgagtgctgcttacttgcaggttgaaaggactctgtgcaatgagaacttctgagttcccatcctgtcccaggtagccagtaaacacctaagtcatgaaggttatgagacacagtccctgtgtgcccggaaaagagggtctccagggagaggtgctccctctcatcagtgctcttcttggagacagaggagggagtagggatactccttctgcttgccttggaggcagaggcggcatcactgctgttggggtgtcctcgtatcacccgctatgatgagtgaaatttcaccagcaagaggaggtggagaaaggcattgtgaggcactcaccctgacctgctcagaggcctgaacgcatctcgaccagcagcccagtgtggcatctgagtgaaggatggtggccaggacacgagagggagggcggggtccgtgaccatgaagctcgagctggaatttcttctgttggcagtgccttctttgtggtaggtgctgtgcagctgcagggctggcctggcctgcagagccagtcacacgggggtctccacccttgtctcagcccactagtgctgctgcacaggcccctgaaacagggtaatttataaagaacagagttatttctcccggttctggaggctggaagtcccaggtcaaggcatcggtgggtttggcgtctggtgagggctgttctctgcattcgaggtggcgtcttttcccgtgtcctcctgggaggactgctgcatcctcacatagcagaaggcagaaggcagcagaggctatgttcctccagcacccccgccttaaataaggttgctaaaatcccactcaggatggcggagccttgggatgtaaccgtcatctaaagcccacctcttagcactgtcacttcgggtcctcagatccaacaggaattttaggagggacgtgccttctcagcgtagcagccctctgggaaatgaaagcctgtttgagaagacatgttcgtatctcagcagcagcgtggtccgggctctcctgaggaaggtgcccagggcatttggggacacagaggagcaaatttcatccagcaggggcagctcactgtgtgggtgaggcttagaactgggcatggcggtggctgtcggatggacatgcaggttcaggatccaggtatgtctgtcacctaccatttctaacggaggacaacgatatcatcagttgtgaacacatcttctctgttactgttcaagaagccatgctgtttgcattctctaagaggaaaatcgcactgctggtagcaccttcaacctgcaattcctacttacccgcctcaaacgcttcctgtcttcacttttgctgtccgcaagatccccaccttccaatccacaaatgtttgtactcaaatttccccagcagaaccagcaataaagcacagaaagcagctgacctaagcccacccacctctttccttaaatcgggcatcttccccttagacagagtgtctggtttgcgctgctgtcaccactcagcttctcccagcatacagcgtgtgctgcctctcctggcccggggcagtcccctgccttcctgccattccagcagctctcccggaaccatcgaggtgatcgctgccttctgagccgtcagcctcactggcctgtccctaatccttgcccctgaagagtccgctgcagagctgaagcaagggacacccccttcagcacctccttccctgccctggggtctgcggctgcctctctgaagctcccactctctggccagcctctcttcctgcacttggacgtatgttctcccacggctgtgttcttggccctcctcttgacgtacttctgcctgtgagaaactgcagctcatccagcgatcactatcctgacccctctgagataatccctccttcctcacgctctccctctgccagcgctttcctcgtcatatacacctgcataaacctctcatgcctgaaacaaaaggtccaccccagcaagagggcactcccgccgcccgctggccctcctgggcctcattgcctagttctttctctccaggtgcagttaagcttcaggacggaagggggtacctcccaagcctttctgcccttcctgtccagccctcaatattgtaatcaggtctcctcaacctagaacgccccctctccttcccagccccaggtgtttaccctggttgtttgtgtttcttgtttttctgtgtaatggaaggaaggtatcacctgagaggccttaggaatgacacaggaaaccctgctgcctccattcagacttgggtggggtgggggtgggtggaggccagctggcatctcccaggatttctgaaccctcgtgtccctcagccagccaccgccatgcccagctccaggcctcgcccccgatatgggggaagctgttgctgctggatctgacgtgcccgtcttctcgctcgggcaccccagctggtgcgtagcgaggcagtcacagctcactgcagcctcgacctcctaggctcaagtgatcctcccacctcagcctccctggtaactgggtctataggtgcacaccaccatgcctggctaatttttcacattttttgtagaaatggggtcttgttatattggccaggctggtctttaacttctggcctcaagcagtcctccaactgcagcctcccaaagtgctgggattacaggcctgacactaatttctgcacatagaggtgaggaggcacctcgggtatcagggtagtgaatgagtgcctggaccacacaggccagagtcgaaatctgttcacctgccttaatctgccactgtttggctgcttttaaaaaataaatgtacatctttgtcttggattgtcttccttaatatcacatccaaaaactcaatactagcaatttttcagaagacctcgatgttttgggcagcccttagacctccctgtcacttgacccaaatggtgctgggttgaccccagtccagcagggaccaccagtgctgtccccaacatgactggttccccctgtctctccccccacatgcctggacccccttcctctccctccacatgcctggacccccttcctctccctccacatgccctgttccccttcccctcccccccacatgcctggtcccccacccctaccctccccgcccttgtctggtcttcagtgcctccctgatgaggggcagctgcccccattctcctgcggcagcttcaccagccacacggctcatccaatggcttggaccttgtttcattcactaaagcaccagctctagcactgtgaggtcattattgagtttgtaagcaaaaatcttcttaaggaacagactaatgtgtatttaattttcattatgtaccaggtacatattaagactttttgtttcttttaatctcagtaattcctgttttatagttccattatcctcatcgtgtaagtgaaaggtaagtggtggcagccggacatcaagatgtgaactcgcctggggctgtacaggggcagagccagggctacgatttgaaccggggttttctgacctgagcgctcttctcttcattaccttctgcctcctccttctcaccacttaagtggcttcatgcatgcagggcttttaaaatgagattttctcaaagagccgtgtgtctgcaggtggcatgcgctggcactgggctattgggaggcacagagttgttcctgggtctctcccactggagaaagcagtgtgtttggctgagccagtgacacagggctgcccgggagcggcaccaccactcttgggacaggtgggcaggcgctgttgatgtccctggatgttgtcccttcacctgcagtttgtcaccaaagccccgagggactgtggtagagacacagctagtggggacttctctgttcgcacagagactctgcagttgcagctacatcacactctggtaaatagcgcctctggcagtgggttttaatatccacgttggttgttgaagcagtatattctaggggtgcctgggaagacagtcgtttaaaatgtctctgctttttataggtcagtttttcttcttctttctcactcccttgccaattgttggacttaaagtttgttggaaaggcccttcctttattttgatttgtgcctgtgctttgctccaaggcaggccactgggggcattttttacaccgaggacttggttggaaccgttaaccagtggctggctggtctgtttgtttacaaggcagccccgcagccttgttctgagctggctggctcctagatgttatttggatttgcttcctctggcaccaggccctcctccaggcaggcgcttgggcaggctggtgggactgatgggtagccttgctggggacgtgtagtcactgtggcgctgccagcaaactgttctttctggaagaggaacgcttggtgcctgggtgtgttcagtgtgttctgttgtgcatcagagctccctcagacgtcgaccgcttctgattccctccagacagctcccggtggacatgcagggctatgcggcctgccctgggggctatggtgctgaatcctgacaaaggccctcttctcgggctgtcagaaaggacgaggctgagtcaggctttaatgtaaaccatcactccctgtttttctatttcttcgttgaaagaagcactgatcattgtgttcactagaaacacctcaagtttttaaaaggctcctctcctgttggtgtgactcgagggcgctgtgacatcctgagaaagcggggactctgggagtctggacgtcaagctggtcccgtctccacccgccttgagttctcggttctcgacagcgcccgtgtgatgatgatgctcacgctccggtgtgacacagacggcgcgggagctgcacgggagagtgctttggaagtggaagccgcaatgtcatgtaagctgttgagtatgaattgtatcatatttcacaatccacagagtattctcccttatggtgtcacatttgctcttactaataacccaggacttgtcaaagcagacgtagtgcataaaacatcactgtgttactgatgaggtaccagatgctccgcgtgcggccgtctggggtggacagcttcatttatggcagagccaaacaggagcccggatcttctgatcccaaatcccgtattattttcactattccatgctgcctgccttcaccaacgtgagctgaagttattacatgttatcactttacttgatgccgtgccgtactttacacgagaaccagcttcccgttggggactttacagagctttcggcagggacagtaatgggggcggcccctgggaagctgtgcaaagtagcatttgcggcgccacatcccgcagtgtttcctgaggactcgctgtgtgcaggggaccgtaagatgccacagagaaatcaaggaggctgcggacacagtgtctgtcctcaagtcattcatcattccctttctctgcccctctgccgtggaaggttttcaagtaattaagctgcttgcttatatgcagctttcctccacgggccccgcctgtgcgtagtcgtgctctggcagagtctctgcaccttcctccctcgggctcctgggcctgtgtctgtccgtcctccactgtcttgctgtctgcatcttcatggtgtaagtctggcccctcagccgccccacaagcctggcccggggccaggcttccagccgctgcttcaacccaaaggtggaacacctgtttcctgcagtggagaagatgggaaagccttttctgcagggcttttactcccacttccttcttgttttcagccattttctctgtgctgtttttctcctttcttcctgagactttcccctttgacttgttcttagtcttctttctttctcttttgaacaggtagcggtcttgttatgttgcccaggatagtctcaaactcctggcctcaagcgatcctctcgcctcagctttccaaagtactgagactgcaggtgtcagccccatacccagccagtcttctcttttctttactttgagtttaggcttcttgagttgttttcttcttctcagatgcttcagggggtagctgagaatgttgaaaatactaaagtgcagcagaagcaaggaggcagagccagccctggtttcccactgatgatcaaatttctttttagctcagaaatactggcttatgcctaacccatcaaaggtgcagcattgttgggcacaggatgaaaaacagacagcccccacgtttggctgtcaaaccacatgacccagaaatagccatcattgtaagaaccccagagggagcctttgctatcttttaatttattgcacaaataatattataacagtaaacaatgaaaaggaagaaatgaaagaaaaattacccagaatccactgtttttgctattccatattcttcatacatttgtccatatatgcacataattttacttacttggaattaaatatattttgtattgtttttaatttgaagatcactgattttatattgctattgatattttcaaatttagtattccatcacatttatagacagtattacttaatcatttccctcttataaaattatagtgcttgcaaggagttttttcctgttcatctttgcggtacatagaacctttccttagctgtccatggtagcatgcagctgtagtctcagctacgtggaaagctgagatgggagggtcacttgagcccaacagtttaaagttatgatgagctatgattgtgccactgtactctagcctgggcaacatagcatagagtaagatcctgtctcttaaaagaaaaaaataataatattttcttattttggagtatttcttagaatatgtttctgggaataagatcagtaggtcaaagtatatagctcttgatatcttttgccaaacttccttttttttttttttttttgagatggagtctcactctgtcttcccaggctggagtgcagtggcgtgatctcggctcactgcaagttctgcctcctggattcaagcgattctcctgcctcagactcccaaggagctgggactataggtgtgcaccacaatgcccaatannnnnnnnnnnnnnnnnnnngtttcaccatgctggccgggctggtcttgaactcctgtaccttgtgatccgtccgcctcggcctcccaaagtgctgggattacaggtgtgagtcactgtgcccggcgctgccaaacttctttactaaaaggttgctctaattacacggccccaaatcacacatatatgaaagtgtcattttcaacacaacattattttcagagagaaaatgttccttactttgcatattgcaggggaaagactgtattctgcaggtcctgtacgtgactgcaagaaaggaccagtattacaaggccagagacagagaaggccccacagtgacatctggaccgaccagtattacaaggccggagacagagaaggccccacagtgtgacatctggaccaaatctttttggtgaacccaagtgctgagttattgatcaggaagtgaagggggaggccgggcgtggtggctcacgcctgtaatcccagcattttgggaggacgaggtgggcagattacctgaggtcgggagttcaagaccatcctgaccaacatggagaaaccctgtctactaaaaatacaaaaattagctggacgtggtggtgcacacctgtaatcccatctactggggaggctgaggcaggagaatcgcttgaaccagggagtcggaggttgcagtgaaccaagatggcatcattgcactcccagtcttggcaacagagcaagaccctctcaaaaaaaaaaaaagaaaaaagaaagtgaagggggagcggaggccagtgtgggaggaagagacaggaaaggtcatctggatagtaaagatcacctggtttcatgttatttcgaaatttacggataattttagatatgtggttgaaaactattaaaaacttgaatattcaagcaggactagagaaagtgtctctggtatgtcttcattccagccgtcctgctgtgtgtgaagtggtatctcactgttccgctttgcatctccctaacgactaatgacatcaggcatctttttatgggcttattggcctttgttgtttttttttttgagatggagtcctttgaggtgggaaagttttattttattttggtaaagtccatcttatctattttgttgttgctgtcacctgtacttttagtgtcatgtttaagaagccgttgcttaatccaaggttatgaagtttgacgcctgcgccgactccagcacttttatagctttagctgttacgtctaggcctttggtccgttttgagttaatttttgtaaatggtgtgatgaagtcttaaataagcatagcttggacttttggatctatttttaactttgagaatgttttctgcaggaatggcagaaatagatgtattgctggagtgactttggaactgtataaagaaaaggtgaacgccagaggctgaagagggaaggagctctttccctagcaggtttctgtgtagcgagcatccgtggctggggttaaagtgttatttcattatgcagtttatcaaatgggaaaagacaaaacctaagggcatttgtatctactccataccataaaagtttgccattttactttgatcatataacaactctgaaaaatactgtttttcatggattaatcaaattaccaacattactttaaaatcacaccgagtcactctttctgtgccgcaaggtgctaggccagtgacatctctgatcttgggagcagctgttaggagcctgatgttaatgacagataaaaattgatgtcagatagaaaattaacctccttcagggtatgtgaaactgcttcccctaatcctatgttcttccttagcaaaccgaatgcaacccaggagctctgaagaaggaaaatgatcagctgtttatctgcttggcaccctttggaacagtcattttcccatctcatttgaaagcagcagttagaaaaatcacaaagaaatagtctttctaaagttttccttccattttaattcttttgtgtttttcttcatcacattttccatacaccccacacgattaaagaatggtcattctgcgtttcaaggggcccaggcgggaggatcacttgagactaggagtttgagaccagcctgggcaacatagcaacacccagtctgtaccaaactttcttcaaaaaattagcctggtatggtggtgcgcctatggtcccagcttctcgggagaaggaggcaggaggatgactagagcccgggagttcaccactaccgtgagctgagatcatgccactgcactccagcccacacagcagagtggggcaagacctggtctcttaaaagaataaaatattgactgaggatcaggacggtaaaatcacgagacctcagagaaggaacaactgtcgtggcacctcatgtgcggtgtctggccgcggcgcctgcgaatgggttttgctcttggttgtcttggaaccaaacatctgtgtgctggcatggactggacatcgccaggtgtttggaccatatctttgtggtttagcacaaaaccaagacatacagtttgtacctgtcatagtcactggagaagccgtgctgttaattgatacagaaacacagccgtgggctgagatgcaccttctgagcccatggctgtcctcagcctcatcacagaccccacgctgaatggtcctgccggactaggcatgagggctggagctcatgtgtgcgcccgtaagctggctttccattcagtggtttcaacttctgcctgtagaaacaccaaaattgtccatgaggtaaatgaaaatacatcccaggacactctcactgtcctcccattgtctggtgtcttgttgagggctctggccaggtcaacaggcaactgttttgtcctgtgaaagtgtggcgcctccgtggctttctgggagaaccgaagagagagacttgcagtcggcgaggaactccttggcgcaagcagcgtgcggatctcctcatgcttctgccgtgcctacgtgcactgacgtcgtcacaggtgggggataagattccgtcgcggtcggagttttcctgtgtgaacattgagatgtgcaattccgtgaccgcaggcactgcccctccgacacagtggggttcatctgcttgcggaagcctcttaagggcggttgggagagaccctcagtggcgcgtgtctggaggctgctgacctagcgtcgcaaccatagaccaggaacacaagcagataaaagcagcaagtgggacagattgaaccagctcttggcatagtttcccaccccccagctagttcaggagtctgtggacaaactgtgtttcaagcatgttgaacaacgcagtgtgcatttccaagttcattggaaaatctatgtgagttcacttgtttgccaccagaatgccaggagtgagctccgttctcggggtgctcttccttagcccccagtttttgcggtggcttaaggctctgcaggagtcgggggtacccaggctccactccttggcccgactccatgctgttgcggctctcatctgctgtgggaaactcgctcctcgtggacattttccacgcctctggctggatttctgctcagtagccttcagccagcggtgttctcatcgtgtccatctgcttctattaagttaatgggcacagacacacggcccataaagcagctggatcaaaagtctggttcttatcagacgacttaattgataaatgtcgcaatcacaagaagctgaaatgctgttgtgcaatgacttccagaatggtgttctgggcacgtcagcttccctaagtacaactggagccgtcggtggagaagagcggaaagggagagttcagttggtaggagggaggggtccagcgagagacagggatgtacacgaagtctgtttaactttacatattgggtgcagaaaccaccacggtttaaatgcttaggaagacaactggatagacggtggtttgtttctagccctgattctgaactcatctgtcctgaaaaacagttgctgacaccctctgaccctcagaggcggtccgggctagaaggggattagtggaggacatctcggcagggctgctgtaggcggatgttgtccagtcagagcggaaccgtgacctgtgatacgtatacttttcatttttgccgtttatgctatttttagattgtctttattttacatattaggaatttgcacacacgtcaggtgagtcctaagagtcacagaggaagttccttcttagcctgtggcagggtggatcctgcagctcccttcccccctcaccctccccccggggggcctcactcacacagcccctccggctccctttctttttatgagctttcaccttactctgttttcctcttttcttcctgatttccctaattgagtttgagtcagtgcattgagcgtgcgctctcagttgtcaggggtacacacttgtgtgtgattttttatgtggctgagatgcaccaggatcctgtcgcctcagcccactgtggtctttgggtgcagaggagggttcttatgcccagccacttagccagcagggtagctgggggtgagtttcagaaccttctgaacctcaactgtctcccctccagggcaggaaggataataacacacatctaagcggggagggtgataattgtgcccatagtctaaatctttctcagatcctccggtgacattgccgggtggcctgagctaggaggaagggtgaggacttaggcagatggaggactgtgcatttcagttttttgttttaattaatttttttaactgacaagataacttagagggattttttaaattggcaaatagaatcttcagctttgccttcggttccctcatcgtagggtcagctcgtggctgccaccccaagacaacacttcctccccgtggccgccctgcggttcccttcttcccggagggtaccaacgagctaggcctggtgctgccgaaaaggaactcaggaaaaggtttcaaaatttttaataggaagaatttcccaagtctaaaatacacagaacttactcaaaaagggccccttcttgtggatatttttaagagtacattttgccacgctgtctcgcgtggggcctctgcagcagctgagacgtttggcagtttcttcaagacttggagtaaaacctcgcctgagatagaatctaaatacactgggcttggatcgcccatttgactaaatttcgatcccaactctagctttcagaaacctccttatagggagagacctattgctatgggaaggcaagagaaattaatgtctgcgttattccagcaaagcccctgcactgcgctggagggacttttgtttgcgtctttgggttgcagaaggggctatgattgtgcgtggcttatcttggtctccagcccagtttagacctccttctagctgatctcttctctcacttgtactttggaagagagtcagggcttggctttgggtcaccaggcatgcagccatgtcagagctctggagccacctcggttttgtccctgtcacggggattgactgattcttaaatgatctgcgcgaggcggccctggagcctacagcagcaccgttcccccagggtatcgctggcctgtgtttcacatagggtcagctcttcgggggttgtcactgagtagtaagtgctgagccctcctgtccctgtttgcagaggcagcggctggtttctggctggccagtgattcctccaccctgtgaacacacgtggaaattgacacggtggactctgggatgtaggggaaggctctgggtcaagggcatggcttctttatatagaaagaacaagtcagatggcaggaaagatataatggtgggtcatttaagtattggttctttgtaatttaaaagaatcactttatttatttatttttttatttttatttttttttaaagaactgagttttatgggtttgccacaaagccattctacatccccgacaagaataagaataggtgaggacccagcagtcgcatgtgaaaataaacggtgtatttagcgggaaactaatgcctcttgcagccatcaggcactgttttcccttgatcctggaacaccttggtttccggggatctcagccccagccgttgccccatagctgttcctcagcaccgcagtcgtggaagccctgtactgaattagaaccgagcagccctggctctcaaggggtcacggggtgagaggaccagagttctgcaggcattttcacgtgagaaactccagtcctctgtggctgtcccacttcctgacagcttggcttccttcaggcagcctgagtattattcccatcttagctctgtcggtatgtagtataaacacagtccatgttattgatagtttcttaggtaaaaacacattaatatttgaatcgggccacggagcacggagaatctgaagttgtcgcaaacaagctggctgtaaatgggctcctccagggcaaggcacaccccagagctactgggggaggtggaagcttgctgtgtgttgtgtgtgtgtttcctgtggttgatgctcataagcgttacctccgtggaagaggtttacctttttaggaaagagttggttttctgcttttgcaaatttgtaccaactgttgatcatctcaaggacagtggagaagggacaggcaaggagcctccctttcagtcttggcattcttcgaaaatagaaggtggcttccttaaatgatttcccgacttgactcatcaatgtaggaatgcctgtgttgacactctcttccccctctctctctccgtctctgtccccatcccttttactttttattataggacagttttcaaccattctgtggaacagttgagaggatgataaagtgaaccctgtatatattaaatcacctacattttacaattatttgctctgttgttttgtttttgtgggtatgtttgctaaattacagacaacatgatgttttaccacccaaatacttaatcatttcttttttaaaaaactgacatttttcttataaccaaattatcttaactttttaatgtcttttgaacccaaatggcagagcccttgcaattagccttgttcccgtggaaggtgtattccattgccggccaggctcatgcatccagcaggcgcctaaggggctcctccgatatccagccagctctgacaatggggccgtagcccagaacaaggcagatgggattggctcattatgtgggttggcagaaagctccgatgaggtgttcatctgtatttctcttaccaatggaataattgtttttcctttttgctagcttgcttctgtagcacggagggccactatgaaatagcgaactcttgcacttaatttgtatcttgtcctgcttaccggcctagaagctcctaaatagagtaaacttttctgtacattacaaagtgcagctgtttaacgtttgcaagttaggaaagtcgcttctacttggttttcttctaataatactaaaaggcatactttttttttaaggcaaaggatctcactgtcacccaggctagagtgcagtggcacgatcatagctcactgcagccttaacctcctgagctcaaacgatcctcctgcctcagcctcccgagtcctctgaccatgcccagctaacttatttgtggagatggggactcaactgtgctgtccacgctggcctcacactcgtgtcctcaagtgatcctcctgccttgggctcccagagtgctggaattacaggcatgagccaaaaaaaaaacacatacttttaaatttagttacaaatatcgcatgatttggcacattaatttcatgtggggatgtttagttctttgggttttttttaacctgctggattaaatgaaatgctgagagttgaagaaattggcttattttcctttttcttttctttttttgagatggagtttcactcttgttgcccaggctggagtgcaatggcacgaactcagctcactgcaacctccgccttctgggttcaagcaattctcctgcctcagcctcccgagtagctgggattataggcacccaccaccatgcccagctaattttttgtatttttagtagaaatggggtttcaccttgttggccaggctggtcttgaactcctgacctcaggtgatctgcccacctcagccccccaaagtgctgggattacaggcatgagccactgtgcccggcctattttactttttttttttttttgagacagagtttcgctctttttgccaaggctggagtgcagtggcgcaatcttggctcactgcaacctccgcctcccgagttcaagtgattctcctgcctcagcctcctgagtagctgggattacaggtgtccgccaccacgcctggctaatgctggttttttttgttgttgttgttttgtttgtttatttagtagagacagagtttctccatgttggtcaggctggtctcgaactcccaacctcaggtgatccacccgccttggcctcccaaagtgctattttaattgtgtatttattgccactctgagctatatttgaaaattccttttgtgaaaaagaatatttaaaaccagacacctccagcagtttgctgtatctctgtatgactaggttaaaatgcacaagtctgtgaaagcttcagtgacaccttcatcagtgtaaattctagagacttcacgtgccagctaaggtgaagtaagccacctacagcctctctgtcccgctcattacaaagaaaagctctggtcaggatacagaaaagcaactaccaaaggctaaaaatgagcagggatattagggactggagtcaaagtcagataaaatatagtgatgaatctctaaatgtaaaacattttatttgggaagcaagatttacagtcgaaggcatacaggcagaccaggtggtcttcagtatatcttgatgaacaaataaaaggttggcagttttaaaaagaggagaactgtttcgtgttgctctttgagaaggttcttcggcactagtgaggtttctggggagctggcaggttcccgactggtgagtgggtgaaatgagtcctcgaatcacagcaggttgtgtcggttgccattagtgaaaactggtttcaagtggcagcaggcagtttccgcggccaggctggcagagaactacattgctggaggaatgttttgtggcccgagtgctttcccccggccccttgactctgactgagttgggtatgacaagaatgacccagtttgtatgatcagctctcacagtgacaatgacagtcatgatggggatgtgttttgagggccttttcctctcctttgccgaggaactgcacagggaatgctgatggcgagacctccagggaagccacttatgtcttcaccactagagaaggggggactctgcatgttggcgagagcaggggggtgccacactccagcacatcgtgtgttccccttctaaccgggaagctctccttgttcaggagttttcatagagcgtctgtccatggggagaggagtggctaggtggggtgggtggtggtgtcccggaaccagtcccccagggatacccagggatgactgtatatgcccggaccaagtcctgaaggtcatagcagaggccgcttctgcacagtggggtgggagagtgaaagttagactgacgcacttttgcgtgacacatgtctgtatgatttgggtttttatagtgaccgccatttgcttttattctaaaataaatcagcatgattcagtgttgtgtaaaagataaatatgaaaatgctaagctatctcaacatggtgggtttatacaaatttttcacttttttatggtaaatacatgtgggtttttttttaattaggaggaaacaaaggaattttcattctcaaaaatgaaaacagcattcaatagttatttgtatgatatttgacaaggttaccgagctgaacattaatttgttcttcattgttaaaagaaaactctaggcaaattgaatacaacagagtttaattgagcaaagaaccattcttgaatcaggcagccccagaaccagagtaggttcagagtgacaccggcactgccatgtggctggataccattcatgggcagaaacgaaagtgactccggagaatggaagagccgcagcagctggattggctaccgcagggggtctgccttgcttgagcccagttcgaacagttggctgcctgtggtagtctgagactcagctgcctgtcacaagaccaggctgtttatacatcaggttgggttacagttcaccatgtatatggaaccattaggccaaacataaaacatgtacggaggcagcctttaggcgaaacttaatttaacatcataaaaatcttgaagccacttgtttgcgtacccagcctggatccgtcacaattcttgcttcatgccacactcatcactagtccatatttggcctccttttaagcagttaattaacaggtatttttatagcataatgggtttcctcaaaccaccacccaaccaaaacccagcccttgatgatgacctgcgcccaccacgcagggcgcccttgatgcacacgcacctgccgcccccgccctgtgaccaccgccctgagtgccgggctcatcatcccttccatgccctttctacattgctactatgcatctgtgtgtattcattaagaccattacttttctttcagattttaaatttattaaaggctttagtgctgaatgtgattttgaggactcttttaaaaaaatacttttggttggaatgtggacatttcccacttagcattgtgttgctcatgttcctccatattgatgtgtgtttagctagagtacccccgtctaactctgcgaatatgccacactgtgtgcacctgctactccttaatggacacttgagctttttcagcttcttcctttatttgtttgttttgctttgctttggtgtattgtattttatttttgctattaccaacagagatactttgaacattcttttctgtgtgttcttttgaacacatgcaagaatttcttatatattgaaaagcagagttgccggatcatagtgtataggaacattcagttttaagggatcatggtaaggtgctttcccagtggttgtgccattttacactcctacagtggtgatggagacagcctatgatccacatcctttctagttcttggcattgccattcttgtacatttttgctgagtaggtttagaatgatatctcgtgtagcctggatttgcgtttctctcatatcgcatgatgttgaacatttcctcacgttcagtggccatagttatgtcctcatctttgagatgtctgttcatccatttttctattggatttttaatgctcttgtggatttatatctaggttttcaatcctggttatgatggatattgccaccacctttttgcttttcattttaggacgactacaaatgttaacaagtttgtgtgtcatcattacttcatagatccccttcagcgtctcttggagttttctcccctctaactttagcttgtcatctgaaagtgtcttcctcatgagtctttttgtgacaagtcttctgaggccatatgtgcctctgagagtatttttgtcatgctcacacatttgaatgacagtttggctggatacaaaattctaggttttagcttccttttcttcagtaaattaaaaacaccagctgggggtggtggcttacacctgtaatcccagcactttgggaggctgaggtgggtggatcacctgagttcaggagttcgagaccagcctgaccaacatggcaaaaccccacatttactaaaaatataaaattagccgggcatggtggcgggaggctgaggcaggagaatcacttgaacccaggaggcagaggttgccgtgagccaaaatcacaccactgcactccagcctgggtgacagagtgagactctgtctcaaaaataaataaaataaataaataaaaataaaaacaccacttcattgtcttcctgcatcctgtgttaatctgataaaaataaaaacaccgctccactgtcttcctgcatcctgtgttaatctggttcttgtttctttgaatgtgatctactctttgtttctggaagctttgtatgtattttcattgtctttttaatattcttgatcttcactatgatgtacctaatttatgatgttcttcctctgtatatcataagacctcacagaatgtgacgattaaaaaaatcagtataaaagacagaacaatggtcgccaaataataagcactaaataagcaacagctgtgttatattatcattatattcagctttgtgggttttttgagccatttttattacctctgcctttgcccactctttgacctttcattgctcagcaacactctgatgtaggtgaatgaaagaaatcgtataaaatgtgaaaccagttgttagcaattctggtataaagagaatttacatttttggctaaaatgaagtttgcatactatcagtgactgatttatccatgctacgcttattcatatagccatgctataataaagttgcatgatattcccattttaattttttatttaagggaacattatattttcactgaatttataatatgcttatctcccagccaataattatttttataatgtgtaagtctctgtgtactaattccaatatctggccaactatgaatctgtttttattgacttttttctcttgattttagatagtatactatctgttgtggatgaggcattgtagacattctagattctgttattttcttttgggcaattacactgatcttgtagaggcttcgttataggactaggctcttttggctttgatcttagttctaaggtgtggttcataatccctctggggtgtccatgtcctcagatgtgatcaagccctgtagtttggcaggacctgatcttctctgtcttcacagtggcaagcagatgtcaaaatctctactctgcgttttcaaccttcctgctgtcctccacggggatcctgggaatattatcctgtgtgcgtgcccttcaggagccagcctccgactcggggaaggtttacatgagggttttggctcccttcttcctagggcttttgcctgcaatatccaggcagccttgagcatggtctcaacccagtaaggctgctgcctttcagtcgcatgctaacccccacatgacttgtgagtgaggagcacccttgggaaaagccagatgaaagtgattcatgcagagttactctcattttctaagggtcacagcccttccatttcctgccttcctgcctgcatttgtttgttgttcagaattttcaaatggctttttaatattttgtccagagcttatcattattggcaaaaggatgagtctgatataagtgattctgtcattactggactctagaaatcccaatcagtaagtacattatggataaaaagacaaagtagcatggttcgcataggactcagatttgaaaatgcatttcctgtagatcatttttatccacagagaaattctggtttgcctgggaccaccgtaggagctgcatgtgtctgtgctggtgcagaggtgtctgggcatggctgaggagagcatctgcaagtgaagccagcagaggagaccactcagagtggcactgactggctcggggaagcactggggccacacggggcacttgatgccgtgggaaagggctgctctgtagcttcaggcaaacgtgggcctcacttttattttctcagctctttgaacgataaaacactgactactgcagccacaaccaagaatataacttcctctctgctggctgagccaggtatcacttcttgagagagtgagtgtggctggcagccatgcatggggtccaggatgaccagctcagcctcccctcgccctgcagggctgcaaaagtgagactgtcttcacacctctggctcgttgtcttcctggttctggatctctcagttcctctgtgtctttttctcccatttcctatcccactgctatgggtaccctcctgggtccaccatcccccatagaggagtcactgccacgtctcccccgaacgtgcctgacccttgcactgcaccctcccctgggccactgtccttctccatcactcacttccagccaacacttctgccatcactcacttccagccaacagtccgcgagtgtgttttggagatgtgcatacttgctctgcacctgccattatgtttttaaggggtgttatttgttcttaattttaaaagtaggtgaattaaacattttgcatttctcctactaaaaatactgcattgcctttttactctgctgcctcgattctgcccactgtatgccagtagcccggatgggaggagagatgctttcctacctcctgttggcgccacgttagagaaagcctgtccggctccacacgcgctcctaaggatggacctgcgtcagacatgaacccagctctgacctgtaggattttatgattatgaacatgatataattgaatttgcatttcttttgtgtgtcttgaggctactcatttattctactccagcagtctccccagctcacttccttaagaaggaaagaagtggcaggtccagtccactccagcatctcgtttggagactgagctttattaagcatctcggcgctcctctccagggaccgggcttcatgtggctgcaaacggcttctctcctttctcctgacaactcactgtggcagctctgtagtctcacgccttgacagaatggcaatgagattttctttacaaatctaaaagctgccgaattaaggaaatctgagtgtacttgttcaccgtggtagtccctgtccccacctttaactcttccctttttctgcaggcctgttgaatttcctgggtgactgttccattcgtgccgttcacattcttttctttctctgcaggttttgcatgcagaaatgtgtcagtctggtgcctggcgtcacactggatttgatagaaaagtaagtaggatttttaagctcttgtggctctctggatctgatgagtttcttttcctttttgaaggctcttgcttctcagaagtactttctatcaacatggcatgttccctttcatgtggctgtgttcttttgttctctgattaaggctgtgtttgtgattgtcacactggggcttagtgcaggagataaccaaacatgggccatatgaaaagaaaaataataaaaagctgaattcctttgaacatttaaaaagtctccagactttaagccaaagcaagaacataccacttcgcatacaaatcatttctgctgccactgaaatgatagctagatcatagctagctcttaccttattttctgaaactgtccctttaatattctgtaactttccatcccctccccccctgtcgccatccagtttccattttactatctcagggcaaactgatttcagaacctgagcgatgaagtgacgggatttagtcaggcctatgaagagtcaatggcacttgcctcccataatccttccagtcccattggccaacccgtctgtccctcgcgtgatctttttggatctgaagtggtgtttcaggacccggagcgtggcctgcactgccttgttctgtttgtttgtgcaccggattcatcgtgactcatcctgagtcatccaggcagtatggaagaactttggagttattttaaaccctttggctcagaaccccatttcttctagaattaacatgcaagataattgttttctacatcttaatatacaaagttatatcttaatattagggcctgaatttactaaattaggcaggaaaagcaaccccacttccaagtttctcttgtaaaaacgtgcttgccttgtgtatcaggggaaaaatgcaagaatattatgtgtaaacgttcatgagggcacggtgagctccgtcgtggttcactcccaccgtggaaggtggctgtgtggccaacaggaaggccggggaagcgacactggtcctgatgtggagtggtctaccagatgtgctaagtgagcagtcctcagcatgggtacctaacagagctcagtgcccagaggctttccaaacagtgcaagctgtgacttagaagactgtttccaaaggctaaacagatagtggaggctctcagaaacatcacgtggaaaataactttaaaaaaaaaatgggactagatgatctgtgctcccctccccttctggttggtttggttccctgacgagactgcagttttgcgaagctgttcttgagatctgtttactggtattgctgtgcgctttctttggggcttttatttccccctctgttttctgagttttagagctctctattacctgtaacgtatatattgcccccgccacccctgcgccctccccacacacacaccggatgcgtatcccaaatctaaaaatccaaaatcagaaatgcatcaaactgtaaaaaaatttttaatgaattaaaaaaaaatagggcatcttgctgtattggccaggctggtcttgaacgcctggcctcaagcgatcctcccacctccgcttctcaaagcgccgggattacaggcgtgagtgattctggccgtgccaggccaaaatcggaaactttttgagcactgatgtgctactcagaaacaatgctctttggagcattttggacttcatgttttcggattagtgataaatccaaaaaacttaactggtaagtataatgcagatattccaaaatctgaacaaattcgaaatccgaaacgcttccggttccaagcatttcagataaagggacacttaacctgtgtatatatattatatatctaatttcttaaataaaccatatccattaatatttcagcagttatattttatccttgctgggttggcttattcaggcagctcttgggtgaaaactgtcttggtgttttctgtttgtcgtgcctccctgtggctatttcgatggtttcctctggaggtgggagggccgcagtatcctttctcctccgcctggtagcaggagcccaagccttacccacgcctccatctccgtgtgggacagtgtctcgtctccatcctggatggctgctgtgtgctgtcccatcccccctggtcacctgtgtctgtggctactccggacagagccccccggtcacctgtgtctgtggctactccggacagagccctgccagcgcgtgttgagccacatgagctcagacagcgccacaagctccacatctctagagcaaaaaggtctgttaaaaatcacctagtgatgacaacaaaaatttgttttaggttattgagtcaaactaccttattttactgagagagaacctggtatttagttcacttcagctcctgggtggccttttctgcctggttcgggcagggctggcctagagctcaggtctcaggacagccccactgtcgtctgcccaacacacggaggttttcccttgaacaagattttggtgtcagaacaaccagctgcctccctgtttctttccaaaacttaaaatgtgcacagcaacatgacatcctaagcatgattcacaaaagaaaaaaaattggtaaattggacttcatccaaatgtaaaatgtttactctctgaaagacacgctgatatgaaaagacaagctatagactcggagaaaatatttgcaagtcacatatctgacaaagaacacatgtatccagaatgtataaagatatctcaaaactcaaaaataagggggaaaagaaaattagaaaatagaccaaagacatgaagagacacttcaccaaagaggatttagggatggcaaatatgcttatgaaaagatcctggaaatcattagccattaggtaatgcaaattaaaacacagtgagacagcactgtccctattagaacggatgacatttaaagactgaccaaacgcagtgttgagaactcacatcacagctgctgggaatgcagaatggtgcggccactctggaagaactgtcggtttctcataaatgtccataaacctgccaacatgtccccgcattcctactcctggatatgtaccctggaagagggaaatcttaggatcacacaaaaacctgtgcgtgaatgtttacggtagctctgttcattaccccaagccggaagcaaccaaaatgtccctcccagggcaaatgaattcagactgtggtgcatccgtatgatggaattctgctcaacaggaaaaagggacaggctttctatatacaccgccattcgggcggttcccagaagtatcacactaagtgtcagaagcccatctccaagggtggcgcatggtccgattccctttctgtgaccttctgggaaagacagaacatggggccagagaacagatcagctgttgccagggattagaggggtggagagtgtggctgtgaggggctagcgggaggggcctgggggtgatgtcttgatgctggtgtggttccacagatccacccacacgttccaatccatagcatgtgtacctgcagaagtcattttgctatttgacaactgaagtaaaagtaatacataatgtaggggaggaaaaaaacaccacgagagtgagcaggccggagagtgcagagcagatgcagcacacggctggccaccgctgcggacaacaggccatgggcctggggagcgaggggtgcagggaaacagagacctggatttgggaaaggaagtggattctacagcagcatgctctgttgtttctgggaagataccttcactcttattattaaaatgggattgagtgaggattgaaaaagagaagcaaacacccttccccatccaccgtgggatgttagtcattttcatcagacgccctttccctaaatcacgatgttagcgtttgcagccactcgtgttcttcccagaaccagtgcatcccctccctccccagcaccaaaggcccttctcagccagtgcgatcagacagctggaggttagggcagtgttctcgtctttcttccatctccccttctcctgtgccaagtgatgctatgaaggtggctaaatgctaaaggtttattttttttttttaatttaaaagagacaattaactgttaatagtaggcagttttcaaaacacaccctgattagggattcggggtacgaggaggagagtgtggtgggaagaatatggacgttggagtccgagcagctccatctggccctcctgaccccttctgagccacactcactgggcacctccttgcctctgggtctgtctctgtcctgcagaatggacaccactcggctctcattgggcagcagcagtgccgagggcatcacacatcctgacacgaccttggctctcagcccgtgtccgcctcccgccagacacttctgccttctcagcacttcccagagctgcagcttggatggtggctgctgtcactccacattcctgtagttctgtaagcgtctcccacgcctctccatctgccatcagctgaggcacctacgactcccaggcatcgttgccctggccccaccacagttagagagagatggcaaggcgccagagaggccgtgctctcgaggcccattgctgagacaaatggcttagcaggctgttttagtccattctcacactgctgtcaagacactgcctgagactgggtgtattagggttctctagagggacagaactcataggatagctataaatataaaggggagtttattgattaatattaactcacacggtcacaagatcccacaataggtcatctgcaagctgcggagcaaggaagccagtctgactcccaaagctgaagaacttggagacactcagtattaaccatcacactgggtaatttataaataaaggaggtttaactgagtcacagttctgcatggctagggaggcctcaggaaacttacagtcatggcagaaagggaagggtaagcaaggcatgtcttacatggcaggagagcgagagcacaccagggaaggggaagtgccacacttttaagccatcggatcttgtgagaactcactatcacgagaacagccactcccataatccagtcacctcccaccaggtccccgcctcaacacatgggtattagagttcaagatgagatttgggtagagacacagagccaaaccatatcacagtcgctgtagccacctcagtctttattgagaataacttcttaaagtgtgtggatttgggtctgagtcactgttctctgaatgcagttcagcaaaagcacctgttttagtgtctttcactaagaatccacgtcagcactcacagggtgaactcccgtggtgcctccgcctcacagtgtgacagaggttaaattgcgggtggctgaattatatttacattttttatgccaggacaaattccaaactttagaattatacagcaatggagaaatccagatctttgctccaaaaggtgcccagccacagctgccattagctctatttccaagtggacgtcagtttttaacttgcatagacacagtgacttctccgcttaaaaacgctatttttatgtttttttaatttttggattttgttccccaattatgtttaaagtctcataagaaaagttttttgtttgtttggttgtgtgttttttgttgttgttgtttttccagacagggattcgctctgctgcccaggctggaatgcagtggtgccgtctcagctcactgtagcctcaacctcctgagctcaagtgatcctcccacctcagccacccaagtagctgggactgcaggtgcatgccatcatgcctggctaatttttattttgggttgtttggttttttttgtagagacagggtttctctgtgttacccaggctggtcttaaactcctgacctcagatgatctgcctgcctcggtctcccaaagtgctgggattatgggcatgagccgctgtgcccggccatgtcttttgcatattgtattatctacaaaggacatgagttactttttaaataagtgatcttgttaatcaagtgatcttcctgccttggcttcccaaagtgcttggattataggcgtgagccaccacgcccagccaaagaaaagtttttaataagtagatttgattttgcagttacaaagtgaggcagaaaattcagcacatctatgtttaatagtgtcttccatgccgctgtggtttttacagtcagaggacactcctataaaaaatacctcgttatttttatactttatcattttctgaagatttattcttgaaatatgttgatcttggttactgtgacctctgtggctcagaccctcttggccagcctttctactacctcagggcccctttttcccacgggggtcccaccaacatatgttaactcccgtaacgctagcccacgtgtcaggggagacagatccactcggaaagcagccgtgcggtacagttgagagacaaacagatcatcatcaagctctactgatgaatgcggcccctgtgttccaggcagccaagactgagttcccccttatttcccttcactgaacatgtcagccatgtttgtgatgttcttgtgtgtcccttgccctgagttgacgctgggaccagggtgcttgaggatgagctcccagcaattccaggctgtgcctgtcaccaatgtgccccgggcaagggagtcacctctctgacatggaagcccagaggttaccttctggaagcaaaccctgtaaccaacttccctccttacagggctggaagcgtagcagtgtccaccatctgtggaatgtcctctggagccgccttgcccatgccacacagaaggacaccacggttagggcacccatgcgtcacagcatgtggccagcagggccacgccacctcccagggaggcatctgacatgcacaaaaccttttgagtttttgtatgtttttttcaacactttcctaaaatgcagtgatcaaaagttagttgcctgctcctgcttgggacaccagtccctcagggggtttgggaattgttcctcccagactccggggctgacatttggagggtcaccgcctgacccctgctccagagtcagcaggatggcgctcctccaacaccactcctcccatcgcatgtgggagcaggaggggtgtggtcttggaagcgacaccctatgatgcgcattcacctgagtggccttcctggccacagggctgagccaaggcggggccaaggcactgcctccctccaggcagcacgtgtgtctaaaaaatttatttataagtacccagggaatatttaaaaatatataaatttttgaatagttgagagattttaataaaaacgtttgtgcattattggcagagctgtcagtgggtgctgggtgagagccacacggttgtctgggtgacacccccgtgtccctacacaccatgactgtcctcctgtccacctgagatggaactctgggttccctgagtcacacctacattaaaacgtacacagtcatccatcacgttcacatctgtgccggcatgacctccctggggaagcgtttgcattgctgccctttttgccaagaccctcccgagcgtgatatgacctttgaacctagagccagagaacctgcttgggcgtccctgccttcgttaaatgaactgatcttggatccaggttaatggtgagataacttgtttttaattatagttttaagaccaggcagaaacaggctctcgtgcttagtctgatttcatttacgttttagcagttcattattgtaaacagaatcctaaggactgtagaccgggggcgtggaaaccccaccacaacacagcacctagaacacacgtgtgtgacatctcgagtgacgcacattcggaacagatcgtgtggatgtgcagatgtcagggagtctgcagtacctgcgcatacactagctggggctggacttgatctgcttttagcttttgccagctttttagggagtctgaagacctagtttagctgtttcattcttttgtctcaactcaccacatggaaatttcttgcccttgagaatacctctcttgccactaagtgtgaggacgacgttggttcctgggtcccacctgactagtgtgacgagtcacgtgacgcaaggagaataacgggcctgtgttctcgggctttttgtttccgtcaagcttcatgacctgcaggaagtaaaaccaggtctgcctcacgctctgcacacccctcccctccctggcggccgccctgcacaccccttccctccccagcggccgccctgcacaccccttccctccccggcgaccctcgttgggagcgtgtgaaggatggtcctgagtgcaggctgcaggtgccaggtggtgatcggcacataacgtgacagatgggcaggtgtgtttgtcacgcacagacctgcatggtaggcacctgccccatgcccatgtgtccttgcccgctgccatctgagaggatgtaccctcatcctacaacagctggcccttggtgtgccaggtctgccaggccagagctctctaggggtccgtgttgggtaagtgcacggcaggtggccccctggccgagagcctcaggaccccgctgtctggggtttgggggctgagtgtggcacagcaccactttcatgccctctggaaggcttggcttttgcgacctggcctcctcaccagctcaatggcagtttcatggcatagcgtccctgctgcccccagacggtcagaaatccaacccgagtcatatcattatcctcgtctttgtcggcactggagacgtggggaggtttcgttcctcagaactgctgcacgatatgtcttccaaaataaatgcggtttatttcaaacagcagcactcaaaatcaaggctcctcaggaaatccagtattaaccccttccgagctttcgccgtccttgtcagatgggcaaaacacgttgtttagcatctcagcacaagactggagagaagatcgggcagtttgtgcataattatttagcagtctttaaaactaggagaggaatctgttttctaattaagctgctgtgtctggaagtaaattatagtgaaccttcctcgagcgacccccccagtttctaattatctatgctaacctagcagcctgatgaataagctgttgctgctgcagtacatatttatattctgaatcctttgagagagtggcaataagatccgtgcctggaaattaagggacatttttcagccctgaaacaaagtaatgcaacacttaaacagtgctagaaatattagggttttcagaaagctccggggaacctgagagatgtgaacctgttccacgaggctgctagttagtattctgatcactggaggctcaaagcgtacccagaacttactcgtgattaacattgattgtgtacacagcatattttaaaccgctaacaatccattgtcgtgaataagtgagtctctgtgtgctgctgcttccgaggctctggtagcacggctgccccgtgtggcccagggacagcaggtgcggggctgcagccccacagccctggagcttgggtttgactctggctctgaaaccttcagcattgtgttagctgatctctggttcccatctgtgggacttccgtctcatctgagcctggggatgcagtgcagaaaatgtaaggagacctgggagctgctgcttgagagcacgtggctatccgtgcttcctggggaatgatagtgaccgtaggaagcatttactgagcccccatggtgccaggcatcgtgctgaggcctttacaaacattacctgtaagtcctccctggagcccttcaagggtgggtgctgttgttatctaccttttaaaagatggggaaactgaggcacccagcaagcacagggcctgccaagcaccacaccattaggacaagctgggacagggatttgctggcagcctccctggagcctgcatctccttcccctcggcatgggctgtgtgaacagagcacgggctcctcaacaggagcccagacctctagaaggtctgcacagggtttgggggggcagcactcgtgtcagaggcacagcggctgtgattagaattcacttcatcgagggaagtcatacacatggattatgtttgaaaggaaaactatcaaaagatcccagtcttgattcaaaaaatacctttctttccaacataaatatacaatattggctggtaaaggtgaaaatcagtaattcattaacgtctgccagtcactgctgagatgagtaacgaggcactagacgctgatttagaaatgaagaggtggaagcaaaacccgagagatcgccgagcgagggggaggtgagtgattggcggaaacgggggaccgccgccacctagcagatcacccctgcctgcccgagcacagccacctcagcgttcccgtgcgcgccacgccagggcgcacggtgctgcacgggggtccttatgcccgggcgcctctcattaaggtccccccacgggcagagggaagacgggcaccgggtccccttcgtgttcgatgtgcaccccagcaaggcctccttagctcatccggattggtaggggtggaggaggcttggttctgagatgaaattgcagacgtgcagccaagggggaatgtgagaggttcagaggccaccccagggaacctgcacacagcacggagatcttccgtttccttcacagtggtacccaaaccctggtatttgtcatcaaaacaaaggcctgcgccacagagcacggagctgtaacatctgtggcattcgctccacctcctcacggctctgcacctcccagcatcctaaagaaaacgtgggctgggcgcagtggctcacacctgtaatcccaacactttgggagtctgaggcaggcggatcatgaggtcaagagatcgagactatcctggccaacatggtgaaaccgtctctactaaaaatacaaaaattagctgggcatggtggcgtgtacctgtagtcccagctacttgggaggctgaggcagaagaatcgcttgaacccaggaagcggaggttgcagtgagtgagctgaggtcatgctactgcactccagcctggcgacagagtgagactccatctcaaaaaaaaaaaaagaaaaggaaaagaaaatgcatgtgtctggatatctctaaaggaagccctcgctctgcggagatgcaggagcacagcttgattggagggcagcttccgttccttgaaggcaggctcccaggtgcagagcgaggaagaggccgcagtgaggctgagcgtgtgcctggtcagtgccccttggccgtcctttctgatgttggcctttgctcttgtgtaggagtcatctcagacggctcagtacctatggaggcacacgtcactgcggtcgcataaccgggatgaggctcagcccccattgatgcctcttctctagacgcatcgtagttcagcaggtgcacctccctccgtccagtctgccatttctccttaaccttccctgagagtctgttgctccagctccattgcccgcacggcccttcggttcctcacaacccctggttctggtggggtgcctggagtgcctcctctggcaggggtgcctccttggatctgtttatcctgcaggattcagtgccctgccgttgttcctatgtgcgtggctgcagacttgcaatcggtgataaagcagtgtggcgtgaggcgccagcataaccggggaccccgggtgtgtggtggcttttccggtgctcatcacagccacccggcgagcagcctctgaggccatctccatttaaacttctggaaaccgaggcaagggaggtggagagacttgctcagggtcacagagagtcacacgagggtcccctgtcggtggcggagcctgtgtccgcccccacccgtcctgctgtgtctgcccccagccgccgctgctggcttctcagtttgctgctccgtgctgcacagtcccctctgtcagagcctggtcgctgtgccctgtggcccttcagagaaaggcctccccgttctgatgtgcgtgtgttgtcttctgacctcgatgccagtatgttttgcgtgagtggccagctcgtcagcggggcctcgggttccaggctcgagcgcacttttcagaccccgcgtgtgtttctcagcacgtttgttcattcaccgttcattcagcagacatctgctgcggactggctgtgtgctagggcctgtccgaggctctggagccaagtccttgctcgttaacttacatcctgatcaggggaagaaacgcacataagaggagtgtgaatgtaccaggagagccatgtgatcgcacacaagagtgcctggatgcttctttgattgggcagcctgatgaggcccatgaagaggcaacactggaactgagaccacctggccagacgggagcagccatgccgggaccaggggcagcgttccagacggggagccccacagcctctgagccaggcacgagcttgggctgtgtggcaagggccttctttgaaagaggcatatgtagcttcagtatttataattaacaccgctaacctggcagcacttaatgggtctacaggggcctgtgtgagtctgactcagaccactgcatcagatggggaaactgaggcacttaggagcttgatggctacctacagaggacattttgctccatgaatcagtggcgtgacccgcagtggccgcagaaggggcagtggcacaagcctgactagtggctccgtttgcagagggggtgggggcgactgacggccagcaggagggccgtggtgttctcacctgagaaggcgggcgagcactccttttgctagaagaggctaagagatctctacgattatttccatggatgatgacccaaacagatttagtgtggctgcgtgtgtagctgctgtgtcttctagctgtttctggagaccagaatgtgcctccccgaaatatgaagaattgttgggctgaagacaattaagaagcaagtgcaagagagctcctttcctgccttctgtttccctaaagcaaaacatagatctacagagacaaaggcatcctgtcccgccccgtcccagggaggacagcagcaagccccgaagacagctccaggcccacgcgaaggtgtttccttcattttctagatgaagtgactgagtctcagagaggttaactcacctgcccaaagtcgcacagctaggagtggccgagcctggaggacagagccgggtctgtgtgatgccacccccaactctgcatcggctggcgtgtggaaggacgtccatcccttcacgtccctctgcgtgtttgtgagtgcgattctgaggaaagtggcatgagttttctgcatcaagatgcctggtctcaaagggcgggttccatgtggacctgacaaaatgaggggatgtgtacagcatgggaggagagaccggttattttgacccaagccccgggtgcccagtggtaggaggagtgctgaccttctgtgtgatgcatgcccaccaggaaaacctcagaggattatcccagaaatcaggcataaccacacaaggctgcctgtatttggaaactgtctttcctagggtgttttaacaaattcacaggaagacacaatttacaaccaggctaggaagtgactctgggatttcagcatcttttcagagacagaaagatccagatgagctcaggacagtcgggggaaggtggtggcaatctctgtcagaaccgtggagtgttcgttgaagatacttccacagcaggagagctccacgccccatcctggaagctcaccctcctcccctcccaccctctttaggccagatttttgcagagaagctccctgatgagatgcagcgtgcaggtgagagtggcgtctggagacagcctggaggcggccagtgcctccggagggaagtgctccccaaccccggctctgctggagcccgtcctgcttccccttattttaggagctgcttttctcgatgtggcaggcctttcagcagcttctcaggagactctgcttggaggtggcttctcccatgtgactcctgcagctgcctctcaggaaaggtctgtctgaaggtcggccctgacaccgggaagcccacagaaaatctgttttgcagaagtgcttcaaaaataaacatgggctcagatgtctttctgatgggctttggaatctgcctgtttaataaaaaagaatctgcttttcattatgtcatcaacatgttgaataagaaaatggggaattacccctcgcctcgctgtggccccatctctccctgtggtttttgtttgcagcctccagagtggccattcctgtccattgttgttgttgactgactccaggaaggggcaataatttgtcgttctatagtaagtcaggtaaaaggtgaattatctcctgtaatattaactctgcttactgttaagtcagggaaacttcctcccgagttcaaccctacatttacttcacaagtaaagatgagcagaagtctgtactaggggaaccattaaatacggaaggacaggatccaaagagatggcagcactgtgcatatgaaccatgtgatttagaaaccgagcagagatttttaaaaatcattaaaaaacaagccgcctctggtggtttttaaaaagccagtcagcttatgcaggggtggaattatggaactttctagtttctattgtctctcgggtgccatgttcactccaaaccatttcggtaaccctgagccagtatatcctcctggagaaattaacaactgcttcctttaagtcaatgtttttcaaagttcaagtcatggttgattagtggctatgaaaccagttaggtgggtcacagccagcattttaaaaaagaagaaaatgtcattgttttcatagtaagataagtgttccgtggtcctgttgcttgaacatgtatctcttttttggtttgcttttttgtttctgttgtttggaggcatggacagggtacgaacctgtgaatatgtatctttatatgtggttgtgtatgtgtgtttgtctggtcaccaaaaatattcctagggctcatgatcaaacaagttggaaagcttcttatttaaatgatctctactcttatgttaattggggacctagacacactgaccaccttaattgcctatactttagttaccatcagtgttgtgaatacttagtcgttttccaagaacaaccttgccccaaatccctgctctaccatcatcagccttgtgccatattatggtttcctataatctgtcccatttttaattaggaatattgcttatacgtatatcttttttctttgattttttcttttttttaaattctcttttgcttatacatatatcttaacagcctcttcttttcttgttgaagaaataattttgacaagtttttacattttactttaaattaaaaactcatttcccttttgaccacatgcattaaccctcagaactgaagaaggccagattaaccgtaccaactcacccttcttgggagaatgaagcaaaccttttatcatcaagatatgtcaccctttatctctggtaatgccttttgccttagagtccacatttttaaagtatcgtagctgaacaactgtctcttggttagtgtttgcagaatgcatcttttttatccatatgtatataaggtagatctctttttggcaatatagttagcttttatttagttttgttttaaaatagagacagaacatttttggttttaattaaagtatttagtttgtttacatttagtgtagtaattgatatatttgggtttaagtctgcctcctacttgcttcatcctttttttttcctgttgctttttattctagccaccccaccacccttttttttggagcggggggaacggagtctcactcttgtggcctaggctggagtgcaatagcacgatctcaagctcactgcaacctccacctcccaggttcaagtgattctcctgcgtcagacttccaagtagctgggattacaggcacacaccaccacacctggctaattttttgtatttttagtacagacagggtttcaccatgttggccaggctggtcttgaactcctgacctcaggtgatccgcccaccttggcttcccaaagggctggggttacaggcatgagccactgtgcccggccaagccccttttttttttaacttttcttttttctcctcccttaccatcttttgagttgatttagcaattttattacacctttcttctcttctgttggcttgttaattttatattctttactatactttgagcatcctgttttttccattaactgccagatagtatatgccttagactttgcaggccatgtaaggtctctgcctcatagtcttcccattgttacaactctttaaaaatgtaaaaaccattcttagcctgggggccttaagaaaacatgctcctggctggatgtggtccttgggccatagttttggtgacctgctttagaaactataacgtgcatcctgctaaaatctaatctaagcctggcacagtggctcatgcctgtaatcttaatgctttggaaagctgaggcaggaggatcacttgaggccaggagttcaagaccagcctgggcaacatgataagaccctatctctaccaaaaaaaaaaagttaggcatgatggtgtgcacctgtaatctcaacactttgggaggctgaggcatgagaattgcttgagaccaagagttcaagaccagcctgagcaacatagcaagaccccagctctacagaaaaaattaaaatcagctgggcctggtgacatgcccctgtagtcccagctgcttgggaggctgaggtgggaggatcacttgagtcccagtggttgtggctgcagtggctcgtgatgcaccactgcactccagcttgggtgacagagcaagaccccatctgctaaaagaaacaaaaacagagtaccctttagtacagatctgctgggaaaaagttctcatttttatttgtttgaaaatgccatcatttctcctttgttttcacgttttcaaatcagcattcttgaggtgcattcaataaaatatacccacttgagctgtacaactgatgagtttgacagaccactgtgcccgtggagccacaccacagtcagcgtatatcccgtgtgtccccttgtacctgtcccagttaatccctctccttatccctcaagcccaggcaaccattgatctgggttttctcactatacattcgatttgatgtttccagaactttctgtaaacagaatgataaagtatgtgctcttttctgtctcttccttggctcagaatcatgcctttgagatgtctccttgttgggagtatcagtagtgtgttcctgttcattataagtaacagcccgtcaccctgtgtgtcacagtttgtttcacctgttgatgcgcgtttgaattgttcctgtcctgactgttatgaacaaagctgctgtaaacattcatgtgcaagtctttgtgtgggcatatatattcatttctcctggataaataccggagagtgaattgcttggtcatatggtaggtgtgtgtttaactttataagaaattgtccaactgttttccaaagtggtttgctgacctgagttcctgccagtaacaacagcgtgccagttgtggcgcatccatgtcgacacttggcattctgccttttcggggttttttttattttattttttgagatggcgtctcactttcttgtccaggctgcagtgcagtggcacagtctcagctcactgcaacctccgcctcccgggttcctgcaattctcgtgccttagcctgttgagtaagtgggattacaggcgggcgccaccacgcccagctgattttttgtatttttagtagagatggggtttcaccatgttgcccaggctgatctcgaactcctgacttaagtgatccacccacctcggccacccaagtgccgggattacaggcgtgagctaccgcgtccggccatcttaccgaagtataacacaatatcattattattttaatttacatttgcctaatgatgacagagcagcttttcctatgctgctattggccattaatttatattctttaataaaatggatgttcaagtctcttgccaattttcaaattgtggtgtttgtcttcaagagcccttcatgtgttttggacacaagtctttgtcctatctatacattgtgaacatttttgctaagtctgtggcttgtgtttttatttctaaaacagtctaggccaggtgtggtggctcacgtctgtaatcccaacactttgggaggtcgaggtgggcagatcacaaggtcaggagatcgagaccatcctagctaacacggtgaaagcccgtctctaataaaaatacaaaaattagctgggtgtggtgtcacacacctgtactcccagctactcgggaggctgaggcaggagaatcgcttgaacccgggaggcggacgttgagtccgtccagcagtgagctgagatcgtgacactgcacttcaacctagacaacagagcgagactccatctcaaaataaataaataaataaataaataaataaataaataaataaataaaacagtcttttgaagaacagaagtttttcattttgatgaagtccgatttcatcatttatttattttatgatttgtactttctgtgtcctacctaagaaatctttgccaaccctcgggttgtgaagattttctatttttttctaaaacttttagttttaactttcatgtttatgatgaacttagtgaactatgattaacttttaagtctgcgatccgtttcaagttgttttttaatatagtcaagagtcaaggatcattattttccatatagataccaaattgttccagcactgtttgtggaagaggctatctttttgtcattgaatttccttggtgcctttgacaaaaatcatttgactataactgtatagttctattctattctcttgatctgtgtgtctatctttattggcataaagataggaataccacattaccttgatcacggtagctttattgtaagtctctgtttttgttttgttttgttttgttttgttttgtcaaaatggttttggctactctagatccttgcatttcatatgaatttaaaaatcagtttatcagttctaacgagaagcctgctgagattttgactggaattacattaaatctagatgaatttgaggagaattaccatcctagtaatatggagtcttctgacccatgcacatagtggcttcatcttccataatcatcacatactgatttagttgtcttggtgccttggagctttatctgtacatatcttgcaaatattttgttaaattaatgtcagtttaaaaattatttaagacagcatatagaaatgtaattgatttttgcatagtgacctcatttcctctaactttgctacattcacttattggctctgggagctgtttgaaaggtttcttaagatcctctatgtgtgtaattatgtcatctgaaaatacatacagtttgacttctttatttccgatgtttatgtctttaatttctttttcttgctttgttgcactgcgtaatgtctccagtataatgttaaatggacgcaatacagctgggtgttgaagccctgatctgagtcaaggatcaatgacagggaacattttatctaaatctactaagtataatatgtgctgtgaatttttcatagatacccattatcaggttgaggaagtgcgcttctagacctagttttctgagagtttttctcgtgagttcttgttggaattcgtcagcggcttcctctgtgtctgtggaggggatcgtacagctgttcaccctgttcagatggtgcatcacatgaatgatgttcagatgttaaacagtcttgcatccctgtggtaaaccccagctggtcatggtatattacccttggatagattgcgggattttacttgcatttcattgaagatcatctcacatgtgttcttctctacctgtgggagacagccacgccctctccaacaaggcctaaacctcactctatccacagaacatagccacgccctctccaacaaggcctaaacctcactgtacccacgggacacagccacgccctctccaacaaggcctcaacctcactgtacccacgggacacagccacgccctctccaacaaggcctaaacctcactctacccaagggacaccgcctctctccaacaaggcctcaacctcactctacccaagggacacaaccacaccctctctaacaaggcctaaacctcactccaccggtgggacacagccacagcctctccaacaaggcctcaacctcactgtacccacgggacacagccacgccctctccaacaaggcctcaacctcactgtacccacaggacacagccacgccctctccaacaaggcctaaacctcactccacccgtgggacacagccacagcctctttaacaaggcctcgacctcactgtacccacgggacacagccacaccctctcgaacaaggcctcaacctcagccctacctggggcctcctccaggtgctgggattacaggcatgagccactgtgcccagcccttgatttcttaatatactaaatttttaatttccagggtttaaaaagaatagcttctagttttcttccaaaattgttcactttgtcctttaattccttatacatattaagtaagatgattgtcaagtctgtgcctggcggctccattatccaaatcctctatctctgtcttgtcagctgcttttcttggtttcaaacatatatacagttttccagtaattacctgtttttttttttaattgaatgctacaaattgaaaacggaaattgtacaggtatttggggtgatttgaggctgtgaagtctgaattgttttgagtttctttttcctcctacgcgccttttagagtctcagctcaacaactgaggagtttccccagatctgcttctccttggcagtgcatcacctcctgctgttgttccccagccccatgagcctgccgtgatctactcagcgtccctgctgctgggtcccgtttttggagttgccagatgcttccaagagaggtggccccaaacgaaagctcaacccctggcttcccctcctcgagtcttggccccataatttctcatagcctggctgcctttccttgcttctaaaatattcccgaacatacacacagcctttctagctgttctccaggtgagaatggtctgaatcacctcatctgccgttacccgcaagggagcccgtgctgttctcaaaaccctaaacctgtgggaaccacacgcccccagatttgtgcacgtgatttggaatctggtgggctcagctttttagataatgcccagtggctgcacgtgagggtccgcaggcacagagttggacccacgtccccagccttccatgtccagctgggactctatgtggctctcttgttcccgttcctgtccctctgccctccagactatagcactgcagcccagctgacagagaggccgctcctctacctttaagttgcaaactattcagaccaatatcgtgtattataatttgtaaaccatgggttttatgcacgctaaaatggactttaattatgatcactcaaagtctgtaaatggctataatattgggcactgtgtagtgagaacatcaggtaatgttacagagcgctgaattgtacatcattttaaataaagagaggctggacgagaatatcacaggaatgcacgtttccttggttcagagcaatattagcttaagaaaaagtattttcactggtttcacgaaaagttatcacctggtgcattatttcctgatcttcacttcgaattgttttctttccccaaagagttgtatttttacaatgaccgacatgtgtgtgtgctttatgtgtaaggtttcaatgcagcgttcattgagaagctggatgaactcatcacgcttttgcacctgctcagattgctttcagtaactctcctgttactccagcccccactgtggagaaccactggtctgagatagacatatatagcttccctcttactagcaacctagccattatgcactgacctggattttcaaaagaattatttcaaaaaagaaattgctcagttcacctcccctgaccttggcatggaacctttgtaagtaattaattatttgcagtaagtaagtgaaccagcccaagcttctctacaccgtcattttcatagtagtcatttaaatttaagtgcgtgtccttctttaactgaatttaatctgagatgatataaatttttaaaatcatacagttttgactcggtacggtggcttatgcctgtaatcccagcagtttgggaggccgaggcaggtggatcacccgagctcaggagtgtgagaccagcctgggcaacatggtaaaaccccatctctaccaaaaatacaaaaaattagctacgtgtggtggcatgtgcctgtggtcccagctacttgggaggctgaggctgaggtgggaggatcgcttgaggctgggaggtggaagttgcagtgagctgagatcaagcctgtgcacttcaacctgtgtgacagggagacctcatctcaaaaaaatttttttttcataagacagttttgaaatatcttcccttttcaggaaacttgctgtagcctccttcttatttaaaaaaaggggggaaaagttttgttttcctttaatacgtaaattgtatgttttccgtgtagattattaagcacataagcaaaaagaattaaaatcatccattttctccagcatgccgggataaccattattaacactttgtgtatacccttccagacttttgtctaagtgtattcttgggtatttttttgattttgtgcccaaagagataatctaggggaatggccaccagagcgtttcacgagcttcttagatgatggaatttgggatgatttgtattatcttgttttcttttttatcatcatttgagtacttttagtgagtttgtcctatttcttggaaaccgtagtttttcatttaacattttgtttacatacagtttgacaatcattcagtggggattcacccattggctcatcgtatgtatgcggcacctgttctgtattcaacgtttcatgccatcaaatatgtacacggcatctgttctgtattcgactttcacgctaagcatcgtaacagcaagatgaagaaagaatgtagtcctcactttcagagcgctccaagcctcagcttagacacagcctaggcaacagtgtctcagagacattcacagctctctgggcaggcatcaaaggagcagccccaagcagggaacccctgggttggtgtgggagagaccccaggggagtgtcctgagaggaggccggacttgagccaaatgataaaggatccataggtgtcccctaagccaagaagacaggagggtggtctgagcagagcacacaggatgtttgagaatgacaagtctgacatggctggaaagcgatgtatttggtgaaatagaaagatggggaggaacagaaaatagcaccaggaaggtaaacatgcttgagttactcagcctccaccatggcagccgcgtgactgtgctggggagcagacactaggcagttaggggtgcacaaggtttgttggatgtaacacctggcagaggccaggacagaagctggacctgatgtacacctggcccaggctctgctggccccatagagagagagctgtcgctccaactcagaggtggcccagcctctgcaggccccgtggagagagagctgccactccaactcggaggtggccagactctgtagctcagctgtgctacagggccacccagaacagagaaaggcctcatctgaacactggcccagtccctgtgcgtaccagctgggactgtccctgtaccgcgctttttcctgccaagggcccagccccgtgtccacaggcagcagacagccatcggcatcagtgggagcagctgttttttaagtggggaagtgacatggcccaggcctgtggactgtggagatcacaccatgtgcttaacgagctgccgggagctgtgagattgatttatgtcaaggaaaacaagtcattatccatgggaatttatctagctacacagaaaattaacagtggaacaatggcgggtaataaaagaaaaagaaagtaagggattcgttgagcaccaaagaaatttagaggaagatctcagctgtcatcctgtgctggacagtccgtcacgtgcagagcatcctcccgactggcgaggtggcttccacgtgccccgtcaatcagggctggacagtccgtcacgtgcagagcatcctcccgactggcgaggtggcttccacgtgccccgtcaatcagggctggacagtccatcacgtgcagagcatcctcccgactggcgaggtggcttccacggagcgattctcgagacccgaggggcgtggacacagcttctacgcaggcagtcggagagccactgggctcttggccctcactcctccagccagaggagttttgctttcctttgtcctgcataagattttgtttgagtagctaaaaagtaatggaaaaccaccacaatgatcagtggagaaccttgtatgtttgggggcccagctgtgtgttaagagccatcagcctgtgtagcgtgagccagggcagaagggcctggcccgagaatgctgtctggacgcctggcaggcctggctgcagggtgccgcagaggaggtgggaagaggcatctttgggaggcctggctggccccagtgcaggaccagagagcagctgagggcctggggcctccggggtttcgagcctcagtgaaacgcgaatccacagggactcttggagtggggaccagcagtggagaagatggaggcattgcacttgattttacacacgttccgcttgagctgtgatgccaggcaagccgagggtgaagggaagcgccttgtcgtgagacctggaaggagcagggctgccgctggagcagatcctggggtgtgaaaagagctggcgacgcagtgctcccagaggtcactaagggaggagccgggtgccaggggagagacagtcaggatttgcagattcagcaaatgaagaaaggcaaggctggccagccactggagtgagggggcttgggaggaggtggcttggaagggcggtgaggacagaaaccagctttcgcatggcaggtaagaggagcctacgggggccaaggagagcttagctagtgccagcttcagggccacatgggttttccccagggtagacaggcataaggccccagcggccactgcatgttgagccccagcagccagtggtctccccggcccatccctggtcctcccattcctgcgaggcggctgcggggtctgggtctggtttctgccacttgtctctagtggaagacacaccctcatagagcctcagtttctccatctgaaaagcaagtgaacataagacctgcctggcgtgggcattgggaaggaagtcttggtggacttggcaggtgggtgacttgggggcctgggtccaccgagccgcacagcgggaggcacggcatgagtgcccagctggcagcggtggtggaggtagtgtaaatgttcatgctgaagaaaatccaagcctctgagaggctgggcagctagtccacagtcacagagccagtctctggccaaattcaagcccccgtctgtctggctcccaagtttaggcctggaagtgaaggaaaaggaaggctgggggttctgcaggggagacatcctgatgacctcacagccccttgtccttgtcctctgcatggatggggccagggacggcagtgaggcggccaccccatggggaggagatcatgtgttgcgtctcctgagtgcagacggagctgaaggcgcccccgagaatccaggtgagagcaggaacctggagagactgggaggcaagcacctgccacgtgggcacctgtgagtgaaccggggagggacagggccccaaggagtgggtggcacctcatgctggaagtggggagcaggcagagtgatggggcaaatgacagggagccgggcaggtccgggagaaggggtgggggagggagcacccttgggagagtgactgtgatgggctgtgatccctcaggcatctggtggagaatcaaaggcgagggctggagacacagcagctcttgttgagtgacaagttcccagcagagggtggtggtggggacagccaggggtgtcagggaagaagaaggggccttaggggaagggcacctgcttggcatttcggagctggcctggcactctacagtggttgcacaaatggggtgtggatgctgaagttctgccagagtctagcagggccggggtcatcatgatgacctggatgttgcagtaaggaagataaatcctggcaagaaaccgcatgccacaggtgagcccggaagtgtgggggaaggtggagataaaccctcctgccaatggcagtgaaggagagtttgaggaggcgcgggccctgttggggggccaccccggcatctgccacatctgttgttggagtgtcatctgttttattttagtcgccattttgcatcagggtcagctgtgttgactcagcagagaaacaggtaccacgagtcatccagccatagcacggctgggaccagcgcttgagttttcttgtctcccaattcaggagtcttttcctgaactgtagctttttacagttttcacatagaagtccttgattaacactctgaatttaaattttaaaagagccaccttgatcattaaccctttgagggttcagagaaacttctagaatgaaacatggtctgacatggacaacatacaccaataggcttcttctgtggtcccctcgtgatctcagtggcctcccgagttgggcaagactcagcattggttaggatcaggtacagaaaggaaatcagaaacaaatcgtttctgcaaggatttaattttatgtgacgtgaaaagtgagggatgctggactcggttccaccttgtcacccccagtaggaccaggcctgctggatcaagaagcctcatcagcttttgctcactggatggttggttcatcgacttgaatgatttctgggtctgtctgaagtcggctgggcagatgactctgtctggtttcacgatgagcttagggaagagaccagtgggattttcaggaccatgttgggagagtctagctttgcatttatttactggtgatcatcacaagataccaatttgtaaaaacacaactaagtacacactggtcctatctggcctccgtttatcttgatggcttggccatccagtgacagtgctggggtgtgggacctcgtgggaagctctttgctgctcagaatgcagctttctgttaaccagtggtcacagactcgggaacagcaggggctctatgagcttcagtcgattcaggatacgtgggctcacgttagggatgtgtttagtcctggtttgcaaacagcctgcgggcaaatggtctgtctgtgcttgtgatggtccctgcacttcttccggaatgcagccctggcccccgccagctgctcgagctgtgctgcacccctaggctccctccccagcatcaccagggccaaggatgaggagatgcaggagccagggttttggcagttccctgttactcaggtgggcacactcattgcagtaaatgttgatgtataaagacaaggaagggtatccccatgatcgcattttgaggtttttcctccaattgtttctccttgcacatgtttgatgtaatcgtgactatagagtatttgtcttgcttctttacttaatgttataaagcattgtcccatattattgaaatattcagaacagtttaactgcttgtagctgctgcgtcgtggttgttgcgtggtttgtttaatcatttccctctcattggtttcggagcgaattttgggctttctgcaatggcagatgacacagcaccacacaccctacatcccatttccccatcttgcttccggtttaggtatggttggttcctggaagttgatgtactgagctatgtagatttttccgacttttacatgtggtaaagaaggtagtgccagcgcacgctcgtacaggatagaagtgtttttgtttagggcagggacagacacatccagctgccttagaatgggggctctgcacaccagaaagaccagctgtgtaacgtagagtgtggactttgagtgatgcagtatcagtcactcaatcggtcttgtctgtgtgactctgaatacacagactccgggcacttcccaggctggcagtgctccaggcacgttgttacagtcgtgctgggagggtaacatgtctgaaccccatggagcgaggacctgagctctgcagttggtgttgggccccaccctgccctgggcgcctctcttcctgaggcttggggacggtcctctgccctcatagtttgactaactccagatatgttgagagaggagagaacccgtgacaggatgctgaagatcagcaactcccgtgtcctccttccttgcacagtcgggccacttatgtgtttactgatcctaggccacagagcttcggcgtgtggtctgggcgctgtctgtcctctgcatggctttggtaaggagggcaggcagcgctcggtgacagtcctgcagcttgaaagaggcggtgtttttgcggaacagttattgacgatcttgtcagtcatttcattaaaacggttttcagcatatgtgtttctcatctgcaggtgtgggacccaagacacaagtgtgttggggctccatgtccaccccacgatgccccccgtgccccttctccgtgctgtttcctagggctgtgtcccgggcagccacccctgttcgcgctggcgcttgagggctgagatgagcaacctggtaaaatgagttcctggattgtttgcttgcatttcataaggaaatgtcttctctttgggaggtgtgccccaccctcacattcctccgtggggccaagctctgtcgtaggttgttagagggtgggcacctttgcttttcctcactcccctgctcggaggtcggagggcaggcagcctggccattcctcctgcgcacagtggacatgcttgttctgaagcgagagcagactggggagaaggaggaggggctgagacgagtctctgctgtccttgtgccgtgtgttcgcctccaggcctgggtttcttttaaatggtgggaatccttcatgatgcctgccctccaccacccacacagctaatgaaaggggcttctccgtcatccccgtcctggccagcagcctgactagaaaaccctgatgttgggtaaactggtctccactgtggaggtcgaaatttttcttgaatttggaaatctttgtttgagacttccggcattgtttgagcagcagtgctgctttagaatattatactaacttctcaatttctcctttttcttgccctatcactgaacctattttgaggaaataagacgttattttctgttcgtaaaggaaagaaagagcatgtgttgaagaattacattaagaagcttgcttaggctgggcatgatggctcatgcctgtaatcccaacactttgggagggtgaggcgggaggatcccttgagcccaggagttcaagagcggcctgggcaacacagtgggactccactacaacagtttaagaaaagaagttcactgaacttagctaccctgtgttactgatgcatagcctctttgaatattattctgatgaagacggtgccatcagatggttcctgcagtgggaattgctgatcagctaaatctttttgacagcgggatcatgcttatggctctgaacacgtggcatttggttttccattccgagttacctcacttagaataatggcctccagctccatccaagttgctgcaaaagtcatggttctgtcctcacggctgaggagtggtccttggtgctgcctgccccatgcgaaatggcagcagcctcatccccccgcccactctctgtcgtatttgtctctgcgtcatctgccgtcacttgccacctctaatgtgtgcttgttcatttgcctgttacctgtccttccccctagacccttaggacagggcctgggcgcgcgctggcaatccccacatccctgtcgcaggtatcagctgcgtgttgaatacacgggagcaaagtagaccttgcgggcgagactcctcccagcatggacggtgtacttccacagcgttcggtggctgaggtataaccctgcagagcatgatgtggactgctttcagcacgtgccacagactgcccttggggtccagtcatcggtccatgggaaccatgtgtgtgaccagctgggcttggtctgtaagtctggggacaccagaggaagaagctgttttggagatgtgcgggaaggaggaaagctgcagatggaggttgagctctgagctgtgagctcatggagagtttgattctccctgccgtgcgccaagcttctgctcagagccttcctccctcgctcagagcctttcgccgcccgcgcccttttttcttgcaacctctcttccattccctgctctcagagctgtggcatcactcatgagaacgccccttgttttctaggatccctggccgcctgaacgacaggaggacgcccctgggtgaactgaactggatcttcacagccatcacagacaccatcgcgtggaacgtgctcccccggggtgaggcgcgggccgggccttggggagggaggctatggccttgagtgcgcggggagccgactctcggacatgagaggagtcagataggatccgtgagtgcctccctagtgaggaagacagtgggaggggctgaaaagtagaaggcgaccacctaaggaggtgtctgcgagggggtgagttactgcacgccaggttctcagaacggtggtgtggagagactgcgtgtcagcgctggccctgaccggtgcacagcccttactgcgcaccggcggcttatcttcagagtcgtcggcattattcacactggctggaaaccagaattgctgttgtaagacttgtttgtattttttattgattggttgatttggggtgtttgttcacatgtacgtatatgtgcactgtgtgtgtacatgtgtacatgtgtatgcatacacgtgtgtatatgcatatttgtgtgtgtgtatttgtgtatgtgtacacctgtatgtgtgtgcgtgtgtgtatttgtgtatgcgtgcccatgtgtaatgtatctgtataggtacacacctgtgcacacacatgtatgcatgcatgtgtgcatgtgtgtacatttgtgcacgtgtgtgtatgtttaagtgtgtgtacgtgtgtgtttaagcgtgtgtgtgtgttgctgatgggagatatgcatattagtcccaactttagtaatttttgatagaagtgaatttgtgtatttggctttaaatgctagacacaagtcactgtagactcctttttatcttttatctgccctcagatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggtgagtgtttcaggatcctccaggtgccgtgctcccccgccctccgtggcactgtgatgtcatggaattgcacggagctgggcagggaggccccacacctaacttggggaccccgtgtagcattaacaagtgaagctaaatgcagggctcccagagatctccacacagaggagtgggggtctccttcagagggcagaagccttggagggccttttaggactgcacgggagcagcggccggctgaagcctcacagctctgcaactcgggagggtagcactttgcaagagagtttctaaccttttagaaaccagtagtgagaaaataacttgctgacttgaatttatgaagcacatgcaagatcgctctggagaattaaactgttgggctcatgatcaattagtttttatgcttatttctcacacacacacacacacacacacacacacacacaacgctcataagtgtaatcctttatgactattgattatagttctctcccattgctgagttgctactatttatacaactcctattagtagtaacagtgacaataatgtgatttgtttttagtctagacattatatttgaagacgtttggtttctttctgttctgtggctgtcctaacaagcaggtttgggcaaattctaaaatggtattaaaacaaaggaaaaatatttctgttcatcaatgggagaaaccctaacaacacaaatatttttaaaagagcgattaacgtatgcctagccgcagaagccatcatgtggcgtattttcatggccaggtttattttagctagtgttttgtgttttctttttaaacgtgtacaggaccactttccctcaaccctggaaacccagagaagcaagaaggaatctaaactcactacccatcacccactccagaaaagttagaaataatctaatttttaatgtttataataaatatttatatgcgatagatcaaaatacattatacccagcatagcacttggactttaaacagcaaaagttaaagcatgcatgatctgtatccttcttaagactctgtaagataaaatagagaaccctgataaggagaaaaggaaattgaagtaaaccatttaaataatgtgtaaataaaaccaccgcacatttatttttcacgaatccatgaataacagagctgtaaaagagacaggtgtttgaaaagcctttgcaatacttagaataaatatttaaaatgaacattttttaaaaataaatacttagagcatttttgaaagagtatattctcaaaatggccttattcctttaagaaaagtaaggccttaaatcctgtctctatttcctctaagacaggttattgtaatacatttattttaaaagaggaaggaaaaagaaaaaaaaagctgaaggggtcagtgccacatcagatcctggatcaaaaactagttcagcactgggagccggttgagcactcggagcggggtgggcagggcctccagacttgcaggttcccttaccaggaatcagtccatggaaacctttttccttctagcgtatgttttctccagatgtaaaagcacctcctatctgatgtgctcagctgcgcagagttaaagacagtgacatcacattggagtccgtggtcaaagaccagagccagagcacagagaggagccaggagggatgagcaggcgaggacaggtgcagggaggggcatgtggcaaggccggcgtggggcagccacatcccacctctccatctagaggccgcgtggcgaggccagcgtggggcagccacatcccacctctccatctagaggccgcgtggcgaggccagtatggggcagccacatcccacctctccatctagaggccacgtggcgaggtcagcgtggggcagccacatcccacctctctctctagaggccacgtggcgaggccagtatggggcagccacatcccacctctccatctagaggccgcgtggcgaggccagcgtggggcagccacatcccacctctccatctagaggccgcgtggcgaggccagcgtggggcagccacatcccacctctccctccagaggccgcgtggcgagttcggcacagggcagccacatcccacctctccatctagaggccgcgtggcgaggttggcacagggcagccacatcccacatctctgtctagagactgctttctaggactggcccctcagaagttttctgagtgccagcatttatatcagtgctgctttatagaaggtccttgtctaggcctagctgcagcctctcccagcgttgctggggctgcccttccctgcccagaaaaaaggccagctattctgcagactctgctccctggagcctcacagagccagccctcacctgtgcttatcggttgcactagagaatcatgaggtgatgtcgcaatccacagaggcccagagagcctggggacagcatcacaagggtgcctcgcagcccctcttcctgacggtcactgtggacactccggcttttctcctctcctggttctgacctccctgagtgtgtcagaggctccgcttgggctaatgtgcgcctttagtgatccagcccgcatggtccatcatcccaccacaagcagcctgcggtgtcgtgtcctcccgcttccctttcgggcgcgttcttctcctggttgttgcagggtgggctgtctgggaagtagacggagacggaggctggtgtcatgacactgctcgtgagtggagcagccctgggtcagcggtggaggggtgggcggagagaagtcaggctcacctccgccggccctggggagctctgaggatgggatgggaggtgagtgggcctgcctgcattctgcgttggttgtcagacataggccacccagaagagggcctgacagccgtgagccacctgcctgtggtgcccccagcagctggggcaagaaaaccttgatcctgaaggggatcccggcccctccctcacagtgtcttgctgtaagagaaaatctcacctgccttacctggggctgctgttaccccagccccattttgatggggcccttgggagcggaggaagcgcagtgcagaggagctcttccacaagcgcacagcccatttgcaagaaacatgtttcctctcctcatccgggaaagtgacacttcccggccggctgtgcagagctcgtcaccaggccctgctgaggcctgtggcagtaaccgcaggtctggactagaagagagcagccagcggcacccggccactgtagcggtcactggtgcagccactgccagcagccagggcctccggcccagcccaggtacagcggagtgaactgtgttcatgtagaatcacagcggcgatgcccttaattgctaggctggggcagggaagcaccgccctggcctcctcctggtccctggcacccttctgccgggtgtcactgtgtccccatggttgggtttgacggacatcagggatgaagactgaagaagaaccaggccaggagtggtgaagggcagggctcctccagtggggtgcacagggtgggcccccgtgccgtcaccgctggccactgggcacacctgtgggctccaccagccacacagctagaactcgccctgctgttgccgatggcctgggtggctttggggtttcaccttcaaccggcagaagaaacattatgcgcttgaatttttttcctttttcttttttaaactcacacctgggcacgcatctgcgtactgccctggcgactgacgtgagcatgaagggagctttagtcagccgctcggcccgcgggaaggaagaggcgagcaggagtgactcacaccaggctcgggctccaggcttcctggcaaagcagtgaatgtgaacacccagggggcagctgtgccaaattgaagctgatttgtgctgaaagaagaaaacctcattcacagattacagaccagtcatggcccttctggtggacgcgtctccctctgcttagtaataggagttcctccagcgccacttgtgggaaatagaatttgaaggtggaaacagcactagggagggcactagccatctaatcctgtgtgacagcagtgtcgctgcagacttggcagctcagaacagcacgtggcctccagatccagttcctgttgtggggctcagccaggttctctgtgcagggtcccatcaggttaaggctgccttcgcagttgagaccacccgccgtccccaccagtggggtccttagcttggcctcccaccactcagagccagcgcaggagccgggtgctgcatcctcacctagtgccacacacagtcacagcagccatcaccgttgccatattctgctggttgaaagcagtctcaggtcccacctgcacccccagggaggggccacacctgggacaggggtcctggggccacgttcaagcctgtccacctcagctggtgaactgtgctggggtttggagagggtgagagtaaagtcgcagagcccagggagcaatctgaccacagctcccctgaggcacaccagtcgcggcgggtgaccacaggtggtcatgtaagaataggaattccagtgactgactgattaagcgcctgctgcgtgttgggctttacaattgttaggccatctccccctcacagcaggtactgccgcaaagctacgatttttactatcaatatgcccattttactgatgagaaactggggtgtgtgaggacctgcatggtagggccaggctgtggctctagccgtctagtgccagcctgccccatgctgacttagcggcgtacgtgctgagtcatgggatgtacgtgcatgagcttctgtttcaggcgcatccctgggacaggagtgcacccaggcagaagtggtgtttaaccagggaggaaagctcttgtcacctcttgttacacatggccactgtgctggcggatcacagcatcgttgtcagcgtgaggaagcttccccggtgtctgaacgagtctgatcaggcagagacgagcagggagtggcacttagcgacctgctgtagtcatgctcctgggagcatgctcctgagaccatgcgaggtctcaggaaggatgtgcgcctcatatgagaaacccgtggcaggtggcattccttgcattttgcagtcagctgcatcccacctacagaacagagccctggggttttccctccagctggacatgagaagctgctggggagtcagcagccctgtcctgggatccgagtcgtcttggtgactcccacgcttcgatgcctggccgagacccgcctggcttgggcctgcccttggttgggacctcactgacctgaggcccctaaccccgacccctgccttggctttacggcctttacagtgctggccccggtggccacccacctgcctgcccaccgtgctcaccctgcctttgaatgcccagcctctttgccccacaaccaatgtgacctggcttaggagcatagctgaagcaggtcgctaaggaaaaaccaagcaacgggactaatgggatgttctgaaagacaaggacaaatcaagccatttgtcagaacattggttataagagggaaaatttgggaataactctactacctaacagaataggaacgtaaattcagaacggatacttaaaatgtaagcagtcttaaaattttattcatgagtatgcaaaatatatgttaaatgagagaaacagaacaccaaattgcatcagcaatatagttaatatctatgttaaaatacatagtacacacagcaataaaacactaaacagatttataaataaacattaatgatgcttgtgccagggtggtacaattggagtgatggttctccattttaaaaattgatagatattactttggttaattaaaagtctgcctgtagattttctaagccttcgaagcactaaaagcaatttttaaaaatagagtctttatggctaaggcattattgttcataaattcagaactagagacacacagaagaaatcattacatacttctttacatgaggagaatcatgactggtagagtggcctaagaggcaggcgtgggggctttcagacagcagaaagacggggctggtgtccaggagggcgcgggcatgggtagggcagcgcccgggctgtgctcagtccaaccggggctctgcggggcggttttggcccacagttgccagtcatagagtagccaaaagttcatattttcatttttaattatctgattattagatgttgatatctaacgtggcattaaaaaacattctgcgagcccaaccagacacatccaacccgacacatccaaccagacagcggcctgtagcctgcctgttccaagctgggccatgaacccctagggacagaggcttcagtgaagccctcggtgcctcggctcccagcatggggggcggcccgtagacatggcagtgccgcgtgcatggagagggcggcgtccacggcgacttgtggccgagtctcaggatgcttcccccactcttcttcctcagcccctcctgtgcgtgtccaagggtcctctctagttagggatattttctgcaaggtctgacatcgtgtcttcttgtctttctatgctgggaagtgccaaataagtaatattaaagggttctttgtacagaaatcaatgatgatgtgaattcagggagaatcacttgcattttacacatgttctctggggtaggttttcagcaacaaggatgccagcgtgaatctagagctaaaaagtaaacacgagtcagttccatttaatgctgaaaattatatcatgagccaactttgatagggaattgaatgtaaaaattgggctttagatttggagaagatcctagatcctcgtaggagaagaaagactggaaatgtggtctggctggtcaggagccgggacagcaggtcccacgctataggtgtacacagattctccccgctggcttctctgttctgtggcatcttcctggtttcctggagtcagggcagctccactggcctcagtttccagagaacaaacctgactgaggtggacttgccaccttggccactgaccagttccgaccccgccccgccccaactccagctccacccagttctctcatttcctctcctctcactgccaccaaaacattatgtcaaaaaatgggggtttctcagtctgtatcagttcactatgtgtgcagaaaatttatcggaatgactttaacggtagtagaccaccccccaattctgagtgctgacagtttgtaaaaggccctttccaggtgctctgccaaagccactcacgcacggccttctcacggcgtcgggctgctgcgccccacggtgcccccgcgctgggccatcttgcacgggccgctgctgtccagtggcttcgaaaggagtttggtagttgaggtgagaccgcaggtgcgctgctccagtggcttcgaaaggagtttggtagttgaggtgagatcgcaggtgcactgctcctcaggaatggcagaggcttcccatgatggggagcatcattttcatcttttttttttttttcggaggcggggtctcgctctgtcacccaggctggagtgcagtggtgtgatcttggctcactgcagcctcaacctcccagggtcaagcaatcctctcacgtcagacccccaagtagctgggactacaggcacacgcccagctaattgttttgtattttttgtagagatgaggtttcaccaggttgctcaggctggtcttgaactcctgagctcagacaatcctcccaccttggcctcccaaagtgctggaattaacaggtgtgtgccaccgcgcccaatagggaacatcattttaaagcagctctttgcttcccagcggagattccatagcagccgtgtgttgttccgatgtgtgttttcccaaatgcgctacacaattaaggtgcttaggagggaggagaggcaagcacagaggtttggcttgcactagctccacgtccttcccgggtttcagaaaggcatgtacttgcccttgcactgcccagagaccaggccccagcactgcctcctctccattccccacggaggctgagacgattcctcagtccatgtcaccctgagaaaatccccctccaataaggcatttgattctgtggagtccgttattgcagaattttacctccactctgtcctaggcgtgttaacattcgaagtctaattctaactcttagacactctcaccacgtccttaacacgagtgagtttactagtctggacacaggagggaggcttctggaagactgggaaaccccaggccttcttagatatgagcagtccttgctgctcgtgatgaatttcatgcatgactttatcactgtccatcggaatcccgccgaggctctggaggcagagatgtcagatctctgatgacagtgaacttccacagagggcagcagcatctccctgtgtatccttgtgtatcactatgtatccctgtgtgtcactgtgtatccctgtgtgtcactgtgtcactgtgtatccctgtgtatcactatgtatccctgtgtgtcactgtgtatccctgtgtgtcaccgtgtatccctgtgtgtcaccatgtatccctgtgtgtcactgtgtatccctgtgtgtgcctgtatgtcaccgtgtatccctgtgtatcactgtgcacacagtaaaatttaacaagaagccagtccattccaccatgttaccatgttgcagatttagggaggcgtaaccacacagacttggtactggtcttgattgtggagggcctttatgctgagccagagatgaggaagatgttggtgcctggctataagggcttgagccaggtggatacggagggcatgcagccaacaccgctcttgagacaccggctgggttagtgtggaaaaactccattgaatggtttgcctttctccctggaggtagttaggtgtactagttgaaacacccattcattgggaacccgtgatccaggggctttacaaatgggcatgtgtgagcataggcagcataggctgccgtggccccaggtgtcagggtgcaggcggctcctgtcttggaggcttccatcccccgtggaagctcgtgctggccactggagcaacattcccgcaggtgggaaggccgcgaggagtggacgaggcagctcaggcctgggggacagacttggagctcacatgcccatcgcccccctgtcctgtggcagtgtctggtccagcctcatccagggagggagggaatgtggcctccaccttgagtggcatgtcccagctccaatgctgttccttaacaagggcagggagggaggcacaaaggagtgaggagtggtttcagacgctcagacggagaacattcggctcagaaacagaatcgtgctctcctctgttactagattttgccaactgcaactgaggactgagctgctgtggaggtgggctcctcaccatgggagcatcaccgggggctctgcagggctgtctgccacgaaaacaatgcccagagctctctcctcccctcatcaatagaccaaagtgtgtacatccccagggagcacacaggaaagatagcagaaaagagcatttggaataaataatgtacaatctagctattatactccttgggtggtgatggagaggttgaatttttagcaagaggaaagagggaacaaagcctaacaaacattgaggttaaaacatgaagtcatctgcatttacactttgcttcaggccgcggcagtaatgaatactcagagccggctttctgtttaatgtttgatgcaaagtcaccggggagtcattctccttcactttcaatttcaggggtcctgaaaccctgcgtttctctgcggtaataacccgtgctttccgttcccggggcgggcgccgctctgactgatcagcgcagatggaggctgtgcggacttggacttggacggttttcctccagcccacctcctgggcacccgccatctcagggctgtttcctgaaaacccagctcttgcctggatgacatgttttccaggcgagtgactcatcagaacagccaacagcttagaaagtccctctgcccccagctgctgggggggaggagcccacgatgcagatgagctggtcacagctaatcacagcctcctcccctcagatctgcactccagcactccagccctgcttctccaggcagcttgatcgcaggctgtgggaagtgctaatccagacaccttcccggtcccctcccaccttctgctgtcgtgtgctgccaaacctcacagggctggctgctgccgccgaagcccaccaccatggcctctcgtgtgtacgtaggacccactttcccacttgtctttagctgggaatcccaaattagagctgcaagtgtgtgttgattttaccgtagaaaatgcagccagttttaatcaacagataaatgttcattagagaataccgttgttctgctgtttaaaaggttgccgtgcaggccgggtgcaatggctcacgcctgtaatcccagcactttgggaggccacggcaggcagatcacctgaggtcaggagttcgagacccgcctgaccaacatggtgaaaccccgtctctactaaaaatacaaaaattagccaggcgtgtggcacattcctgtaatcccagctactcaggagaccgaggcaggagaatcacttgaacccgggaggcggaggttgcagtgagccaagatcgcaccactgcgctccagcataggtgacagagtgagactccgtctcaaaaaacaaaacaaaacaaaaggttgccatgcgattttagaatttaatgggtaatctggccctgtaatttggttaaataaataaataaataaaccacccacggccccgagagggcctctggcttgctcagcaggcggtgccagggtgcaagctcctcccagtacctccgtcttccctgccttgctctgagtggggctgtccttcgggcccaggccgagctgtggcttgaggttcagggccgcttcactgtgtgctgataatcgggttccagcgcttgtctttcagcggtttgtaggcgttcttttacatcctttcttctcattagtacttgaacaaagttattttcctcctctcatgtagacagctctgcctcgagtccacagccctgggtagccggacggccccgagcagcctccgtgcatcgtctgggcgccgagccacagcccttcctcctgggctttgtgtcatccccgcagcctcctgagcctctgtgcatcagtgaaaccagaaccatctggggctgcttttctggtctgaaatgtggagctgggtcagtccccgcctcccaccccggggctggatccaagtgggcccccagccttttaggagcacatgtcccactgcagcaacatgggtcacgtgtccgagagagattgtcacccgtggctctgacacagctttgctgggcggcatcctgtccggtgtgctgagcgatgtctccagtgcagttcaggccttcaacaccaagcgagggccttggagaacgtgcgaataggctttccgggaggcatggttccaaaggcgccttgcccagcactgaccgaggccacaccaggtgccacgctggtctgctcggcccacggcccggacaccctctctgccctcctctcgcctccacctcccctaacttgcacacactttcttctaactcctgaagcagaaactttttatttgattaaattcgaggaatctttatagagtttaattgcaataattgactttgcttctgtcttaacaaagagtaaaatctccctcaatgctgctgaataccatttgcctgcagctggggatttactgggcatatgggagctatttattgcacgtactttgaggccttttgattatctcctgattgcttcttaactctgttggcaggggaagggcatgtttgtgcaaagagggccagtcttgggaaaattgaaatatatttcatatatttgaaagtgaaaaattgctctttagtccctttgttcatcttaaacttttacttttttttctggattttaacatttttcattctcattttggtcctttactaagacattgagaaaatatgccctttgacacggcagcacggagtgtcattaacctaaaaaataacacagagtcctcgagtctcttagaaaattacccaggagaagagagcgcagtgctagaagcagaatccagtatactgatcatcactcggtttccacaaggaacatatttctagcagaaagggagagtagggctgaagggattgctgtccttcctccatccctacgacgaaggttgagtgtccctaattcaaaaatccaaaatgttccaaaatccgaaactctgtgagggccaccacgctgccacaggtggacagttcccctcccgaccttgcgggcgcaaactttgtttcatgcacaaaattgtgtaaaattcgcttcaggctgtgtgtgtaagaggtatatgaaacatacatggagtttactcttagacttgggtcccatcccctgatatctcattatgtatatgcaaatattccaaaacctgaaaatatcggaaacccaaaacacttccggtcccaggcattttagagaagagatactcaacctgtatccgcggagatcaagactgtgttctgtggctgtgctgagagcgaggtgatgattcacttccagttgagagttcatgttggatgttgtggcggggccacagcagctgcctccgactgacccctgctttgtgtcagccgctctacgaggacgctgtgagggaggcatgatcataagcccatttcacagatggtgaaacggatcctagagagagagccacgcgcccagagccccagagccacacgctgaatttcaccaagcagcctcccacacgggctccctggtcaggccctcatcctccgggcgaggcagcgaggcaggcaggtcagccgctccctgggccggagctagtgggtagcagagctgggagcagagcccaggctcatggctcccggtcagatcttttcttccctctctccttctcgaaagtcacacggggctgctcatgcacagagggtgctttcctgctcgccctcactctcatttagccaatgcatattgaaagcctgctatgtgcctggcactgggaaagaagttgggtacggctggatgccagggcacctgcaggatgtctgtaattcagcgtgtggctctgcggccttgggcgcgtggctgtctctctagggtgaaacagtctcatgatcatgtctccctcacagtgtccttgtagagcagctgacacaaagcaggggtcggtcagaggcagctgctgtccctctgccacagggctagagatgtcagaggtgctggggtgtgccaggcctggggtaccacgagaaggccagagccacagaaaggcttaggggggctgtgttagagcctccgagaaagctcacagggcagctggcctggagggaggtgccggcagaggggcccattgggagggggctgttaggacaacaccgaggctctgacaaggccatgtcaggaaagtggcgatggtggctgggggtgccccataaggctgttgcctacacctgggaatcccaggaactggcctggaggtgtgaggtccaattcagactgccggctggtcctacagtagaattggggtgtggagctctggggagaggtgtgaggctattttaaatagcgtctgggggtgtcggtgagcaggtggcattgggcgccctgagcaaggatgagagcaggcagggaaagggctgtggaagctgcagcagtgcggccctgaaggacggggtcgggagcccggggaggaggctgtctcacgttcaccgtgacgggaaggaggccggaggagaaagcctcataatgtccaagggggagaactcaagagggacagtgtggtcggttactgtgacaaggggtctcgacaggggaagcacatcaccggggtcatctgtggagccactgtggcttggggggagcagctctatgcatggtaggagaccccagactgcagggtgcctggtgagacccacagggaggcagcaggaactgactgagcaggtggctgtccacaccagggagcagcaggggggaggcaagggagggacagggaggggcctgacggcaccatcacagcgcagagctcagccctgaccgccaggactcctttccctgactgcacgccgacccctcctgatgaggcactttgggcctggccctggtgtctctcccgcgtccctccaggacgctgccccatcagagcctgcgcagggaccacagctgcttagaacacgtgggctgccagtacatgggttcaagtcacagtcagaagccacagcagaaaatgggaagcattcctttatttttccaggctttttttcttattttattttaaagagaaaaaatgtgacaaaatggtgaggatgctggcagcgccagcgttcccggcctgcactctctcctggcctcccctcggacgtcttctgcagcccaaatctgaacagcagtgaaaccgtaaacatgccccccaccagctgccgtggcctccgcccagacccttgctgcccaggctcagccggctcctcctgtgccctgtgaagtggcctcgtgtggaagcccgtccataatgctcagtggatttcctctgttctctccgcaggcaagcctgggacctggctgttgacatctgtctgtctcagctgccgacgatcatcgaggaaggcactgcgtttcgggtgagtccctccaagggcaccctgtgcatccgcggcggcagccacttctctgggcacctggactgcaaagcccccagactgggggtggtgcccaggactctcgggtgtcagattttgttcacctgcctggaaaaaatgtagttgccagagtttaaaacatcgagtcaaccagggtttaaagttaaactttgaaagaatcaacttttaaaacagtcctatctcaaaattttgctattacagatctacttttcttaatgcggactcactccctgtgagtggtgatcctgttacactttctagccttttcaccacagacgcgttgtggatctcccccaggcctctgactctcagccctgtgggacagtgacccacggggggtttggtgctgaaccctggagggcgttctgcccccggccgcactgcacgggcgctggagagctgagccaccctacggcggaacctgggtttagtcgccgcacctgcaagtgagggtggccccgggccttcgcggcagctccctaggaccccctcgtggtttcttaatgagcttttgccttacgtgaggcgccaagtctgaaaatagataaataagacggaggccctgccctccagaaacccgtgaggaaagaggagcctctcacatctgtgcagaatgcaagggagcaatcggcaagagggcgcggcagacacggggaggccagggatgggggaggcggcagcctgggcagaggcaggaggggaccagcatccccgcctcccgttggggccacacctgagacaccaccgtgtcaggctccagagccacagagcctagctttgccaccgagggcaagtttggtcgtctcctcatttaagggagggattatggtggtatccaaccccaggggtgctggaaggacaaagggagttaatgtaagaaaagtgctttggacagagcccagcacagggcccttgggaattcatgtgcaggcactgccccagagccagctgtcactgatgtgaggatgccaccctccagcccagggcaggggcaccgatggtcaggaaggttccgtccactgcacagacttttaactttcagtgcacaccacagccgtcagggaagcttttaacacatgcagtcgggagcctgggtgtgcctgcgtgcgtgcgtgtgtacgcgtgagtgggtgtgcatgaggtgtgtgtgatgtgcctgtgtggggtgttttaactcctcagatgattttgacatgtcccacgggtgggatgactgggaaaacggccttttaagagggctttcttttttataatcttctgttaccctcccattattgcttgatttttttggtaacatttgattgtgaaaattttcaaacctacagcaaagttggaagaaatttacagtgagcaccccatgcccaccacttacttctaccccatctttgtattcatggggtattttcaagggcattgcagaccgccccgcattttacaccgtgaggcggaagccagctccccgtcatgtgcttggcatcaacactgggcttctagacaaaggccttccctcccttcctgctggaccacaaaccttgggggcaatgacagggtctcctgcagagtggcaaaccttcacagacgccagctgtccaccctcagcctgccagagctgctttcagagtgcctgcgcttttccgaagagctctgggcctgttgccgcaaacagatatttggaaaccttcgggaaactggcctttctgtactctgagcgtggcttcactcggtacttttaagagatcagaataatctgctcttatataaaataatgcagtttctatttgcatgtgtgctctttctaaacgaatacttaggtttctgtgccaggtatctttgccaagtttcttttcaaggattttactctatctatgctaaacaactagaatcaatattctgcatttgggaatgatttcaccatgttggggtgtcaggacaagccggggataactgacgtggaccacacactaggttccttttgtttttaatcttattggaggtgtaacttacatatagaaaagtgtacacatcatacacatacagcttggtgaatgtttcaagctgcacatactcgtgtaatcacacccaaatcaagcagccccatgagccccctcggcgcccctcttagctcctcccttccccagcagtggccgctttcctgcccagttttgtgcttggatgcgtggagtcacgcagggtgtagtctttgtgcctgcccgctgtcactcagcattgtttgagtaagctcactctctctgcaccgcagctcacactcaccgcacggcagctcactctcaccgcacggcagctcacactcaccacacggcagctcactctcaccacacggcagctcactctcaccgcacggcagctcacattcaccgcatggcagctcactctcaccacacggcagctcactctctttgcaccgcagctcacgctcaccgcacggcagctcactctcaccacacggcagctcacaccacggcagctcacactcaccgcacggcagctcactctcaccgcacggcagctcacaccgcacggcagctcacattcaccgcacggcagctcactctcacaccacagctcactctcaccgcacggcagctcactctcaccgcacggcagctcacaccgcacggcagctcacattcaccgcacggcagctcactctcacaccacagctcactctcaccacacggcagctcactctcaccacacggcagctcacaccacacggcagctcactctcaccgcacggcagctcactctcaccacacggcagctctcaccacaccgcagctcacactcaccgcacggcagctcactctcaccacgccgcagctcacactcaccgcacggcagctcacactcaccacacggcagctcactctcaccacacggcagctcacactcaccacacggcagctcactctcaccacacggcagctcactctcaccacacggcagctcactctctctgcaccgcagctcacactcaccgcacggcagctcacattcaccacacggcaactcactctcaccacacggcagctcactctctctgcaccgcagctcacactcaccgcacggcagctcactctcaccgcacggcagctcacactcaccacacagcagctcactctcaccgcacggcagctcacactcaccgcacggcagctcactctcaccgcacggcagctcacactcaccgcacggcagctcactctcaccgcacggcagctcactctcaccgcaccgcagctcactctcaccgcacggcagctcactctcaccgcacggcagctcactctcacagcacggcagctcacactcaccgcacggcagctcattcaccgcacggcagctcgctctctctgcaccgcagctcacactcaccgcacggcagctcacaccgcacggcagctcacactcaccacacggcagctcacactcaccacacggcagctcactctcaccacacggcagctcacaccacacggcagctcactctcaccacacggcagctcacaccacacggcagctcactctcaccacacggcagctcactctcaccgcacggcagatcactctcaccgcacggcagctcactctcaccgcactgcagctcactctcaccacagggcagctgacactcaccacacggcagctcactctcaccgcgccacagctcacaccgcacggcatctcactctcaccgcacggcagctcactctcaccacaccgcagctcactctccccgcacggcagctcactctccccgcacggcagctcactctcaccgcacggcagctcacactcaccgcacggcagctcactctcaccgcacggcagctcacactcaccgcacggcagctcactcaccgcaccgcagctcactctcaccgcacggcagctcactctcaccgcacggcagctcacactcaccgcacggcagctcactctcaccgcaccgcagctcactctcaccccaccgcagctcactctcaccacacggcagctcactctcaccacacggcagctcacactcacggcgctgcagctcacattcattgcaaggtggacaccattgagtgtcccaacattcatgtgtcccttctatggccactgggcattttcagttttcagtcctcactaacagtgctggctagagccagactctgtcacatcagagcctgagacaaaagggaattctgtgatattggtcctccctttgaaatgtcgatatcttcttcagtatggatttttgtattaatttttatttttgtaaatattgcactgaaatatcatttgtcttgattactgattttttttttggtaccccacccgctagcaccaattctgtgcctgaggccaaggcctccccttcctggctggcctcccgttcaggggctgctccctccttcacatttctcggagtgatccttcggggtcccagggtttgcccatattcagctttaacagatggtgccagagcactctgcaaagtggctgagtcagtttacactcctgcctgcagcattcgagagttttagttgctatgtatttatttggctatgatggttcagtatgaaaaggtatttccttaagagctaatcgtgtatttacccgatggttaatagagcattgttctatacttgtactggccatttatggttccggcttttggtatcctgttttatgaaacctttatttcctctgagatgagcattctgagcagacgctacgctctttgtcagctagcagcttgtgtgtttccctttcacatctggacctgcatctgctcacatttcacgtcccccgtgaatgctcggcttactggtggtgtttgcactgaggaccgtgtccgcgtggctccctctgttccctcctttgcaccaagggccatgttcacatggctgcctctgttccctcgtttgtccctttgctcacttgttctttgcaccaggaccacacagttgtaatgacaaactctacgtgacactttctaagctggtagactaagtcccacaacttcgtttttttccccgagtttgcctcagttacttttggtcctttgcatttccatgtgaattttacaatcagtgtgttaatttctgcaaagaacctgctggatttttgttgagattacagttaatctacagattgatttgggagaagtcaccacctctataatattgagccttctcctccctcaacgtggttgtaaatggtattgtttaaaatttcactttctgatttttctctactaacagtgacatagaaccctataaaaattgaggttttcagaggctgaggcaggagaatttcttgaacccaggggcagaggttgcagtgagccaagatcatgccactgcactccagcctgggcaacagagtgagactctgtctcaaaaaaaaattttttttttggtttattgagatagtaggagaagccagaatgattcccctgcagtagaaagctcgggctaattgactttcttaggggtgttaaagagaacccttctgcaaactgagcagccgtacagggggatagaatgtccctacagagccgtacaggggggtagaatgtccctacagagccgtacagaggggtagaatgtccccttggcagtgaactttaagtcccctctttaagcagcaagcttgtcgtaagtggcaaatgtattgtgccattgtcaggacggagagtagccatctcagaatgtccagatggtgagaaaggcggcaggtatgctcaggttgttggtagcagaagtccagccggacgggctccacttaggtgtgacttggaggctcccagcctctcagccggccttcccattttcagtctgctgcccctgtttttagaatatgtcaaactgcctagcacacaggctggcaacagagcaaaactcctggcatccaaatcgccctgggagagccaggtatgtggtcctggccgggcaacccagacgctcagcccagcaggacctgtgagctctctgtctcgctgaatggacttcgctcccctgcacgcaggggccagctcaggagctcttcatggggtggagaaaatctcagagatttggcccaaaacatcagccctgtgaatcatgggtggagacacgggccgctctcgagatgttttccggaatatcatataaagtgttggccactcttccgcaggcgcttgctctaattcgtcagcctccccgtggctttagggagcttcacgggcttcaccgcgcacctgccaggcaaaggtgtgcttttccttttttgtcagtttgaggtgaatagtcaggaatttttctctttctgcatggagtagtgactccagcagtgaggaacatgtgaaaatccatcaggcaaagctaatgtgatagaaagaagaggtgtaactatctgaattacctgacttctgttcacagactcaagccttctctaactcaggagaattacgttctcgcgggatgtggaggagggggtacttaacgagatttttttttaaccaatttatgaataattcacacttgaaaacaggaaaatcactctaggggctccaagccagctccacaggttgccctccaagtgtgattaactttctgtaagctggctgcacaggagcacggattcctacgtggtgaatgttctcggctgactttttaagtcgggccacggggctctgcccgccaggctcctctgtggaggctgccgagagcgctcctggacttgggcgcacggaggcaccctgtcctgctcctggcgttcgcctgtccacatgtgtccacgttcactggaacccggggcacagccgaccccggccagatgagcggagggagggttcctcccgacctcctctcagagacacgcacctccactgcggccacccaccttccccccgagcaaaatcaaacaacgtagggaagagaggatagtggatgggagagagaggctggtagttgttttttttttttttttctttaattctttgtatcgggggctcagggaaggcagagctgtgtgttaagtggaagtgactctccgtggagggaatcaggccggactgctcctgcctggccgctcagttccgagaccttccaacggcagcctcccctgcagccttcacgctctccagccgcaggcccagcagccctgctgcccacctgctccatggcacccaggcgaatccccctccactctgtgcctgcactcacgtggctgggctaactgggagctcgggcccacccggtgtggcccacggagaactcgtgtcaccccctcgaggggccctgatgccgcctgacattctgaccccaagcattttttttggtctccctcacccgcgcgccttctctgtccagctgcaacccctcctcccgccctcaccccagagagtaccctcgtttcccatttcactgaggaaacaagaagcagtcgcatgaccgcctctgccgggtcctccagccctccccctgcttctctgcatctgggcccccttgctttgccgcctgcctggttcccctggggagcagccctgctctgccagcccagcctgtgcttccagtcccatcccccagcctgcccgaggatgccctccagcagcctttccccaccctccgtgcccccagctgggtctttctcaccagcgtcctgtccccattactccacatctacaaaaagcacttcctgaccctacatccctctccagccaccacctgtctgtcttgttcccctttgcaaccaaaaccaaattcaccctgtctcgaaacccctctggctgcgcttttgcccaactccagagcgttcttgctgctgatccggggcccagtcagctctccatccttatctcgcctggcccggtgctggtttgtggctctgccctggacgttgctccctggcgtccagacctttgagctctgctttccctccactgccgggccctcaccggccccagcgcggccccagctcatctccttggtctccatagcagaggctctgtcctgggcccctttcctttctcacttaacttgaaaaagattcacacaccatgactcccaagcgtgtccccagccagacttgcctgctgatccacacactcacggggtcccctgcccccggcatcttcactcccttgtccagccactgtcgtgagcaccacatgtccacagctggttcccagcacgctcctcttgcggccccagctcggtgccccggccaaaagccttggagtcatcctcagctgctctcttctcctgcctgcctctggtcccttcgtgcaccccgcaggctctccctctttggcatgcccagagcgcccgcttctcagccgcctggcatcctcgcggccctgcagggcgggcccttcgtgaaggcttggatgcccggcaggtggcaggggtgggcaagaccaggccatctgggaacatggccctaacaagcacctgttctgcttgccccgcagcacagcccgttcttcgccgagcagctgaccgcattccaggtgtggctcaccatgggcgtggagaaccgaaacccacccgaacagctgcccatcgtcctgcaagtgagtttcttcagaccgggccagacagccgaggttcctcaggaaggaagccagatgcctgtacagccccgggagtgccttctctctccctgagccctgtgggtctgtgacatcccagcccctctgccccgaagatgatggtgcatgggcaggtcgcattcgggcaaacggatcacacagatccaatcaggagtcactgggctgatcgcacattcattcctaaagggtttcctctaaagccattgatttccctcctccaccctcagataagtgtaactttgggactggggagtcatcagccagtccatcatccccctctcccctggctaccatttccactttaggaattgctgagattcagctacagatgggctttgcttcagagcaggctctcgacaccactgcctccttctcttgggaaggacaggagatggcagtgaatccgggagaggagggaggaggctccctgagcggatactgaccggcgaagcgggcagagcggctttgtggcccagcgccgtaggttatgcactgaagcacacacagatccggaagccggcagcccttcccttgcacggggctgtcacagctgctgtaacaaataggcccttttggggcacgtccttcagatgccagtgcccacggggcccgtgtcatgtcagtgctgttcacgtgcagaccatgacctgttcatgggttgggaggtcagcatcgtgggtcctgctggctggtttttggtcactgagataggatgggaggccatggaaattgaggagttcgtcacaggtagtgaagttagaaagattccacagaacttttgtttcggtgaatgtgtgtttgtggggaagtgtgtgggctgagtcagagtcaaaggagtttaaaatccactggtcagtgtagatatcaaggtctaagaactcactttaaaagctggaaaagtgtttttgtgattggggtggtgcagttggactttggcgaggagctgtgcatggccgtggggaggggctgcccagcagcaggcagggaatgagcaggccccgccctttttggtttaaagctgggtgactccccccacacacaggaagagccccacctccgggtgtggtgctgagttctgagagtcggcagagttgggtcctcgccttcctagaaagcagatcgggtggtggtacctccatggagaggggcgtgagtggcgccgcccacctgcccttcttccttccagagctcgtgctttctggttagggccgctcaccacactgacagacagcacaccaatcttcactagaccaggtgttcatcccacctctgagagatcatttagaaaaccggggccagtttatctctgtcacggccatggcctcagcagccttcccttccgccgttcagtctgtgctgcagcagtggcagccagcgtcgcaggcgtgctgtaggactgaggcttcacctcgttcaggactttgccccaagaatctcagccagagaaagaggagttgggagaaggaacagtgcacatggacgtgctcaagacagtaccgccggcctgtcctcgccggcattgtctcaggcgggcaacaaagaaccagtgtgccagccggctgccctggtgttatgatcccagctcctcagtaggccaaggcggggaaggatcacttgagcccaggagttcaaggccagcctgagccacatagggagactccatctctacaaaataaaataacattgtaccacatttcacagtatatatttctgctgctgtcagtatattatgacagttgctttttggacattgcaaaaagaatgcagacgttattactgttcttcctgtatgtacctagattcatttaagactatcctgagattacagggtgaggtgtaaacaaataaaccagctcatgttcaaaaccaagaacacgcagtgatagcagcaacgcaaccaaacaacatttgacagaagcccacgttttcccttcgtgcgactgtagaaaggcagctggctgtgtggccacgggtgaccgggggtggccacagcgcaggttgcccatgctgggccccacggctcctgttggtcatctgggttaccaggatgtccctcaggagacactggctctcttactggccttcctactatttgagcaatgtgatggagtaaaatcggccctctccaaagcaggacccgatgccaagcacgttaaatccagttcttttgggtccggcaaataatctttttgtaaatggccttctgttgatttctttcaatgttcccttggccacccacactccctcaaggaaggagaagacgtgctggaggcagctttctgatggtgacgtatgcgaagacagctctggtcggagcgtggggcatttcccacatgattttccagcaggtgtgagtggcaggttcctcctccctctggagggtctgtttcctggctgtgcccagccgggatcaatgggcggacctccacctaacacaaaagtagggaaagatgaagtgtaatggggtatcggcttcatttgacgtaccccccgggactggcttctttctcgttaactcggctcacttccccgcgctttctcttaaaagcctttatttttgccaaagcctgggccctgttatccttaaattattctctagtgccttggcaagtcagaaaacatcacttaagggaaagggagttttctcactcgcttccggttttccgaatccctgccacttcatccctaagccagaggcagtggctggtggccctccagggtcacgcacggtgtctcatcaggtccggctgattcgcagcccctcctgtaaacgtgagcatggaacaggcccttcctgctttccagcctcaatatcctctctgccttttaaaaatataaatcaacagaggaacaagaaggaagatacaatgtttaaaaaaattgctgttttgcccagacccttgattgatggtgtctatttttttgagatggagtctcactctgttgcccaggctggagtgcagtggcgcggtctcagctcactgcaacctctgcctcctgggttcaagcaattctctgcctcagcctcccaagtagctgggattacaggcacccgccaccatgcccggctaattttttgtatttttagtagtgacaaggtttcaccatcttggccaggctggtcttgaactcctgaccttgtgatccacccgcctcggcctcccaaagtgctgggattacaggcgtgaacgaccgcacccagccctgaacaccgtcttctcacgaggagctctggactctcgtggcctgtggggtgcgtttgccctctggcttcggcagctcgcccggaactcagtgctgtgtgcccccaacaggtggctcaggaagcccaggcaggggaacgaagagcgcctaggttatggaagagaggggagaaagtgacttttcttcttctttctttttcaggaaaaaggtgacagtgatatttatgtgttcatttatttaattggccctttttcttttcaatagatccagggtatacgggtgcaggtttcttgcatgcatgcactgcgtagtggtgaagtctaggctttgggtgaacctgctacccacatagtgggcattataccccataggtaatttctcagccctcagcccctcgcaccttttggagtctccggtgcctgttattccacctgtgtgtccctgtggacccgttgtttagctcccactcacttatacatgagaacatgcaacagttggttttctgtttctgagttattccactgagcataatggcctcctgtttcacccatgttgatgcaacagacacgatttcattctttttctggctgagtagtattccatgatgcacagacgctgcagtttcctcatccagtcctctgttgaggggtgatctcggcttactgcagccggagctccgcctcctgggttaaagtgattcttgtgcctcaacctccagagtagctgggatatcaggtgtgcaccaccacacctggccaagagtgattttataggatgaagttttagtcccttttcctagatgtcacagatcagtgtgagcatttcattaggaggtctatttgctctctctccgtgcatcattttttttacaaatagaatgtggggtctgaaagtacaggattgttatcaggtgacagcagaatgacaaactagagtgatgttatacataccatgtacatcggggactccaaaaccgccctgctcatcaggtgcccgaggcaccctggcctgcagcacctggcactccagggctggaactggagaatcttttcttatgaagcagctcttccagtatgcctgtctgagcactctcttcatatacaaggcaaatgaaatttgataaccttagcaattctgttttaatttggtcgcctcagctggagtgcagtagtatgatcatagctcactgcaacttccaactcctggggtcaggccaccctcctgactcagcctcctgagtagctggaactgcatgcatgtgccatcatgcccggctcatttttgtattttttgtagagacggggtttcaccatgttgggcaggctggtctcgacctcctggcctcaagcgatcctccagcttcagccttccaaagtgtttgcattacagtattgagcctctatgccggccaccatgattaatctttagtttgggctaccacaggtggaaaataaatctcagtaactcattcagctcaccatcatttacttctataatttccatagatcgtgggatggtccggaacaggaggtttttgttttgttgtttttaagtacagaaacaacattggctttttttctaaaagccaatcccattttaaaaataactttgctttatgttggcttcagtttttaaaaatcgtaaatcaacaaaaggtggcaggaagatgatgtaatgtttgagaaaaaaaaacagtacttaacctttccgccaatactctttattgacgatgtttctttgcaaatgaaataattgtagcaccaaatcccatgctgcccaaggacctccgacgccgactcccaggcaggtgggcccccgaggcccccgcgtgtgtttcatcagcacctgcagctcctacagtgggacactcgggaccacatcacggtggtgattgtgaaccagcgtcccgcttgcttttgttgtttgtaaggagcacattctaaggagacctttattgctgggctagtgtcctggtaaaacagtaacaggaactggccttgattagacctcttcgccccgtcctgccactttttccatttgttctgcaactatttaccttagaaacagccttgtccttatttacagtgttggaaaaaaacaaaaagaatcagaaaacaatctttgtaagctttagatctgatgatgtctttgatttctgacgattgcagccatggcgagacctgcctcctctcctctccctgggtcatctagaaacttgagcctcaggcagcctagtgttccctacacacagagagtcagtccttaaaaccttgggtggtggagacatctggtagccgaacactatgatgctgactttacatccgctggacaccttggtgcacacagctttgtgctagacgctttacggactctgcctcattgaactttgagaataagcccaagtcaagtactgttgtctccgtttttcttgataatgatattgaagtttccagaagttaggaatctaagccaattattgggcagagatggaggcagggttaacatcaggttagccggccccagagccagtgcttttcctccgactggcccctcaaacctgagttccaggcagcagtggcatgcgacagcccccgagttcagcataggagagggatccggttccagttcacatatcctgcgagcagtcccacgttcctttcccagcctcttaatcagagactctcagcatcaccagcacggggaacctgccactcctgggtccatggtgaacccagcgtgggagctggctccgggcacatagaagggaagtgaggccacattcccactgctctttctctgcccccaaggctggacatgctgggatcccctccataccccatctgcccctccagcctggctagccacctcctcttgctgccacctgtgaccttccctgtccccctcatcctcctgccagtgctcttctcccaccacagggaagctcctccctctccacggctccccagggcccatgctcctgactcggtggctcctccgtggaagtcgtgctggccgacccccaggagcttgacccaggtggccgccatctcctctcccctcccccgatcctccaccctcactggcctcctcgtccctttcccctgcctctcttgagggttttcaaactcatcccaaaccttcttttctagagtttgctttccttcaccccttcttctctcagcctctggccagtgctgcagtctcctcctccccatctccgtattggcaccctggtcaaacccacccccttccactcgcctccccgacttccagcctcttgccaggcctgtccccaaagcgagcacactggaccagtcactgctgcttaacgtcggctggtggcttctggatctcaaaacaaactgacctctctgcatgccgtcagcggggcctttccctatccggcccctcccccatcactgacctcagtcatactggtagcctgtgcatcctcagacacccgggcttttccagcctctccacctgcaacgcggtaaccccctcacgtcacctccaggacccgctgcccagctgtgtcctgtgcatcttctcctggggggagggaaaacctccgaggcctgcagcgaggccaggtcaggggctcccagggtctgtgtgtttaggcatggtgatggggcggtcatttgtttaatgtctgtctcccaggccacatgaaggatgggtgaggtggtccctactgtctgtggtcactctcctagcacccagcgcagcacctgccccataaacaccccttggatgactggggcatcgtggatagaaatgctgtaggttggagggagtcgatgcacgtgccttccagcatagccaccattaaggaaaaaatcaaaagaagtaatgccattaaaagtgtaaagcttggccgggcacggtggctcacgcctgtaatcccagcactttgggaggccaaggcgggtggatcacaaggtcaggagatcaagaccatcctgcctaatgcagtgaaaccccgtctctactaaaaatacaaaaataaattagccggtcatggtggcaggcgcttgtagtcttaactactcaggaggctgaggcaggagaatggcatgaacccgggaggtggagcttgcagtgagccgagattgcgccactgcactccagcctgggcgaccgagtgagactctgtctcaaaaaaaaaaaaaagtgtagaactttaatataacagaaaaagtatgtgcaaaacctctggcagagcccactctaacttataaggaactctgacatgtcaataagaaaaagccacattttgaagtagaaaactaaacgcatgcagggcaagtttactggggaaatggcccatcaacctgcaaaatgtactccccttgaaatccaagaaatccagatgaaaaggatgtattttcacctgtccttttggctaataatagtgtaatatgggctagtattgtcccacaagctttaaatttattatttaatttaatgaaacccttgtgggcaggtgttgtgttatatgtgttttatgaattaataaatcaaggctcagcgacgttaacttgcccagagtcacaccgcagtgagcgctgctgggtgaccagctcaggcagcaggaagctggtgcccacgtgcgtgccgtcgagagtgtgagtgggttcagccgcagggtcatttggtaacttaagtatatatgctccgaccttacctttttaatactcacatttatcttagtggaaaagaatcatgtacgtgtgccgatgtacccattaggatattgatcacaatcttctttatcagagcagcattttggccaggcatgatggcccacgcctgtaatccctacacttcgggaggctgaagcgggagggttgcttgagccagaagttcaagacctgcatgggcaatgtagtgagacccccatctctataaaaaatacaaaaattaaccaggcatggtggtacatacctgcggtcctagctactcagggtttgaggtgggaggatcacttgagtccaggaggttgaggctgcagtgagccatgatctggcatctatactctagcttgggcaacagagcaagaccctatctcaaaaataaataaataaaaatggtaaaagtaggaacattttgatgataatttaaatatctatcactggggaagttgtttaaaagaattgtgtacatttgcataacggaagtactgtgccgcctttgggaataatatggtcagtacatacctactgatatgaacaatgttcacagtgcattgtttagtttaaaaaggagctgagaaatagaatcacatattatctagttcaagatcagtaagagaagtgtggacataaagaacaatgtctgagttcatatacctaaatgtcaccagtgggttagctttttaaatgcaattaaagcatgtttgttctagtattttctacattgagcatcttttatctgtgtaataaaggcataaagcgtgttttcttcacctgtctaaaagcatgaacttgtaaggaaaggagcaccagctctaggtaactgaagcagcagacagatctgaactgtggtcagaccgctccaaagctggcagctcatgcagcagcgtttcggggttgcacaccagtatggtttgcagtgataccattttcttcttgttcttccaggtgctgttaagccaagtgcaccggctgagagcattggacttgcttggaagatttttggacctgggtccctgggcagtgagcctggtgcgtgccttccgcattaacctgggggctgagggaggtgggacagagattaggctccgtgtttcagtctgtgcacgtatttcatgatccagagccacccccagccgtgagacccagggcgagtgtgtccaccgtgttggtgtcctgtcactcctgaggccctcaaggagcccactctgtacccgtgcagcctgcagtgctgcctggcgtttgggggtctggggttgtcgcccctctttatgtctgatgttagacataggagtgagtgtgttgtcggccggtcaccttttcctgagccgcccccagcgctgcggaggagcagggcgcccctgagcctgacgcagcacccacctcgtggtgctgcttcccccaggaggagtctggatcctcagcactgtctgctcaccatcatggcaggcacaattcggaaacgctcttctggttcctcattctatagcagagtagtaatggccactaaaaacaccctggcagaggcaggatcaagaagcgacgtgcgtttaacaaataactcacagggaaagtaaaaggaggctgagagggaaccacagagtcaaggaaactcgagagacctatggccagctgccatgtacagtaaaccttacttggttctgttgaagttccaaaaatgaatactcataaaacaattagaaattttacaggtgctggatttatgttattcaagaatcattgttcgtttttcttgggtgtggtaactggatcatgtttttataaaagagacctaattttttagagatagacactgaatattcaccaatgaaatcacatgacatatgagccttaatttactgtgcttgggagcggtgcggtggggcggtgggtgcggaaccgctgtcactagctgggtggtgagtacctgggtttggtgtatttaagtattttcatcagataatgttgacaaagagtggtaattgatagtccagcactgaaggacgagagaaaacatccaaaacttggaagaatcattcagcactcaccactgggccattttcactccaggtgcctgaggccacaaatagcttgtaacagagtcagggcctgagtcatcggaggaaggctggcgtgactcggtcacttggtgtgtgcgtggtggtgtcgcttagtcatcctggaaaggcctgcgtggtattgcgtgcactctaagaagacaggaagcatgtattcataacagtttagaaagagtttcatttttaaggttaattttttaaaaccagtttcttccctttaaagaattaagcttctgctcattggaaatttgcctaatacatgaatcgaggctggataaacgaggtatttttacaggtacagattttgcctctcaggtgagggcccagccacccgaaccagagaaactgctcataccttgttaaatgtggcctttcacagggaagggacccaggcctaggtcccaccaccacctcctgtcttggttacaggggacctcacttattggaaggtgatacctttaggatatctttgaaattccagcagctttgagataaggacacagcagaaacccctggctgtggagtgcagcagtactttgccaggcatcctccacactgcagtgccctccacgccctccctcccctgcctctgagggcagagagtcccctgagaatgacatggccagaactgggcgccagtgagcccctgggcaacccccgctcctccctgcctttcccagggcaggcatctttctcccaaggtgtatctgaagtgcaaacatgagtgttgagcaagctggccgtgccgtcacggagaggtggccgtggtgtcacggagaggtggccatgccgtcacggagaggtggccgtgccgtcacaggtggccgtggctcgtacgtgagcaacacagtgaaggtgcctgatgctctgctgccaagagcagacgaggccactgagggcaggcaagggccccaggcgcaagcagcctgcgcctccacaaggaaaagctgccacccgattcattccagtctcttgacaccagtcaaggctggcagtatgtggcagcttctaggaataaatcagagatgaataaatctggaggaagcccctctttactttaagtgaggcccattcattcctgttgcgtttcccatatgtgctgaagatagcaccgcagctggtcccgcgtggcacccctgctgctgcccgttcccttgctgcggcacaggtgcgctgacgccctccctcgcccccaggccttgtctgtcggcatcttcccctacgtgctgaagctgctccagagctcggcccgagagctgcggccacttctcgttttcatctgggccaagatcctcgcagtggacagcgtgagtatccccgccctcctccccagagtgatgtgaacctgccggcccttctggggatgccgagccctgcgtttccagcctgccctttctccagcctcgctccctctccaggcaccgccgttcccttcctctcttctggggtaaagtgggacgcgcccgcctcggcagccacctctgggtcgtgggggctgtcacctacctgtcctgtccctggccttcccctggtaccctgcgctcagtccccccacaccgtcctgtccctggccttcccctggtgccctgcactcagtccccctgcctgtgtctgacccccgtaaggctgtccccgtgctcctgaccctgactggaagcaaccccgccatggcataaacttggcctctgcctcgcccagaccccgcattggctctcctgtgcccaccattgcatttctccccctcctcaaccctgcacaggtggtctgggccaggccccgaggtgttaggggccacccccttacacggggctgtccagctctgtcctctctgacgggcatcagccctggccctgcagccatgtgttcgcccctcaatcatctaggccagggacccatatttagctatgttaagagagacacaaggtcagctgtccctgtccccagcggcttatgcttgggtgctggcaggggttgcaggtgacaccagccctgttgtgaggcagggtcacctcctgcaggagctaccagcgagatgggtcagaggagtggggctgagaagtcgtgtgggcgagacccggcctatgctgaactggaaacgccaggaagggccttgagggggtggatgtcgggcgggggtccaaacatggaggtggcagggagggctgggaagacatttagaggagggcaggccactccctgtggctgtgtgcggggacacgcagggaggccccatccacgcagacggtgcacggttcccggtagacacagttgaacttcatttagcaggcatggggattattacagattttggaacaaagacatcaaagaatgaagctgtggtttataaacattgcctggcctcggtgtcaagtggattgtagggaaacacggggtggagagcattttcctccaggagggtgggcagaggaggtcgggctgcagggctgggagggcggcaccaagcctgggttgggagaggcgactcgggctgaagcctgtgtggccggctggggctcggggagccttccagagacaactggtcaggagccctgtgcggcctaggagcagggctggcccgatgccaagactggggacctcgtctacccagtggtgatggcaggcgagaccctcgaaggaaaatgtggaaggctcagctgcgggagaactctcgaaagctcctcgtgtgacacagtggagaggagagctgtacagagtggtgcaaagggtctgggaagggctcatttatagaacgtgaagattctagaacaaagggtgtgtgctgagaatggagttgggggatatgttgccctctgcagggttgttggggacaaagatttcccagagatgcctttgcctttagctgtccgtgtgcggaggggcacacgtgtgtgatacagagctgggctcggagccaggttggcagggagccccgggaagaagccaagtcagtcttgctctgggggtgccgccacgggtgaggagagcgggacggaggagccggcatcagggcaaggctggctttgctccctgcttggttttgaagcaaaccagccccagcaactcattagaaggcctgtaggagcaggtccacgttccccccggacttcggccagctgctgtgtgcacgtgtgtgcgggggtggtcatgtatgtgggcgcttgtgcgtgcatgtgtgtgtggcgccctgtcaggcggctttcatatgcaaagtctcttaattcctaagtcccctgtgaagttagcttgaatttgcagcctatttactggtgaggcgccgcccacaggagggagcaggggccacatagctgccatgcgaggggccggcaccccactgggcccctgcgccgggtctggagctccttgcccacacagggaaatggaaggtctagcaaagtcacagagcaagtacaggagagtgccaagaacaccttggagaggccatggcttggagccggggaagaccaccctttccttttctgtgtggcaggtgaggggagagtggacggagcttaagcccccggggctcctgcctgctgcccggcgctccccaggccacattctgtcagctcctccgtccagtcactggcactgagacccagcctcatccttagccctgtcagccatgtcgcactggccaccaggacctgctgtgctcgctgaagctgccctgttgggctttgttcagccaaattcactgaccctgttgtccaggcactggcaggcaccccgagccacaggctcgtaccccgcactgtgcgctctcacccgtcagccctgcacaccccacacaaagccactgctgtgtctcccacccacagccgctgctgattcaagtccagcccaggccatcaggtccccaactgtgctgcccacggacccctgggcccctgctcagcccttctgctccctgcacccagccctgaccatagcctccccacaccccaagtcctcacgtactactttggtgtcacagctgaagtcagggggcagtggggaggctgctgccgaagcggacggtgagggcttccaccttggaggcaggcgtcagtcgtacccagcaccagttgacctctcgctggttccgctgattcttgtagattccctgggattttctgctagttcactggttcttgtagattccctaggattttatgtatatgctctctccaagcagaagcagcttccagcccctcttccggttctgggatctctcactctttttctgggcctggggcactgaccatggctctgctggcacgggtcggctaccgtgcttgccatctctcccagctgctcctgatttcctgagctggatgcggggagctgctgctcttcctctcagcacagctgaggttgaccttgacctcagttcaaccttgaaccctcctgggcccagtgctctgcacctggctgtgaccagagaacgctccataatggtgacctgaataccatatatttcagcaaaatattttccctgctacccattaaactacagataaagaatgactgctttgaaagattggctaaagcactggatttaaggttaaaaccctgagtttgatcccatcaccgcatttgctcttacaagtcattttcacttcccttggccatgatttgcctctgtaaaatcatgagccttcggccgtctgccttcagccacagttccagagctcagaaccaggacgtggaaaactgctgtgtaaattatagaggaacaggaacaggaccaggaaggggcaccacgtaaatctcacatctctcctgcctgtccctgttacactaaaaccttttcttgctaaacagaaagcttggctttgtggatcaggacgcgagaggtgtgggtcatttctattttactcttcttcaaattcactgaagagccacattatgtaaacaaagggtgtttggcaggaagtcattttgaaacgtggtttctgtcctacacccatatcttcgtcatctacatggacacacttagaaatatcttggcacctggccacggatgaaggaccatgtgtaggggctctgggatgcacaaaacggtgaccctcacatgacacaaagcccagggtgaagggaggaagagatgccatctgcatgcagaggtctgggattacggccgcctgagcctgctccccagcaccgccagtgctgcaggaacgtgtctaagccaactttgattctcagacttcgtgtttttagtaccttttaggacctggaaattgatgatgtctttatttttagtctcaggggtggctcttggtgaaaggggacagccttcctcgtaccttcctcgtgacattctcactgcatccacagcccatcatggtattgcagtgcagggcgtcttgtttaaaactggctcttggtcccgtggatctcccagggcctgttgctctcgagtgccccaaatggcagaacgtggccatgagcacggaggctgcagcgtgccttcgttttacaccctgctccaggcagataccagggcctcgggtttattattcatgctgctgaaggggtcatctgctcagtactgcttggggagctgttcccacagccagctgggcatgcccttgcctgcagtgttcttgtaactgcctgcaggcatcacaggccttcctgtgaattaatttcttaaccagcttgttgcacctgcatgtttaaaagcaatcattccactgaggggcattttgaagtgtttccggtagaaactgagcctcgtctacctcacctgcctcgcccttccttccatcgttaccctggcgataacttcccagagatgaaagttccctgtgtttttgaggggtcattcctctactcccttcccctccccacgtctggccatggatgttgctggcggtcctccggatctccacccctacccccccatgatgtgtgcaccccctacaatgtgtgcatgcccctctgtgttggtgatggtcctccgaagctccgcccaccatgatgtctgctccgccccctcgtgttgctggtggtcctctggagctccgcccaccatgatgtctgctccgccccctcctcgtgttgctggtggtcctccggggctccgcccaccatgatgtctgctccgccccctcctcgtgttgctggtggtcctccggggctccgcccccacatgatgagtgcctcctgcagccctcagccgtccctgtgactcctggggcttgccattgtgcagatcggggtgcacatggtgtacagacgggtccacctgtgaagatcgcagagcctgctcagaggttcagaggtgcagacagaagccagccactcccccagtgttctcagcatccccctgctgccgccagccggccctcaggacacacttaagagtttgagaaggatcggagcccactcaggctgggcccagcggaagggcgagcctgggacctcccctcatttcccaagcacctttggggcacaccgtgtgtcccattgtgccagaagctctgagggattcatggggaggccttaaagaaggtgggctcgggcggaagaaaagacggaagaacaccatgtgccaccggggagaagtgtgtgccgtttacatgagacagagcagggcacagtggtgacactgatctgacacagatggtaccgcacaggacaaggagcaccaaggggggcacatgaagaaagccgtctgtccaggattctcccaggactctgatcccagagggcctcccccagcatcactccccatgccaggttacactccacttcacactaccagccagaaattaccaggcagatagaatcaggaaaatatgacccgtaatgaagaaaaggaaatcaacccattaaaacctgctcagaactgctgcaggtgttatcattagcaggccaggacattaaaaagttagaagtctactctacatattcaaaaagttaaattgagacacggagaatataaaaagaacccaacttgaatttctagagatgaaaactgcaatatgtgatgggaagaaatatacttgatgggattaacaaccagttaagcattgcaggagaaaacagtacacggttaggcacggggctcacgtctgtaatctcagcacttttggaggctgaggcagacagatcacttgagtaaccaggatttcaataccagcctgagcaacatggtgaaacctcgactccacatgaaaaaatacaaaactcagccatgcatgttggcgcgtgcctgtagtcccagccattcagaaggctgaggcgggagaatcgcttgagcccgggaggtcgaggctgcaaagagccgtgattgtgccatggcactccagcctagggaacagagtgaggccctgcctcaaagaaagaaagaaaatagcaatagaaactaacaaaaatgaagcatggtaagaaaagaaaaaaaaatttaattaaaagaatattattccattgcgggacaacggcaagtgacataacgtactatttgggggtccataaaggaggctagcagaaaaagtatttgaagaaacaatagctaacatttttttgaatttgatgacaattataaacccacagatccacaaagcttagcaaaccccaagcacaagaaaactacacgaaggcatatcgcaatcaaattacttgaaaaacagtgagaaattcaaaagtctaaaggcagccagtaaaaagccagtaaggagcaaaggtgagaatgacggcaggtttcttcttacagatttcctacagatggaaaaggtgagagtgatggcaggtttcttcttacagatttcctacagatggaaaaggtgagagtgatggcaggtttcttctcacagatttcctacagatggaaaaggtgagcgtgatggcaggtttctcacagatttcctacagatggaaaaggcagacagcggaacagcatctttaaagcagagagagagacagagaaagagaaaaaactgtcaacctagaattctatacccactgaaaatatatttccaaatggaggcaaaataaagacttttaaagacatacaaaagatgaaagcttatccccggcagatccacactacaagaaacgtgaagtcctttagccttgaggagaatactcttcagagggaaacacggttctacacaaaggaattcaaagcagcagaaatgagtactatgtggataaatatgggatttttttctttttatttaaatcttctttaaaagataattgttttaagaaaaataataacagtgtactatgaatttttttcaataagccttttgcactcttaattttttttccttacgagacaaggtctcattctgttgcccaggcctgatcaccgctcactgtaagctcacactccctggctcaagccatcctcctgcctcagcctcccgagtagccgggatcacgggcacaagccacggcaccccacagaatgtataacatttgtaagagcaaaatgcatgctaacagtaacaaaaagatggggaggagagagaatgaagaaatactattgtaagattcttggactttgtttgaagtggtctcatatcacctgcctgaagatgaactgcagtagtccataaaccctaaagctgccactcaaattttaaaaagaattacagttaattagctgacaacagagatgatatgaagtcataaatatagacaacacggaaggaaaaagataaccaagagtagatgtaacaaatagaaaaaggcaggatgatagatggacacctaatcctgcccgtcactgcagtgtggagactgaacgccacaatgagaaggcagaggccaccaggttgaagagcaagaaaaaaccataccatggctacaagcaatgtacttttggcataaagacacgagtagattgaaggcaaaaggacgggaagagctctgccatgcaggcactaagcagaggaaggctgcagggcctatgttaatatcagacagaggaggtttgggagcagagaacgttgctaacaataaagatagacatttcataatgctacggaagtccattcatcattcatcaagagaacgtcgcagtcctaaatgtctattcacctaataatagagtttcaaaatacatccaacaaaactgatggaactgcgaggagaagtagataaatccgtaattacatttggaggtttcagtgctcctttctcagtaactgacggaacaagcagaagagaaatcagtaggaatagtggggacttgagcagcactctccagcagctgggccctgacgtttatagaacacgccacacagcagccatgcagtgcacagaggctgtgccacgataggcccgacccttggccaaataaacctcaacaaatgtaaagaactgaagccttacaggcgtgttctacagccacagtggagtcaaactcaaatcaataatagatagtaggaatgtctctaagcacttagaaacagaaacttttagataaataaatgattttcatttcattccataaaattttaagtaaattaatatatatgtgcttaatgcaaaatagaatataaatatgtaatattaagatacatagatattataagtcgtgaataacaaagatttatataaaatatttattactataagtatgtatatataatatataatataatgtacatataattataaatacttgcattaaataaatacattatataaacatgtatattaagatataaaataaataggttgagtatacgtggacccagctctgaacagtgctgagaggggagtgtgtagcagctgctagacaatgcattggaaaagagggacggtctccaaccggagatcccggcttccacctgaagagggcagcgtgagtggagtaaacccaaagctgtcggccaaaggaaatgatacaaatcagactggagactaatacgaaagaagacagtgaaacatcaaaatctgttgaacaaaacatttttttaaaaaacacatgaataaaactgtgaaacaccaccctgactgataaggaaacaaagaagacacaaattccagcatcaggaatgatagaggtgacatcatgaaagattctagggatattaaaaggatgataggcaaatatcatgagcaacttgatgggagaacatttgataactttgattccttgaatgacacataccactcactgaggaagacatcattaatctgaatagcactatgcttcttttttttttagagactgggtctcaccacattgcccaggctagttttgaacttctgggctccagcgatgcttccaccttggcctcccaaagtgctgggattaaagcctgagtcactgtgcctgtcactacaagtggaatttgtagtgaaaacttttactacaaagaaaactgcaggtccagatgacttcgccagtgaattttactgaacattaaggaagacgtatttggatgacatctaagcaccttcccatattgttctatgaggccagcattacctgataccaaaggttagacacacgttacaagaaaagaaaactacagataagtattctcttgaacacaggtacaaaaatgctaaatagaatttttgcaaattaaattcaatgctatataaaaacaaaacatgatctagtgggatttatttcagggatgcaaacctgtttaaggattgaaaaatcaatggatgcctcttcagattattaaagaattatttttaaagagagaaaagtccatgtaatttaccatattaaaaaaagatgaaaaccatattaccatctcaagagatgcaggcaaagtattttaacaaaatctgagatccacttctgatttaaaaaaaaaaaaactccctgcagactcctaatagaagggaacttcgtctacctgacaaacagcatctccacaaacttacagccaacaccatacagtggtgaaagactgaatgcaagatgaagccatctgttcttgtcacatcccttgacattgtactggaagttctaggtagtacagtgagtcaaggaaaaaaaggcattcaagttcaaaaggaagaggtttaactgtattttcagacagcatgattgtctatgtggagaatccagtttaatctattttaaagtgctactagaaaaaatttagtaagtttgcaggttataagatcaatatacaaaaatcaatttatgtatatacactagcaatcaacaattcgaagttgaaattaaaatagagaacatttacaataccactaaaaaaaaagaaatacttagggatacattctgacaaaaggtgggcaagatctgtacaccaaaactacaaaccattgtgaaaagaaatgaaggaagacctaaataaatgaagagatcgtccgttatcttgatttctgcttctgagatccacatggaaatacaaaggacctacagcaggcaaaacaactttgaaaaagaaaaacacagttgaaggactaatactacctgattacaagagtgactgtaaatccacagtactcaagatcggaaatagcttcaaatggacaaacagataatggaacaggaagaaagtcagggaatagacccatacatataaacacctgccctatgatgacatggagaaaatgaaaaggcaagacacagactgggaaaatattgacaaatcgtttttctgttaaaaacttgtggcaagagtatagaaagaactctcaaaaatcaatatgaaaacaaacacaagcagacaaagaaaattgggcaaaaggtttgagcagacacttcaccaaagaagtacaaatggcaaatcagcacatgaaacaatgctgaatatcattagtcaccagagaaatgcaaactgcacccacagtcttataccactgcacaccaagtagatgccagaaatgcaaactgcacccacagtcatataccactgcacaccaagtagatgcctaagaagctgctgttatcaagtgtcggcaaggccgtggaggaactggaaccctcgtatgctgctgagggcagtgcaaagtgtgcactaccactttgcaaacttatttcacagtttcttataaagattagcacacactcagcatacaatccagccattcctttcctaggtattccccaagagaaatggaagcatgtccacacaaaggcttgtacatgaatgttcctagcagctttatttataatggccaaaaactgggaatagcctaaatatacattaacaagcggatgaataagcaaactgcaatctttccatgcgatgaaatcgtactcaacaatgaaaaggcatgaactgatctcaaaatagttagattgagtgaaagaagccagtttaaagaagggtacctgctgtatggtgccattcatttaaaactctagaaaatgcaaactacagtcacagaaagaagatgagctgctgctgggggcaggtgagggtgggggcacaggggcagaagaaaatgtctgaggggccagaccccacctagactgtggcggtagcttcacaggtgtagacgtacgtccaaaatcttcaaattccgtacttcaaatttatatgtcgcttatacatcaatgaagcggctaaaaaacttctcattgtgggacagtctacaaagaactgtactgttcccttctagattttattttgtttttttattttttctgagatagagcctcactctgtcgcccaggctggagcgcagtggggcgatcttggttcactgcaacctccgcctcccgggttcaagcgattctcctgcctccgcctcccgagtagctaggactacagacgcctgccaccatgcctggctaatttttatgtttttagtggacgaggtttcccatgttggccaggctggtctcaatctcccgacctcaagtgatctgcgtgcctcagcctctaaagtgctgggattacaggcgtgagccactacacctggccccccttctagatttttaattcaagaaacacccccaaaaatgtggggggatttattctcaagactaatgtgtatcagctaagtgcagttcctagttggatcctggatcaaaaatcagaggctcacagaggacagttgtgaacaattgggaggaatttgactctggactgcgtgtcaggcagcaggattgggaggagtttgactccagactgcgtgtcaggagggaggactgtgtcgctgtcacgtgtctggagtgtgatcatggctttgtgctcatggaagcaaatgtccttttccttaggaatatttctgggcaaagcgtcatgctatctgcaactttcacacagtgcagaaaaacacaggggatcagggggcagaaagcaaacatggcagagtattttttgaaattgtccttagggtcatgtgatgggaccagagctcaagagcagcagaacttcatgatgagaaagtccaggagatgtggccacagctgtcttccgctggtcacactttgcaaggatggtggtagtggttgttttaataagttcctcaagcctgctgttagcatttgtgtatctgctaattagcaagattaaggagggggagagttaattaaggactcccgtaggcaaggttccagttaattgagggtttttcatagataaaattaatactcagtccagactgaccttctgagttatagttaataaagttgtggttatggtaccaccagggaactccaagagcgtaatgtcagtggatctggaaagatgctctgtgatggtattcatgaagtaaatccagatttggaaattcaaagaggcttcccactgggaacaggctgctgtggtccccggaaggaacccgcactatgaagaaaaggcagatgagagagtcatagaattttgtttctgcagcccccacgtctgtgctggttctcctacccgtgctcaaattctctactgttttctctgcaaagtcgtttcaccacagttcgtgtatgctggcgttgatagcctctcctcttcctgcttctccacttttccccactcccccttcctcacacacgtacacgcaaaactcaattcaaaaaatgtgcaaggttagctttctctgtcatccagcgatgactcagtctcaccaagggggcaagagagtgccatctagagcgtgtgaccctgctggtcccacagcagaaggcagtgccctggtgggggctagtctagttaggacctgagcaaacattttacttgtgtcccgaactcttgttcctatagtttctatcttaacaaattttatttttttagaacagttttagatttacagaaaactggaaaaggtagtaaatagagttctcatgtaccctacacccaattttccctgttgacatcttctattagtacaacatgtttgacacaacagtcaatgaacttatgttgatcagttattaactgcagttgatactctcatcagattttcttgctaatgtcctttttctgtcccaggatcccacatgacattgagtcctcgtgtcttcttgggcttctcttggccgtgacagtttcccagactctccttgtttttgatgaccttgacagctttcaggggtactggtcagggattttgtagactggccctctgttttgatttgcccaatttttttttcgtttgagacggagtctcactctgtcacccagtctggagtgcagtggcgcgatctcggctcactgcaacctctgcctcctgtgttcacgcccattctcctgcctcagcctcccgagtagctgggattataggcgcccgccaccacgcccggctaatttttttgtattttgtttagtagagacgcagtttcaccatgttagtcaggatggtctcgatctcctgactgcgtgagccaccgctcccggccatgcccaatgtttttgtcctgattagattgggatttggagaggaagaccacagaggggagtgcccttctggtcccgtcataatgagggtgcatgctgttggaatggcagatccctggtggcgctggcctgggtccctggctgaggtggagcagacccggctgaggtcaggcgtcccccgggtgaagccgctgctgccgcccgttccggaatgggctgctctttggaaggaagtcgcttggatgtgctaggcttttgttgcctaaactgctttatgtctgtggttaacttattccttcctgcagtttcattatctttttagggtctaaatatagttcttttaatttcctcttgttatttatataggcttactgtataaggcttagtcttggagttgttttattttattacattttgttttgcatttctgggattttttagtattccttctttcagtttgccccttcttgagctaaccttcctgcagtaccatcttccagctgactgtcagtggatgaggtggaaacagttttaccctttctgcagggagctttgccagttagggacccttcaggagtagtcaggaacgcgcctgtgcccacagttgggtgagtcccaggaacggcaaaaatgtcacctagcgttccccctgctcatctaacatagtttaattgccttgatggtccatggaatttccaaactagaggttgtgatatgcagaaaatcaacaagattgcattgctagggagcacgtttgtgaagctggcgtcttccacagaagctgtcatcagcgaggaggggctgttgaggggacacatttgtgaagccagcatctttcacagaagctgtcatcagcgaggaggtgccgttgaggggactccgggtgatgctttcgtcgtttggaaagtagcactgctgtgcagaatggcctctttttagccatcctcctagttccatgtggagccctcagaatgggttttactccgggcagattccaacacaccctcatgctatcccgggagaactgcggaccaggaaggcagaggccccttcctcccacccccatggaagccagaccacacgagctgggccacccagctgtcccagcactgggtcggtcctgggagaccacccaccccagaagagaccaggctaggtgacatgcacattggtgacaggccaggctgcagggaactgggtctgtcggtgccccctgggaaggtgggaggtgtttggctggagggagacagttgtatcagctgcctccgggttgccaagaatgaaatgaacaaaagagagaggaacccggagggggctgtctgcccagccatcccagttccaggctcttttcgcctgcacccaggcagactagaccgagccctggcaggggtgacggctcgccctttgcaagatggatgggcacaacggggccctggcaggtggaggtagcacggcaggctgtgccgagggcgaccacagaggctgtctctgtgtggcaacttcagggccccatgattgatggttaggctgcttggaacctgatcaaatctcagctcagcctgctgggtgtgagcaagggagaggggatggggagcctggtcagcctagagcgggccccccaccactgaggaggccccgggggggacccccagcctgacttctccctgctcatggctggctcctgtcccacactctttcgctactgtatttcctcttcttagtattagaatttggatgagaaaggcaccacagttttgacctgaggtcaaggctgggttcgttgcaggtccagaaggctgcagctcagacacctactctagccagaaatgcccggggctctgtgcggttccaagggctcctttgccagccctgccactgggcacagggagcccctccactactcaccgcagacagagcagctctccagtgggaagcaggtcctgggagtgattggcatacgtgatctggaattgtgatgtttctccacagcccaaacatgggttcttttattcattcatccaacatttactgagcgcctaataggaaccaggacgtgctgcctcctgggactaataaagactaataatgcatgtttttgtcctcacagagctgaaatctagcccggaaggtggagggtggaaatggctaactcaaatgcagcagcttgggaagtgcagtccaagtccctgcaaagggtggggagagaagcctttgcagaggctgttgcccggggacagggccccaggcggagaggacaaaggcccagcaggcagagggagctcaccacattcccaaagccgcaaaacaatgagctcggtgtgccccaaagtctgaggagctgaggagaaaggggaagatgagtttctttgtgcagagatgtttctcagtcaccactgtcacactgctgggttattgacaccagaatgtgaagaatctcactgtcagtgccacatgtgggagggcattgcttaccatgactcagcgtggcctcagggacagtgcgtcaggcccggcaggacagcactcggtctgtgctggggaagtcgtgcagacgtgcagagatacagacatgtggacccaagtcagccccggactgagcagcgggtaccccagaagggatgggcagtggaataaggattacatgtaggggcagaggacgtctcagtctgtacctgtctatagcattttaatgtttgagccttgatacctacaaattttaggacaggtttgaaaaagattgaaaaagatggaaagcatgccagtgattttgctatggacatcagatgcagcattcagggccactgtagacgtgggtatgtctggcctgagaataactaaagggctttttttttttttagacagtcttgctctgtcaccaggctggagtgcagtgacatgatctcagctcactgcaacctccacctcccgggttcaagcgattttcctgcctcagcctcccaagtaactgggaccacaggcgcgtgccaccacgcccagctaatttttgtgtttctagtagagatggggtttcaccgtgttagccaggatggtctccgtctcttaacctcatgatccacccgcctcggcctcccaaagtgctgggattagaattaaccatttacagaaaatcaatgtgtctatattaatatatatatttatgttgaaatatcttgcctcacttggcgagtggggaatacactgtgcctgggggtgaaggtctgaggcggaaagcttgtcttgcactgctcggtggatgttctgctgaagtcgtgaagagcagtgagctcttgtgaccggtaaacagaaatccctgcttcggtatcatttccccaggcattagcagttttattggcacccaccattgtgaaaacgctgcacatatcaacatctcagcacagccctccatctgcctgcagatgacttccccggtagcatcctcacgttacggtaacacaccaccgaaggctcactcaggagctgtgttcttgttggaaacttttttccttcccagcaccccgctcataacaagggctaaactcttctacccagtggacatgaaacacggcccgtatctctgtgattgtctctgtgttcacgtcagaacgcacgtggtagggtatttgcgtgaaatcgcgcgtggtagggtgttcgcgtgaaatggctcagggcttggctcatcatcctgcctccttatgccttccccgtcaggcacggtggtctgttagcctgggcgtaattcttgtgttcctgcttctccataaaataatccttaaaatctttgttaaggagaataaagggagggtctcttcccatggcatcttttgccagaatattcagaggaagaaagcccgccccggccttacgggtgcaccttgtagaaggcagggccttggccaggggctcctcctggtctctgccccattgtcgtgtctgcttgcaaaccacatctttagttgctgcaacaacaaatacatgcttgcatcttcccactttgtgtttgctcttcttctcttcttcacctcccttttccccatttaaaaaaatataagttcctgaaacctgagacacagaagaatcaaaattggcttcagtgtgtggtgagggaagggggcttgctcaggaaaaaaaatgtcatgttcatgctcttcccacctgctttctactctggccttcacatgtcaccaccatagcttgatctgggagaaaacaagcacagcaagatggagcctgttgagagggcggctttggcagattcacgctgccggcaccgtgctgttcatctgagccccgagtctctgccgggtcttccaccaagcccctccgcccaggatgtgtgtgtcgcctgccgggtcttccaccgagcccgtgccacgcagggtgtgtgtgtcgcctgccgggtcttcacaccgagcctgtgccacgcagggtgtgtgtgtcgcctgccgggtcttcccaccgagcccgtgccgcccaggatgtgtgtgtcacctgctgggtcttcacaccgagcccgtgccacgcagggtgtgtgtgtcacctgccaggtcttccaccgagcccgtgccgcccaggatgtgtgtgtcacctgctgggtcttcacaccgagcccatgccacgcagggtgtgtgtgtcacctgccaggtcttccaccgagcccgtgccgcccaggatgtgtgtgtcacctgctgggtcttccaccgagcccgtgccgcccaggatgtgtgtgtcacctgccgggtcttccaccgagcccgtgctgcccaggatgtgtgtgtcacctgccgggtcttccaccgagcccgtgccacacagggtgtgtgtgtcgcctgccgtgtcttcccaccgagcccgtgccacgcagggtgtgtgtgtcgcctgctgggtcttccaccgagcccgtgccacgcagggtgtgtgtgtcgcctgccgggtcttcacaccgagcccgtgccacgcagggtgtgtgtgtcgcctgccgggtcttccaccgagcccgtgccacgcagggtgtgtgtgtcgcctgctgggtcttcacaccgagcccgtgccacgcagggtgtgtgtgtcgcctgccgtgtcttcccaccgagcccgtgccacgcagggtgtgtgtgtcgcctgccgtgtcttcccaccgagcccgtgccacgcagggtgtgtgtgtcgcctgccgtgtcttcccaccgagcctgtgccacgcagggtgtgtgtgtcgcctgccgggtcttccaccaagcccctccgcccaggatgtgtgtgtcgcctgctgggtcttcacaccgagcccgtgccacgcagggtgtgtgtgtcgcctgccgggtcttccaccaagcccctccacccaggatgtgtgtgtcgcctgccgggtcttccaccgagcccgtgccacgcagggtgtgtgtgtcgcctgccgggtcttccaccgagcccgtgccacacagggtgtgtgtgtcgcctgccgggtcttccaccgagcccgtgccacacagggtgtgtgtgtcgcctgctgggttttccaccgagcctgtgccatgcagggtgtgtgtgtcgcctgccgggtcttcccaccgagcccgtgccactcagggtgtgtgtgtcgcctgccgggtcttccaccgagcccgtgccatgcagggtgtgtgtgtcgcctgctgggtcttcccaccgagcccgtgccgcccaggatgtgtgtgtgtcgcctgctgggtcttcccactgagcccgtgccacgcagggagtgtgtgttgcctgctggctgccgttctgcgcgtgtgtggtttcaagtcttgtttcctcttctgtttaacgaggcccttggtctaagtgtgcttgtaatttgggcgagtgagcagcagccgagagagtccaccccagtccccctagccagcgaagtgggagctcccaggttcctgcctgcggggagggtgggggcggtttgagttagtgaaaatgtgtgtattaaacagatatgtaaatgacccctgccgagcgctgaaaatgaaggtatgaaaaggcatcatcatccgtggttcccacctggcataatgaccgtatcagaacagacatctggtagtatacaccacatagttgccagactccgataccaagggcacatctaagttctcccaccctgatttgcatgcctcaaattcagaattagtgagatttgagtcagtgatgcttcattacactctcgtgagacatgtttgaggagcttcaccgtgaatgtgtgggcttcgatttgacttgtggaacctgtggttaaaacaaaggaaggtgccttcattctcagaacccagtgctttttctgttgccctggccctctgggctgagtctttacgtggacggcggtcgatgcatctcagtttatttgtcaaaaccttcagctaaagccagttgttgcttgaaaactgcctgcttaattggcctcctcagctcgggggagcagcttgcaatctgaggccggcgcctggctccctgaccacccgctccccatcgtgctcagctctcattccagcagcccagcccataacccgcctcatcagtgtattgatgtgaggcagaaacacctcattgtaagagcacccctgagaaatggcggggttaggggcttctgggctgcataaccagcagattccctctgcaaaactgctcctgcctcagtgggaaagggccagctgtgcagggctgcactggagagccgttctcttcttgatcctcaggcatccagttcttaaaattccggccctctgtccttgcatggccttcgtcctctggaaaggagcatgctgggagctggcagaacgcacgcctcactctgtcgatgcagtgtctgtcactgctcagtttctaggtattgatcctagaaacccatgctctgtgggtccctctccaagaaacacagcatccatgatttgtacatcgcactgcagtttcagactgctttcacatgcgtggtttcatctctgactccacgacctgagcacagattttttttttttgagacgtagtcttgctctgtcgcccaggctggaatgcagtggtgcgatctcagctcactacagcctccgcctcccaggttccagcgattctcctgcctcagcctcccgagtagctgggactacaggcacgcaccaccacaccctgctaatttttgtattttttagtagagacaggatttcaccatattggccaggctggtctcgaactcctgaccttgtgacccgcctgtctcagcctcccaaagtgctgggattataggcatgagccaccacgcccagctgagcacagatttttaaaactttacctgggtccctgactagtaagagggagaacctggacttgaaacttagttttgtttcaaatcttgccccttttcctcgggttttgggcaaatacttcccgaagtattatcgttacccctgaatatccaaggcaggatcattttattcccttccagagccagcacttgcagaagtgtccccaagttaggcagcctggtgtggcttccggtaacactgccagcctcagagccggcctgtttcctccaggacgcccacaggaccctcggaagccccttcctctaggggcccgtccctcctccttccccaggccccgtcccccgccttgccctctgaaagtggtcttcagcaccacccgataagcagtgacttctcatcttagaagcctggcttgggtcaggttctgcgtttcggctgtgcgcgccccggagcagccctgcttgtgtcttatcatcgatgcctcagctgcagtgtgccccactgtaacccctccgggatgaaaacgcaacccacctcttcagtgggcagccctccacttggatcctcgcatccctggcatcatctccgtcctctgtccttgctgacccagctccaacccagcctgtctgacccgtagcccacctgccatgtccttcccggctgcagctcctgctgggctctgcagcccctcctgcccaacgccacctgcccccgcctgccctgctcctgcttgcccttcccctgcccctgcccccgcctgccctgcccccacctgccctgcccctttctcctcccactcccacatcccgggcctggacctgccatttcctagcagcaggagtcttttccctcgatcccacccttccccttcttccctcactgccctggacagttctgtctgctcatcagcgtaaagaggtctccaaaaagtacaagaccctccctctccccgctttccaagcaccctatggtgcctctcgctgctccttcaggaactgtgagcagggcacaaatacctagtgctcagcacccagtaggccctcacgactgtgccgagccatggccgtgtggctgtgattgtgctgacagcacacagtaggtcctcacgactgaggcgagtcatggccgcgtgactgtgaatgtgtagacaggcacagaatggcctgaagcgtgggaaggtcgcctgcctggcagcagctttagcaccaggaaacctcccaccttggggctgcccctgagggtgaacaagtggggccagtgggaagcacctgctcaagtgggactgtgcacacaaatcactgggaattactgcctcacacacgattggttttcagcattttgtaagtccaagcaaacccccaagaaaagcttgagcgggaccgggtctgcaccaacaggctggttctgagtgagtgctggatggatgtgctccagtgtggagggcagagggagggagcgggacccctggagaggagcggggtgcaggcaggggctgcagggcactccccagcaggtgcccggacgttgtgaaagaaaacgtctgggagctgctttcctctgggcgttcgtgggatccctccccttcttagccaaggaaagcatgtctgcaggcgccggctgcagctgtttttcaaatgaaaactgggcttgaaaggaggaaataattgaggtataagaagtccctgcccttattcgttcacgcaccatgagaagcttgtggcatctgcgggacactgcactcactgcctctcctctgtctctttctgtccagtcgtgccaagcggacctcgtgaaggacaacggccacaagtacttcctgtcggtcctggcggacccctacatgccagtaaggacggggcagcacgctctccacgggcttgggactcagcactcgcctctgcccacacgctgcactgcggtggggccttttgacgggggctacaggagaaaggtcaagggtcacagcaggggccacgtccacggggtcagcaactgcttcacgttagacatggccctttgcttactaccatgagcgcagctgttgtttcgtgtttgtctctaaacaagagctcagttaacccggacacatgggtggttttagtttattttagtctcttttcactgggacttctttgcaaaatagtcaaatccactctccctgctgtccgccgcgttagactagtgagcgccgcacgtctgtaatatgagagttcaggcgcctgggaaggtcttggagcacaagaagatatcgaagcaccccatttcaggaaggaagggagagaggaaaggaaggaaagaaggttgtttgaaagtttaaattttcagtatactttattgtattaaattgtttgaaaattagtaatccatgaatagggtgtatagttattctataaatgtttcataatgttttaatttctaactcccagcttagtaatgagaacaaaatagatatatcctaaataattctttaacataacttaatattgccagaatatttaaacatattagctagtttacacagtgttcggtggctttgctgtataaaggaacttttgtatgtaatttcaccccctagttggttttctaagctaaaggattttttaaaacacaaaacaaacaggactattttccaaaaggtaaacagtatatgcactttgtgttgtattgaaacatcacaggcagttaaagttgatactttgtatcagttttggaaaccatcacttcccattcttaagaataaggaagaaagcaaatcccacatgaagaagtgaggaagaatgctcactggcgacttgggcgcgagggtgagctaagctcacatgaacggccccacctcagccacgagcctgcggaagttttgaggacacagccaggtttgaaagaatgaaaaggaggctgggtatggtggctcacacctgtaatcccagcgctttgggaggccaaggctgacagactgcttgagctcgggagttcgagaccagcctgggcgacatggtgaaaccccgtttctaccaaaaatacaaaaaaatttgtctggcgttgtggcacacgcctgtggtctcagctactcaggaggctgcagtgggaggatcgcctgagcccggggaagtcaaggctgcaatgagctgtgactgtacaactgcactccagcctgagcaacagagtgagaccccgtctccactcaataaataaataatataaatattcttaaatgactgactagaaagaatttgctatgattctgtcaaaccatcaaccattgttttgtttcttcagtgctttgtgcctgttatgagaaaacattcagtgcttcctactcatcctcagaaacgattgatttttctaaactcataagcagatctgaaaaaacaaattgaagctgtgaaaaagaaaagacatgcactgttattgaaaactctggagatgaattaaatcacagaacagacagccaagaagagaattcatgaaggagccacctggagcgccgtccatgaagctaagcgagaagatatgaaagccgggctaagagccgggctgggaacgttcaccatgtagccagcatggttcagaatgagaggagaataagtagagaagcagtttttgattagatagtggctgagaattttccagatttgaagaaaggagagttccgattttaaaagcaggatgaatcctgagaaggttaaagagaaacaaattcgtacatagacgcatcataatgaaaacagcaaatatcgaaggcataaagacaaaccttaaaagtccccagaacaaacgttattagcaaaggaggagacagcaccggccccaacagcagacctctcatcagcagcggctctcggccggggacaggggagccctcggcgtgcgaggaaagcgaccacggtcgggtcacctgcacccagctcagtcaccactcaggaatgggggtgtagtaagcagcgttcagacaccaacagtttactccttccgaaccccacagaccatggctagaaagaccacatgtcagcgaggaggaaacggaaccaggaggggaaagcaagatgcaggacacggcaaaaagccaagaagttggcacacgtgttggcacatctatagatttgtaaaaatgaagaatactcatggcgaattggagggttaaacaagaggaggactcaggtaccctgggagccctgcaataatccaaggagccctgcaataatccaagaggcgcgtaggacactagaccgcgcgacgtgtgtgtaaaaaactaaggcaccgctaaaaagttacaaatagactctggtttccaggtcagcggaggcacagaggaaaggacagaatgaaaatgagtcacagtagagcagaaaggagaaaccagtgaaacctagagcgctgcctccatgccttttgctgccaaagcccctgattgcaggaccgtgtgctcacagagtgctgggcaggctggggaggtgaggtccgggtgcttcataccgacagccacggctggcctgtgacagaggaggcatccaccaggtctgtgcccgtcttgcagtgttagggcttccaaggagcagtctgttcactccgggaggcgagcctggagctctaaggcctttgaaaacagctgttcttttttgtagagtccacgtaaaatccaggagtaaagctggctctcgttactttaattatgcgccacgcgtgtcatgaagattccgaaaggatcacgctgttgtactttgggaatgagagtttccactgaggggagacgaccaggactggtttttgttttccaggctgaacaccggaccatgacggctttcattctcgccgtgatcgtcaacagctatcacacggggcaggtgagccccccagccacccccagccccagagctcacccttggcattgcagaggagctgggcccactgtgaaacgtggtgccacatgggggacagggggtgtccagcagaggctctgacccttcatctagccagccatttgcaggctgaatatgaatcagaggaatctaaaatggggaaaattgagcaaatcaaggcttcccaagaatgggtggccaccgttgtcccgtgcaggtacccaccacgtgcctgccattggcaggcagaggccaacctgtctgtggtcccgcctctgcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtgagtcaggcgggggctcagagtccagtcctcctggctgccgactgcgggggtaaggcagaggtctgctcgcgtgcgggtgtggccggccacgtgtccaggaacttcaggggctgcacgctaataagagtaggacagtgggaccttggtgagaagagaaccacaccactggggattttgcacccaggcccagagtgcgctcccggggacagtggcacagctgcaagcgggggtcccagagggaacctcagaggcaggggtcacgtgctcgctgtccgggtgccgctctgcgtcctcactgtggcctgcaaggcagggaccactagatctccactttacgggcaaggagacaggccagtggctcgtgcctggtgcagctgggaaaggtgcggggcactgcccacagagtggccgcgggctggaactctgggagtttcatgcaccattgccttcactcttcccaccggcctgtgcagtgcacagggtgttgctcatttttagagctgaggaagcagactcagggacagtgacttctccccaggaccacatggtgtcagaggcaagggctaagccagggtccccggaccccagggccagcacagtgtcgctcccctggctgagccctgtgtgctcagtgcacttcagggcccccatgcccctctgcgtccaggagtgcctgcgccctcccctctttccaccctcccacgctctgtggcccatcccagccccctcgtctaactcctgcctcgttcatcagcacattccctggtgcctggtttggtgtttcagttcccggggcaatgcagctcccgcctctgcagtctgagctgcccctggagctgggcggctgcccctgctgctccccacctccttccccgttgccactctggtagtgcgaggagagccttgggcctggagagctgttgagcaagcgcctgtggggttggattcacctgcacacacagccctggcagaaaggcaggctgcagcatggcccggtgtgggacatgcctgtgaccccccgccgccttgcaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggtgcgtgaacccccagcccggcagcagcagggcacccaggctggaccccgtgacatctggggccaagcccgcatggccctgaccacagcagggagcactcagtttccactgcgtgtcattgcgagagcagatctttacatgtttcattctcttcaagttgcatttctttaccagacacccatgggtttgcttcatttaaaggcatctagcaggctgcgcctcccggcagcttgtgtagtagtctccttcctgcctgggagcaacacacacaggcaccactgcgattccaaagagacgcagccacccacagatggcgggaaggtttgtgtgctgggtcccccccaacaccccatgtacgtcagcgactgaacaaaacagttttatgttttgttttgttttgtttttgtttttttgagatggagtctctctctgttgcccaggctggagtgcagtggcgtgatcttggctcactgcaagctccgcctcccgggttcatgccatctcctcctcagcctcccgagtaactgggactacaggtgcccgccaccacacccggctaattttttgtatttttagtagagatggggtttcactgtgttagccaggatggtctcgatctcctgacatcgtgatccacccacctcagtctcccaaagtgctgagattacaggcgtgagccaccgcgcccggccaaaacagttttataaacttgaaaacttacttacctgtttagatgtagaaatatcacagatgatcgtccaaggtttcacaccctcagattccccacccaccccagcgcaaaaggggcgtttaggaagacactggtttcctgatctcctttgctggtgagatggaaggctgctcttgcagagaactcatctgacagctggagcacagagctgctctatgggcagggagtgtgtctccccgtcaggtggcgttggctaccctcgtgcgttcccgtgctggctgtgtgtggctccctcttggagatgggctttatcatgagacgggccgtggtccaggggcctgggggttgtttgtctggagagcagctgccgctgctttacttgggagggacgtgacccggacaggtttccctcagccagacgaagtgtggaaagtcacgttctatcgtgtgtacccttctagaattagcccaagtcatgagtatgctacattttctaacgaaatcttgaaaataggaagtgaggttccgggctgccttttctgttggttctgactttgttgccatcacgttctcctcgtggccgggtttctgaacctggcttcttttggcccctgctgaattctttttcccacatcaactcacgtttggtggacatcactgatcaaagcagcaaatcagcggtttgtctgctaaaattctttttaaagtaaggaaagctttgtttcttctttacaaaaacgatatgaaaatagagaggacgttagctgtgaggcgttccccaagagccatcccgtggccgggctgtggccctgtggtgtggccctggctgctgaggcactgagacgaagctccccctccaccgggagcggtccggcgtcactcgcctgcacggctgcctgctgaacctgcatcctggagatgtggcccgcgaggacaccgtggggttcggaggaagtgctgccaaccgggacgcagctgtctcggggatgctgggcagggcgtgtagagggggatgacagcccctgccctccgggagcacgtggtctaatcaaagaggcagatacagataaggtcattacaccagagccttgtggagaaatactgcctggagtgctgtggagctcctgagggctgtgcctgtgcctgcatcggagcgggaagggtgtcagcagaggcttttgtggaggggcagctcttacctggttatggagggtgagcaggagaagcagccaacagagctgataacgccagctggcagggtgatgtctggagggaggaaggctagcgaggagtcagagaaagacaccgtcactcacctgtgaccaagcgggctgcactggcgcgcagactccggaggtgcgctggctctgaggggctgtgctgactctggggggtgccagctcggggggtgcgctggctctgagggggtgtgctgactctgaggggtgccacctcggggggtgcgctggctctgagggggtgtgctgactctggggggtgccagctcggggggtgtaccgactccgggggtgtgctgactcttggggggggtgctgactccaggggtgcgcctccatcctcgtcatagagtcctgccgcatcacagctggttttctcttctgtttactaaccaccatgggcaggcacggtgctctgcaggggacttgggcacaggtgcaagcaccaaggagcctggcggcgtggagccggccccattctcgcagcctcttctcaaggaccatcctgagcccgtcctgagcctgctgtggggctggggttggggagtagaactggctgagaggctcctggcaccctctggggtgggagagaggagggtgttactgctgcttttccataaaagcaacgtgtactggttaccaaaaaggttacatccatcctactttttaataataaaagtgtcctctcctgtgtggggtgataacgatggccgagtaggttttgtttgttgacttgtttaatgagcttacttgacaaaatttaaaagtcagcaaattcagcttagcccccaaattattttgaacttcaacctgtctttgaagtacaaaacctgcagtcagcagccacccgtcccttgtcaagaagggccaggccaggggtgcggggctagaacccccagtgtcaccccagcctctgcctgggccgggctgggcaggagccgcacacagggacgggctcagcggggcttggatgggggcttactccctccctgtcatggcctcgggaggaaataaggactgttcagatactattttattttatttgttttattttattttgaaacagagtctctgtcacccagattggaatacagtggcacaatctcggctcactgcaacctctgcctcccgggctcaagcgatcctcccacctcagcctcctgagtagctgggaccacaggcgcgtgccaccatgctgggctaatttttgtattttttgtagagatggggtctcgctgtgttgccccaggctggcctcaaattcctgggctcaagtgatccactctgtaatcccaggccttggtctcccaagatgcttcccaggacgctgctcgggcctgctgtggtcacaggagctgagttttatgatgcctgagcacaggtcacaagacaaatattagccagtgctgtgttgttggagcggagtgggtggccctcagggcaggtgggcaaggggtagaggcgaggtgggccagtagcccatggtcagtgcagccgtgtcaacactgggaagtgtgtgggcccccagcggggcaggacatgtgtccaagaaagatgtccttgagtcctggcaccagttcacggttagaaactaaccatgtgctacagacgacacccctgcagggagggctgcacccacccagaacacacttgtcaggcacgtgccacgtgccgggccggctggggcctcagtgaccccgcagggcactaaccctgcctcttctctcaagaaagttacccctggagctgggggaggggctgggtgtgagagtggtgggccggggtggcagctgagcagagccagtatggatggggctgggggcacagggaggccttgccacagggagaggcccagtgcaggggctgtgcccatcagagggcgtgggcacaagaggccaggagggcagtggggcaggtggcccagccaggcacaagccttgtcgttcgtgatcagaggcctggaggggtttgggggcaggacctcaccttcggctgcccaggtgagaggggccgctcgcccagctgcagggacggcgcaggagggaagaggcaccagcactttgaatgcggagctcacagcacttgctcacaggtggagagggtacgagaaaagaagaggacagggaatcctgggggtttgggtctgagcaacagaagagcagacttgcccctcgttgaaggggccagccatgaaggagcaggttccaggatcacgcatggactctgaaggtggggagccgacaggaagggctgagctgacaggtgaaagtatgagtccaggcaaagctgcctccctttcgaggaaggctgctcagccccagccagggagcaggaggacagacaatggctttgacaagcgaccggtcagaggacctgggaagcctggccagtgtggagcccgtggccactaatgtggcctcgccgtctgtgtgctgctggggagccctcagggggaaggggtcacatgacaacaccagccaagctcatcttgcaaaagctgagagagaggggagctcccacacccctggctgagcacctctgccagaccctctgatgggttctgcatgaatatcctaaagaaggccagtgcgtgtgtgtgttgctgtcagagcccagctccattcaggaagggcaggaagggtccaacgcaaaggagagctctttgctgtgtgccaggcagcagcctccagagcgaggcccccatctccagcaggatgtgcggcctccgagggaggcccccgtacgcagcaggatgtgcggcctccgagggaggcccccgtacgcagcaggatgtgcggcctccgagggaggcccccgtacgcagcaggatgtgcggcctccgagggaggcccccgtacgcagcaggatgtgtgttcgggagtgagggaggcccctgtatgcagcaggatgtgtgttcaggagtgagggatgtgcggcccccgagggaggccccgtgcgcagcaggatgtgtgttcgggagtgagtgctctctggacattccccttgaataacagacgtggcccctgttggcctcccctgaatcgaagggcccaccacctcggtgcacgttaatccatgccagctcccagctctggcttttctcacctgatgtcagaaggaaagggaaaaaaatcggtgctttctgaagacaggtgcagccttgatcttccctggaaggggcccagtgggtgttcgctttgtcggaggccccgtctcggcagtgcctcactcctcttgcacagggaaggcagcgggggttctgtggtttgccaggggagcctgggacagtgacttaggcagttggagacgagcgccagaaccggggcgtgggccatggccgtgaagacgcacactgggccatggcccttggtgcccagcagggtgggaggggcgggtggagggtgatgccagggctccattctgagcagtgagagacttgcagttccatcggcgcaaatcaagagggcgctgcaggctgaagggaaagtagacggtgcccgcagttcatagggcagggagagtttggggtgcaggtgaagagccggcagctggacagccagcctggacctaggagagtgaggggccggcatcagggaaaccacaaagcatgataggaggaagcccggggcatgtaaggctggggtgggaaagtgcgtgtacagagagtgcgtagacggagagtggggtggccacgagaagaccctggtccctggtgggcgcccatccagagcctgctcatccagccgctgtggagacaggggcgtcacgcgactagcaaggggtcctctcacagcgcttggctttctgctaagaatccgtattttttcttttcagaaaaaaaaaaggcagaaaaagttgtcgtagggaaaaaaacgttctttccgctttttaaacctacatcccccttctgttccccagtgacttctaggatctccagctgttcctgtcacagcactgaactgtcctaaaagagaggcaaattgtgtctgttcccttggaccaaggcatttggtcctaaagatgatgttttagttctacaacttttcccgttccctcttagggactagaaacatctaccaatgaaagtttcacatgtgttgaaaagagcaggcttcggcttgtccgctgcactcggccctggggcgctcagattcagaaaggccgccagccattgggtgtgatctagagcggcgttttcagccagggtcccagtggtgaccgtaagtgagaggctgtgaggcctcctacctttccctctctggagtcctgtgactcaccgtgtccttacgagacccccgatgcgtcgtgcgcctctagcagtggggaggattctggcaggcattctgggcttcccccgtgagccagtggcctgccgtctcccagcactctgctattccaaggcctctgctctgacggttcgaaaagggatggtccctgtttctgatgccaattgcacggttttgtcttaacctttcttttttctgttggtgactcaagtctcactgctgctccacaatcattttccagccccagtgactgttattgtcccttctccctctcggcaggagctggtggtggctctgagtcatcttgtggttcagtatgaaagcaatttctgcaccgtggccctgcagttcatagaagaggaaaagaactacgccttgccttctccagcaaccacaggtatggcgtcttctcctgtgaacccgcagagcacctcgcctggcggttctagtgcaggccgcggcccagtcttgctcaccctcgcagagtctaagcgcaggtttctcagatacctgccgcaaggggtccctgtttttctcatctttttaggcacctgccagatttaaaagggcaggaaagagggccacactgaccctcttacatttttcctttctttttaccctttttggaaattaaactcacagagaccttgaagtatgacaaaacttctgcagtaggagcttgcggaaaagcgcaggggccgtcttcctgcgatgagtaatttcatcacactgctcttggctccgtggctcggtgagtcatgtcaggcgtgctttctcacacgtgtcgttttgactggagagtacagttcctatctcatcgctgccggcagcccctcccgcttccacacagccgtctctgccgtgcaggggcttgtcatcagcagtgaggcctcactgcttctaggaagcccaggaggggagaagggtgagccagactgagtgtggacggtcattgctctgctgcggcttcccggggagcacggctcacggcccacgtcaccatgcacctcgtgtgcactcggacaggccgcagccaccagcctctcccctgttgtcttttgtaatttaatatgcacagagccacaagcggttgttgtttgtccagtgctatcccgcagagcctccgctcacgtctgagtctccctgagctgtgcagcccctgctctgacatttgttgcagcacaggtagcagctgccgtcaccgagtgtcccagctgctgagtgtcagaagacacgctggcctccacctggaagcccattgtaatttgtctttctccttctttcccagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatgtaagatcctggaaatcgggttattggattgggagagattggggttgttttttctgaaacactgtatctgagtaagcaccactctgcccctgccccttcgtctaagtgcgtgccctgaagtcccatctgccaacatggtgatgagtcacccttccagacgtgagcatggcaaggaggcgtaggccagcccccagaatagccagcgggcccgttaccaatgcggcagggagctcaagcgcagccgcagttgaggcggtggctccttggagggctgtgccctgcccccgtctcccagtaacctgtggtctgcgggtggggagcttggctcccagggagatcagtgagtgcctgtgcctgtgtgtgcgccggggcgtgtgtgccagggtgtgtgcgccagggtgcgtgtgtaccagggtgtgtgtgcgccgggtgtgtgtgtgcgccaggtgtgtgcgcgcgccaggtgtgtgtgcgccagggtgtgtgtgtgctgggtgtgtgtgcacaagggtgtgtgcatgccagggtgtgtgtgtgtgtgtacaagggtgtgtgtgtgccagggtgtgtgtactgggtgtgtatacgcgccaggttgtgtctgtacgcgccagggtgtgtgcgccagggtgtgtgtgtatgagggtgtgtgtatgtcgggtgtgtgtacatgccagggtgtgtgcgcaccagggtgtgtgtgtaccagggtgtgtttgtgcctgggtgtgctgagctttatttagaagaaaatatgtatctcagtcatgccattaactgtaagaccaaaaggagggtcccgggagcaccccactgaccccgttgcgtctcgggcagctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggtgagtccgcctgcccctttctgcttccgaggggccccgagggtctcctccccacacagagcagcacagacctgtgtctgcatcaggtcagtgggtgtcaaaactgtctgttcaaaagaaagaataaaggtcaacaggactgcgaggcagggagaacgttttgctggggcaagcgggaaagttgacatcactgttgtgttggggtagtattttacaggctgctccggagccatcggagctggccagtttggctgggtgggaaggctgccagaaccttccatctttgttccatagacgggtgagagttcttcatggtgctggacaccctggtgatgcagaacggtggttctcagccgggggtggttttgccccccacgagcaactggggtacagtaggggtgctccttgtcccagtgggtgaggccaggaagctgctcacatcccctggtgcccaggacagcccccacacagtgtccgcagtgagaggcggagggccctgcggtcgggctgggggctgtcatccccgccctgctcacctgcggaatctccacacaactttccctccatcccagcagcttgacgcagcactgcctggaaatggaaatctgacggaagggtcagattcttctcttgttctgccatgaatggtgtgtgcctgggtcctaccaccaggattgctgttgtaaaacaggagaagcaggaattcaccgtgttttcttattgtgtagctatgttcatcttcacactgctggtaacagatttagggcttaaccaaacgagcctcctctcctcttgttctgactatccagagtggcttaccggcttcacttgaatttttttcatgttaaggagcattttagccatgtaaaaatttacagagacttatataagagcgctgcgtgtgtgtgtgtgtgtgttgtgttcccagcttaaggaattacagaggtcgagccccagaccctaccccggtcccattccctctggtgacattacactttccctccctggccatgagccctggcacacacgtggtgcccacttagaggcctttacctcctattggcgccgtcgcacgatgcgtggcccgcaaagcccgtttctttggctctgacttcaatatgtatctttgatggtcatctaggttttgttccttcacctccgcgatctgccgtgactccattatccattctcctgtctggggacagtgaggccggttctagtttcttcttgccttttgttccttttcttaataagcaaactcagaattcagcccctgccaccatggagccccacatccaacacaccctcactcgctgcacccagctctgctgggccccggcctacccggcccccagcctgggcatcggtggggaagctcttctccggcatatggtggccgctcccctctcattcagagcccccatctggcagcaccttcccagaagcctccccagccccacgccccacctggaatcaggcttccccagctgccctctgaccctgctcccttttcctgctttatttttctcctgaggactgtggactgcagacgtgctgtacgtgtaacttgttcattggcccggcccatctctctcccctggagcttgagagccgcacgtgcaggaacccagccttgttaaccactgtctcctcccaccctgtccacacccagtgcctggtacgcagtaggtgctcaatacacataaacaggcacgtgtgtggtgcgtgttcttcagcgtggatacacatgagtgcctctcgccaccttgcctcagagtgaagctgctgcgtgaacggtgcctgcaccttcagcttttgtagatgtcaccccaggccttccacgggatcctctgttctaaagcgcaggcgcccccatctcgccactctctaccacgccggtcttggccagcctttgtctgtctgatagacacacctggtgtctccttgtggcatgaatttgcatctgccttgattgcagtgaggttacagccttgcagccttacagactcgccttgtgtcgtttgtctttctctgagtagtttgtaatcagcgttcatcacagttctgggtgctgattcctggctgaatatatccatcgaaaatgcatctaatctatgactttttatgatgcctttggtgccacacaagcttaatcttttagtttctctttttctttataacttgggccttttgtgtcttgtttttccttttctcaatgtcctaaacatattctcctacattttcttccaagatttaaaattttccttttttgtgttcatgtcttaagtatatcctgaaccacattttgtctctgtggtgaggtgggaatccaggttttattttttctttatgccaccccagacccttcatcagacagcccgtcctcccaccagtgcttctcagcgtctccctggccatcagtccttagggtctgagtgggggctccattctcagcagcacccatcccatccacggccgcgccgacaccccacacggccgccccgacaccccacacggccgcgccgacaccccacacggcctcactgacaccccacggccgcagcaacaccccacacggcctcgccacggccgcgctgacaccccacacggccgcaccgacaccccgcatagccaccccggcaccccacggccgcgccgacaccccacacggccgcgccgtcacaccacagctgcgggggcagcacctttgagcccgctcctcagttcgtttctcagaactgtcttggccgctcttagccctttgctctgctgtatacatttcacagtcaggctttctgtgtcgacagcagcctcactggggtgttgtttgaatggcgctgaattggtggatttccctgggatgactgacttccttgcatcatgagtcttcctgctcctgaacagggtgtatctttccatttactcaagtcttctttatgtcttcaagacagtctgactttctgcataaaggtcacaggcatgacgttacctttcattttttgtaattttaagtaatatcttttttaaaacctgttgctggcaaaaaaagaaagaatgccagtgggctgggcacggtccctcacgcctgtaatcccagcactttgggaggcggaggccgagacgggcggatcacgaggtcaggagatcaagaccatcccagccaacatggtgaaaccctgtctctactaaaaaaaaaattagccaggtgtggtggtgcgcacctgtagtcccagctactggaggagaatcacttgaaccggggaggcggaggttgcagtgagcggagatcacaccactgcactccagcctggcaacagagcaagactccatctcaaaaaaaaaaaaagaatggcagtggacatctgtgtttctctcttgagagtaaacgaaacctttctaaccttttacctttgatacgacatttgctgtagattttttgagtgggtgctctatatcagtttatagaaattcccttccctttggttcactctttttatgagtgcaaattcccgttctattctagttagttaagaattttcctgataaatggaattaatttctttgaatgtattttctgcatctcagaatgaccctgtgcatggctgtttgttagggtagggaattacatgattgaattttttgtgaaatatccttgcatttctgggggcacccagcgtggtaatgtcccctgacatcgctgccttacgctcaccagctatttctttgggcgctccccattggcattcacgagtgggttgggctgtgacttttcttgtcctgacctggctggtttagacattgagtctgtacctgcctagtaaaactggctcctccgggcatggtgacaggtgcctgtaatcccagctactcgggaggctgaggcaggagagttgcttgaattcgggcagcagaggttgcagtgagccaagatcacgccactgcactccagcctgggtaatagagtgagactccatctcaaaacaaaaacaaaacaaaacaaaacaaaactggctcatgagtgtaccctcattccctgtccaaaaaaactggctcaagagtgcgccgtcattccctgtcctcgggggcaatttttataagacaaagatgatgtgttctttcggtgtctgagtagaatttgcccctgaactgtctgggctagtgtagtgttgtgagggtgggtttgaattctgtattccatttctttaatgctgataggattatttacattctctatttcttcataagctagcttcaaaaagttttattcttctaggatcttattcatttcagctaagtattctcattctttcccttgaggctgtctgcagtattctcatgagtctctaatctctgctgtctctttattgttttagctgctcttactgtcattcccaatctgctgcctctttagatatgtccccgtttattcctattgttgtttatttgccttttcccctttttcctgattaatcctctaagatgtttgttcatttctttagtgtcttcaagttctaacttttaggctttgtggatttactgcattattttatctttatttttctattccagtactttattttgtttcctttctactgttttctctaggttcactctcttgtcctgttacagttctcaaacagaaaataaaaacagctcattaactttgagtttttcttccttcctaatgtgtgtgttcaggtctgcgggacccctgccccggctccccccaacccctgcccccgctcccccccccgctccccccaccccccgccgccccgactccccccgccccggctccccccgcacctgctcacccaacccctgctcaccccgcccctgctcaccccgccgtctccgtctagtgagttttgatgatgggcttttcacttgtgttcagcttcaagctttctttctacttccattgtggttcctggggatggcggtccagccacaatgacagcagcgcatgacaggagcccaaagacccgaaacagacgcagggcatccgccaaggcagttcccaccgggcaaccctgtgggtgtgctcccagccttggccagctgctgccttgagcacctctggatagaacgagtccagagcttgcaccatgccctccagggtatggagaactgaaaggttcactacacaacaacccagacacgccagcttagcccagacacgccaacttgttaattttcattgagaaataacgttgcagctttgtgcatttggctgtccactaaaatatgccaagtgcccagaaagcgcagagttgactccgtatattcgagtataaatcaaggtattgccaagtcaccaatgaaatatattctaacgtcacttgtaagatgtttgttttgaactggaatacactttttaaatagaattaatgttacatatagtggttaggtttccaggctagcctgcaagagtcttttaaaacctgtctgcagaaattctacttataaatctacaatgaaaaaaggtattttaaaatttttttttaagtactagaaaatgtaaattcatagtattctgttttgattacacatttcccctggccccggccacagctcctgtgagtagctctctagcgcctccagcaggttagtgccacctctgccccagttcacgctcatcaaggtcaaggtgatagctcccttccgtcacgtgtaggttagagcaggagtctgcaaactcttcctgtgaaagagctttgcaggtgggactgccccttggcacttccccagcactgccattgtggtgcaaaagtagccagagaccgcgtgtaggtgaatgaacttggccatgttgctatgtaaccgtgtggactgaagtttgaattttgcgtaacttcacatcacaaaatattgttcctttgatttttttttcaaccacttaaaaagtataagaaccatacacaggccatagaaaaacaaggctgagttcagctcagagagcctgacagtagggcacaccctgcccgcaccctggcctccaaggacactcctgtgagtcagagggcttgggattcttccacggattggacagatattttgacagtgcccccactgtgcatgctggggcacaaaagtacagaacaggcaaacccaatgccacctgtgtcgaagccagtaccatcggctctgggcatctcccacccctccctgcagaagtgggcgtcctccctctgcagccaaggggaccggcgtttactcaggttgactcctggccaggagtcggggactcctctttgtgccccaacacatccttctctcagccgggcatctgtggccgtctcctccccgcctcgcagccacctgggccagcagctctggcctggtggtcgcagctctctcccgggtctccctgcttccactgtggccctcctggggccgtgtgctcactgtggccttccttttttttttgagatggagttttcctcttgtcaccccagctagggtttaatggcgcgatctctgctcactgcctcccgggttcaagcaattctcctgcctcaccctcccaagtagctgggattacaggcgcatgccaccacacctggctaattttgtacttttagtagagacaaagtttctccaagttggtcaggctggtctcgaacttccaacctcgggtgatctgcgcgcctcggcctcccaaagtgctgggattacaggcatgagccactgtgctcgactggccttcttctttcacaggaagcgacagcagcatcacccctcggtgctcacctggtgaccgtctgccaagggcctggtggccccgccaccctacctggcccatgctccatggggttctcggttcactctcgtccctccactcacacgtatctggccatcaagtaagaatcaaaataaaaagttgcacctggcctgcaagtgtgcagaaccgcaccttttgttgatccaggaagctcaagccaggcagtgtggcgctaggtcaccatggcaccattgagagcttccgtctgcaggtccccacgcccacagcacctccctttccccctgggcatttggataccacgtgggcatctccccttctgctggcgaaggctacagaaagttgacagctgtggagtttccaggtggctgaacttgctgaggctgctgtttgctgtgcgcgtgccatgcctgaggccctgggtgctgtccacaggcaagagggactgcggaggccccgcccaactcctgtgtgaaacttagctcttgtctgtgatgagtgaatgccgttgttatcctcggtactggtctcggtggagtacagggcgaagaatcgcagtttcatttgagggccacccagacgggaagcacacagcagcctggggcccggacacaggggcttggcctccatgagttttctcctctgccggttctttcttttctgtcttctcgaaggagctggactccccattccaccatccttcttatacaatgtgattcctgactttcttttttttactggagaaaactgagttttattcgtatatcattcaaatcttaggaaatttgacaggaaagagtttcacaatgagctggagtttaggaaggaaagaaaacaaagtcgcccccgcaaagccagcctcattcatattcagtgaggtgtcactcacaccacctggaaaccaccgtgcttacctaagtgtttagaagtcataacttacacagaatcccattgtgcacagcacttccctgtttccagccaatttcttctttcatttcagccaaagaacagcaatctctttagtcctttcagtgaagattgcagaggctttcagaaccatggcaacctggagagtccatgtctccccatctttcctggtgccccagaagccctgccccagcgcctccccatctttcctggccccccagaagccccacccccagcaccctccctgctctgccttccccagagcacttgcattcttacaccctcaatcacgtgtttcctttcttccccgtggcaatgaagccccttggctggtacttggcttcctttgatcgctgatggagcccaggttcccccagcagtgcctggccctggtggggcaggataaatgtttgtgaaactaaatgggaacccaggtctcagcactgtgtcaggttctagaatcttctttgatgtctccatcctgcttgtttctcactcagcccttcgtctggcctgacatccacaagaatcccctacctcaatccctcctatttccagtgcccccatcccaccaggcctcgttgccctgggtcttgctctctgcagaccacaactgggcaggccctctttcacaccagctcctcaccaccctccaggtgaagccttcgttaaaaccgcattttctgtagaggccaaaccattgtctgacattcaaggccttccttcagcctcctgccccccgtctcagcagcagccgctccactgcacctgcccgcagcacccctggctggcccctggcccggcccctctgccatccgtgcagctcagagccaggtggtcttgctgggaggttgcctggcccaccgccaggatccccatgtaggtgcctgacccagtacatcaaagcatgatgtcgccatttttaccaccacagtcctataaagttgtttcttgctaacgcatggatgtgtggacacaggcctcacctgtcccggcccccagcccatgcgtctgccctctgcacttatctgtgttcctgacggccacaagtggccgtggagctgctcaggatggaaggatggctggagacggtctgtggcctgtgtccacatgtcccgggacccagcctgaggtgccctcctcacccccagacacccatgcatgtggccccacaccatgtcactcccacgctcatccgtccagccccagctcccagctagagtgcagtcccatgggggaccacgctgctgtgtgctccacccgccttccctcccgaaaccctgcgtctcggccagagtccaagcacacccgtgctgagaggcgaggcgggagttaattctgctcgggactctggtggcctgagaaggctcttcccgcagaaacagcctcatcccgagagcgctggcaggaacgcagatcagaggcctgggctagatgggaccagttttcacgactctgctagatacggtgacattttttacggttttgaaaatgagttaccatagaaatggatccaggatggactaatgcaagggaggggagggcgagaaaggaacacagccctgcggagcctggagccggccctggtgcagctgtggcaagcgccctgctcacccagaggaggagctgggggccctggccagcggcagagccagaagccccgcaggccgcctgtgctctccacacctgaacacgggattctgcgggagagctggtgtcaagtcctgacccctctacttcgttccgaatctgggagccagaactactgcctttggaggaaagaggagcccggagacccgagcccagaaactggggcactgcccggctcctgggaggccacagaacagtggcggcccctgcaccccaggcctgcccaggcctctcagccgcacacattgcggccggctgcactgcggcatcattggtgttcacaggacgggccatagcaactgcttctcccttggtttattttttaatgtttcttaaagacggggtttcgctgtgttgcccaggctggcctcgaactcttgggctcaagcaatcctcccacctcaccttcttgggtacctagaactacagtttccttccttttttccaaggcatcgagaagctgaaagagtccttacaagccccgcgtgcagctccagagacccccagtagtgagttccggccaggcctcgaggtctgggtttcagggcagagaaggtattggtttctgcctttgcagaaaaaaagcctggtgctcgctcaaccaaaagaaaagctaggcagggtttttgccaaaggaactgtgtaggtttggaaggaaaaggcttcacaacccagaaactggagttactcttgtcagaagacagtggtgagaaaatgaacaacagttttccaatgctacaggattatgtttttagggcaaaagtccttaactaaaggccattatgatgtttgtctcgtaggggtactgaatatgctgagaaaacgatgcagacgcaccgcccacccggcccgggaggtgctgcgtcttccctgtgggcagctgcagggcccacggctccggccggcccaggaggagggagggcggagcggctggtcagcgtgattctcgtaacagccacaccgagttgtgggtgcagcccctgaggggtcaggaggggtcacaggaaaggggccgctgcggaagccctcggcctggggcactggttccccaggatggcagagggtcttggccatcacagactgggtgagcacatcagagggcgtaacccgctctgccaacccctcagccttggggtggcggctggcagctgtcacctgcaggaagactctgtcttctctgaactgctccgacagccggggagcttctgggattcagagtcagccagagctctgagtaaatttccccgccgtgtatgctatttggaaagctgtggccattgggctctgaacaataacttctaaaaccattcattatgatcttttattacttttagtctagacatgaaaataggttctccgtgcttacagggagttctgtgagtgccagcaggggccctttctaagctcaacatccccggtccctgactccctgccgggcaggacccaggcagccccacctccttcctggtggactcgaatccgatgggaagttctctgcggtctgttttggggactggcagattttacaacaggacagttcatacaacggagcctgagagaagattgtggccaaaccagggaaagacgtgaaataaagacagcagttccgtgatcacagcgtcatactttttactagtacatagttataaaatccactgtcactaaaaagactggcaaaaattagatttttttttcccctgttgagtcgcaaacagtatttcgactttgatataagtggaagtctgcacgaaggtcgacaacaatagcgttggccctcggtacgcgtgggggactcaagggcccagggcccacgacgctcagtcctgctaggaaaggcgtgacagctgtgcatcccccacacacatcccccatcgtgcttgcatcttctctagtttccttataataccaaacccagcacagtgtgtcaacagtggttatgctctcttgtttttttttatgtgtattactttttgttttgttttcaaatattttcgatctgcggttggttgaatccatggatgtagagggccaactgtaataaaaatctgtttttaaaaattagatgaaagtggccaggcgcagtggcgcatgccggtaatcccagcactttgggaggccaaggcaggtggatcacgaggtcaggagatcaagaccatcctgcctaacacggtgaaacccgtctctactaaaaatacaaaaaaaaaaaaaaaaattagctgggcgtggtggtgggcacctgtagtcccagctcctcaggaggctaaggcaggagaatggcatgaacccaggaggcagagcttgcagtgagccgggatcgcgctgctgcactccagcctgggcgacagagcgagactctgtctcaaaaaaaaaaaaaaaaagttagatgaaagtagcagctaatacatctcacacacacccccaccccgccctgcacattgccagggtccttacctggagtgtcctgtggagccctgacctagaccccgggtgtccgcgtctgtggcccccacattgtgggtgaggcttgagcagccaccagcctgcaccctcctcgcagtctgccagggccgccgggagtggggggcctcctgccgtgcctgccctgggttccgggcttgcccagtgccctattcttcacagtggcctggtcctcacccccgggtcttgtgaggagggttctcatataaggccagctgcccctcacagccccttcacggggcagtcgagcctcgtggggagctgcttcaatgcctcactcagctgtggggagcccaggaccccagaataatcaaggggagtgggtctcaggtgggcagtcatcaacgggcatcttacggggccatcctgtcacccatgttagagagtgtcgtggagctaggcggtagcgaacttcgccagtgaggccgcatctcctcctcaccagggcctgtcgcgggagggaattcaaagccaaatctcctagcccacccacccactctaaaaaaaaaaaatgaggacgcagccatcgccgatgtccttgtgttgcacggagcagttcctaggagccggctccgctggggtagaggagactctagggatgttcctacagtctggaccgattttacatttccgagacttgcttgtggatctacacggctatcgcagagctgtgcaatctgagagctggaaggcttcggttctgtcccagtacacgcggtgcaggaccacggttgagcagaaggtgcatctgcgtggcaccgtggcgctgaagtccaggtgtgcttgggccctaggctcccaagacgttcccactgcctcctcctgggcacaaggctcaagcacagggaccgccggccaggcacacatgtgcatgggcaagacccgcaggggacgtgtccctgggaagaatgcttcctttggttgaaggctgtaaactcgccctgtgaggtgagacatgtcagctcccagaaaaggtcccagcctctcatgattcacgccagcacaggcagcacagcagcagagcgtgacctcctagatggcagcgtgacctcctagatggcagcgtgacctcctagatggcagctgagctcaattccacacggctcagtcctggagacaatcactcactgcaacacgcattcctcatgggggcctcttcaggagccacgggcatggggcttccctgacctctgcactcacggtgggggcgcgcacagcaggggtagacactggcccgccatatctggagctgaagtagagcccgtcttgggctcgcttagcggagaccataggtggaggtgagccagtggcctcaggcatctgcagaacccacgcacacattgactttcgcacccgcctccatctccgtggacttgactgtgtcgtgcaaaacccactccacgtgcgcagctgtgttcctgcagtgacacgaggccctccactggctttcgatgcttcagctctttcaccaacaatcaggtggactggaatcacacctcactcgaaaccctttgaatctctatttagtgaacaagcacttgcttctcagcaaattgtctagcttccccaaaaataaagaagatggagttctgtgtggctggatcccttttcagctcccagcactgagggcagggccctgtctgcctccgcctctgggttgaagcctggcagtaaactggcactcctggtgcccgcaggcaggggaggcagcgcctggccccgctctgccctccacgctcagcgcctctggtcctcggcccagcccttgctggacatgcagcctctaccaggattgctgcttcccttctcggcctctctgggtccagcgtagcgtggacaacagttcggcaatgcctgctccatcagcctcctccctggcctcagccaatgctgactgtgccaggagcccacatagcccgtgcctgcccccccttctggtttccaagtgctcacagcctccaccccacaatctctgattggctcctgcaggcttccgtcaggtatcccccaaggctccgcgtccccatcacctccgtgttttattgttcaatgtcttagatcttgtttgtgctaccccctctcgctccacccctcctttgcccagagaatgatcctccttcccttcaaagcccagctccttcgtgcctcttccaccaggccttcctggccttcacttcctagcccactgctgacagaaggagtcactctcgctccttcctgcatctccctgaggccgcacgctgtcgtggacgtagcatggctcaaaggtttgatgggtgtgcgttcacatccttcatcctctgggcctcaccttccttggcgacgctgggggtaacacctgcctgtaggattgctggggaattaaataggaccgagcagccgcaccgacgaatcctcaccgacgaagcctcagcgcttccctccatgcccacgactcaccagtgttatttataaatgagtctgagtccctgctgggtcctgccttgtctgtctttgtatccgagtatgcagcacagaaccttgcattgagtgttgggtgagtcgggagaggcttagggacaaaagtcacagcacatcaacctttcgtgaagtcctagcatctcagagcagggccagtgcctggaggtggacaggaagcacgtggaggtgggcaggaagcactccctgggtcacagtgcacagcagcacgtgctgaacttggtgcagtgcagacgtccatgccacatgcaccactacccatgggctgcggcagctcctagaaatctaggatgtgacatcagacgctcctccgggagtgtggtcatgccctccgatccgctgaggcatttcaaggaaagttacaccctttccaacgcagttttccttttagaaagatttggcctcagtagatgaatccatgtgatcaagcctagtgatcagctaggattcttgaatctcgggacccgttgccagaataacaaaatgggggcttcctgtaacctcggctctttaaagcaacacttctgataccagggttagggtttcagaaaatgcagccgccttaggagcctcattggcagctactttccactaaaacatcttccatttctctctctcaggagtttcctttaacagtgtttacactcagatttggagagtcctgctgcacctggctgctgacccctatccagaggtctcggacgtggccatgaaagtactcaacagcatcgcctacaaggtacgtgccgggcgctccccaccgcgctccagctgctggttctcggttacgagtatgcatgccaggaactccaggtgtgcccgggtccacaccacggtttagaaagtaacaaaacgagcttcagcaaatatcttaaatctggagatgtacacagtacaccccaaactgtgtctgtgcagctcccacgtgggcagagggtgctggatttactgatgcctgtcaaggcaattaggggaggactgccattatctttcaggatcctctggtgtctgggtgagctacagtgctggcccttcttccatttttttttttctttctttacttaattatttataagagatggggtctccctgtgttgcccaggctggtcttgaactcctgggctcaagggatcctcctgcctcagcctcccaaagtgctgggattacaagcgtgcgccactgcacctgttttttgtttttgtaagacagtctcactctgtccagactagaatgcagtgacctgatcacggctcactgtagcctccaactcctgggctcaagcaatcctcccacctcagccttggaagtagctgggactacaggtgcacaccaccacacccggctaatttttaaattttttgtagagacagagtctcagtgtgtcgcccaagctggtctctaactcctcagttcaagtgatcctcctgccttggcctcctgaagtgctgggattacaggcatgagccaccacacccagacttttcttccctttctgatagcagtaatttttgactcattcaaaacccttctagttaatggtttcttattcatggccattctagctcaagggaacttttcaaagaatcagtttttggtttcattggtttttctctgttgtttgtccattttccatttgattgattgagctttcatcaataaagcttgctttcttctgcttactttgagtttaatttgctcttctcatcctagtttcttaaggtagaagcagaggtcattgattttagtcctttctctttggggactgtaaactcttctcagtcccttttgtgagctctgggcatttggcctaccgccttcccgctgttttttctctgcctcatgggttgtcactctacccttgagcagatgaatacttagtcaaagaccccaggggcctctcctgcagaccttggaagctttcccctctccagtgctctgtcctgcaaattgtcaccacctcagcctccctggagccccagtctctgtctcctgttccctgaaagtgctgggctccccgtctctgcactgtggcctgggactgcctgaaactacctgcaagccggacacagggcagctgtttatttccgttctctcagggatcacaggcccgtgacacccagcacccagtgtccaaaaacaattgtttacggtatttgtcctggttttctagttgcttatggaagttggatgatttatgtggaattagaagtcactcattatagcacttaaaaattttttggtaactttttgataaaacttcaaaagcttacagaaatgttgcaggaagaatgcagggaaaggccacactcttgcagcctctgtggtgttctacgtcttcatctgacctcgtcacggctatggcgttgcctcgggtatcactcagtgccagggtctgcagggtcgaggagccacggcttcccatcctagtccatcgctttttccaaatgagctatcgactctccccctctcatttgctgtggccttctgggtcctggccggccatcgagccagggttcctgcagctcctcagctccttttgctgatattatacttctgtggctttcggttccttcaactaagttattttctgttggtctagttatatcttagatggaaatcaccttaccgtctgcagttggttcttcttcagttcttttttttttttttctcttgctctgttgccaggctggagtgcagtggcgcaatctcagctcactgcagcctccgcctcccaggttcaagcagttctgctgcctcagcctcccaagtagctgggactacaggcgtgagccaccacacccggctaatttttgtatttttaggagagacgaggggtttcaccgtgttggccaggatggtctcggtctcttgacctcgtgatccgcctgcctcggcctcccaaagtgctgggattacaggcgtgagccactgcgcctggcctgttctttatagtatcacaggtatagtcacaagtagcctattggccaacttggaaaggtccagattgtttaattctgcaccggcctcccctcctgcagcggactctgccacttccttcgtcaccgcatccctgcagcggattctgccacctccttcgtcaccgtgtggtgtggccagctgcacgggcacctggagacgttcatccccaggcagcaggccatctcctcaggtttcttttatgtgctactggcctgttgaaaatagccagtcaattaagttaatgttttcattatgcggtaagaaaactaagaaataatataattatttgcttttaaactaggaataagataaatacaaaaataaacctcaggctgggtgtggtggctcacacctgtaatcccagcactttgggaggccaaggcgagagacgatcacttgagcccaggtgttttgagaccagcctgggaaacatagtgaaaccccgtctctacaaaatagtagcaagttagccgggcacggtggcaagcacttgtggtcgcagctacccaggaggatgaggctggaagatcccttgagcccaggagctcaaggctgcagtgagctatgattgtgccactgcacttcatcctgggcggcagagtgagaccgtgtcttttaaaataatgtttaaaaatatatgtttgttacacattatggtctgagaccaagaaggggaggcagtaaagcagacaggaaggaaataaggaagaaaagaaagtcgtaagactgcacaaacacccctgaggaaaccacccacggaggccccagaccagagcaaccggtcccgaggcctctcagatgagctgacgctctggaggattgggactgaaaccgtcacatctgcctgctacggattagggaaaatcagttcttaccacttaccactgcccttttagactctaaatagcctctaccacttttagtttaagatttcgaggttgggttttaaatagccgttttcactaaaataattgtaaaagctttttacgaacattaataaatggtttaagtttttagaattgatggccagttcgcgtctctgctggcagttctctgacacacaggagtgtctggtggcctcttcttttctcttggaggcacaggatggctgtggccatggaccacccttgctctgtcctgactgcacagttggaggccagcgctatttaggaggtttgatcgttttcccccaattaatttagcttcttgggtattttgatcatgatgaaatcagtattcagcctatttaagtttatttttcagtggcttttgtgtatttaaccttactgaaaaattagcctgaattattttaaactgtaatccgagtgcctaatcttgaaatataaggactattaagtgcgttcctgtggacctggcctccagttgttaaatagctcctcttgggaagctctcgagcctgtgtagcacagaagccactgctctctgctcttcagcaaacgtcccagcacagcctccacagcccagcgcccttttggattgtgtgtgacatgtagtgtagctggacggcccgcccccctctcccaccacggtaaggcagttaagcacctgcgtctgcctttcatgttagcaggttatagcaactcgaacacacggctttgtcgtgctatccgattgagacccagaaaccgccataaaagtggcatttgccttctgtgcctgctttgccgttctagaatgacacagagaccttaaggcacatggccatcactccagcagacatgccacagccagaggggtggagaaggtcaagagaaggcctctgctagagaccttgctatgcatagcacaatgcagcatgagcttgtgtgtgtgtgtctgtgtgcgtgtgtgtgcacgcgtgtgtgtgtgtctgagtgtatatgtgtgtgggtttaagagtaaacattgctactaaagcatttggaagcataaatctttcttgtcttcattttaatttcaagaaatgccttattttcctgctctaggaactgaagggattacatttcattttacagagaaacgagcctattttagatatttaactctgaagccaaatttttgttcatcagagtctaaaacagccttattactatggaatgccctgtagaattctatattcaaatacagaaattgccaccagctctgtatgagagaacccacacagctccagagctgtggtctgatttcatgtatttataatatatttcgattcccattccatgggcttggggttttcattttgcttttagctcccttttctcttggtttagttttgggggtgttgtttgtttgttttgttttgagacagggtctcactctatcacccaggctggagttcagtgatccagtcacggctcactgcagcctcgacctcctgggctcaagcgatcctcccacctcagcctcccaagtagctgggactacaggggcgcaccaccatgcctagctaattttcgtattttttgtagagatggggtttcaccatgttgcccaggctggtctcaaactcctaggctcaagtgattcacccacatttccctcccaaaatgccaggattacaggcatgagccactgcacctggcctgcttttaggtttttttaaggaaaatttcagactatgtagaagtagaaagaagagactgatgcccctcaggagcctgcctgtggccccagcagttctcacctcagtggttttaggacaatgccaagaaagaaccttcaagccacaggtggtcacctgtcagggcacatgttctcatgatcactgcttatattataatttatgagaaaacgtgtgagcataaatgcacaaactcacctagaagcaccgctgcagcctcttgatactgtgaagagtgtgtgtgcatgtgcgctggccgctgcctctgttgcaggactcatgcatgcagacggagatgagaaaggggtgtacttaacgaaaggtcaaattgatggcagtggcagccagtctgggagcggccactgccatgatgccagctacagctggggaggtgtggccagggccgtgtgctccacaaagctggcaggaggcagggaccggtggaatcccacccccttccaaactggcagggtgggagcctcatgctccccaggcgcagctacagccacccagccacaactctggatccaggcatctctgtgctcttgggggccgggagcaggcaggaaccccaccctcccaggcacagctgcagccacccagccgtggctccagacccagccatctctgctcttggggaccaggagcgggcaggagctccaccctcccaggtgcagctgcagccacccggcatggctcctctgtgctctcaggggcccaggaagtgcccctacccctgcaggcttggaagcgtctgctcccgctccctggcctctccctgctcctggcacccacttcaatctcggagcaaagttgaggctgtacccaggtgctgttgcaaccagccggctgtgcacacgctcggggcagtgctcacatgccaaccacctgctatgtcagcccctctggactttgggcaccaacgagcatgggagggaggctgagggtggggactgagggcagtttggcactggcctgcaggtgccccttggcacaatcagcctgggtgttatggatgatggcaggaggcagacagggtcctgggcagaaaggggcaggtccccagtgaagtgccaccttcaagccagggacagcctgaagcctgggggctgggctgatggaccagaatgggaacttttagtgctttttccaagcctgcccatggctgcccatgaatcagtcagcacatacttcctcccctttgaagcccataaaaaccctggactcagccagactcaaggaaacgatggcataacctgccttcagaaaggagctacccatgccggggtctcctctctgctgagagctgagcagacgttgggaaaaccagctgcagagaggagctgcacactccagggtctcctctctgctgagaactgagcagacgtcgggaaaaccagctgcagagaggagctgcacactccagggtctcctctgctgagagctgagcagacgtcgggaaaaccagctgcggagaggagttacccactccagggtctcctctctgctgagagctgagcagacgtcgggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcagagaggagttaaccactccagggtctcctctctgctgagagctgagcagacgtcgggaaaaccagctgcggagaggagctacccactccagggtctcctctctgctgagagctgagcagacgtcgggaaaaccagctgcggagaggagctacccactcctgggtctcctctctgctgagagctgagcagacgtcgggaaaaccagctgcagagaggagttacccactccagggtctcctctctgctgagagctgagcagacgtcgggaaaaccagctgcggagaggagctacccactccagggtctcctctctgctgagagctgagcagacgtcgggaaaaccagctgcggagaggagttacccactccagggtctcctctctgctgagagctgagcagacgtcgggaaaaccagctgcagagaggagttaaccactccagggtctcttttctgctgagagcagaacacttatcaggacagtctgcctccggagaggagctaccaactgtgggtctcctctgagctattctgttgctcagtaaagctcctcttcagcttgcttaacctccacttgtccgtgtacctcattcttcctggatgcaggacaagaacttgggacccaccaaatgtcagggctacaagagctctaacacaaacagggctgaaacatgccccttgcttgccactttgcagatgacaagaaggagagaagagaaaaggagagaagagctgcagcccttcagggaacccagacctaggagctccctgagatagggctgtgatgccatctctggggctctgcagttcctggcgtctccaagcttccaggtgccaccacgttccccagtgccagatgttgaagctgcttgtagtacacctggcccagccacagccttgcagggagcaggcacccatgccagtgcctagagctgcccacccccctgcagccagcatgcatggctgtgcacagtggctggaccccacattcactctcacacccctcaccactctgcgcctggcttgcctttggcaggtgtgagatgcgggccagcagtgtgagccaagcgcagcctgccaggctgaatgggcataacaagcccagtgggtccaagtaaaaactcgggcaaaggcgtcaccagccacagaggtttctggctggcaaagcaataccccaaggatcccatgacattttgatctacttataaaatgaagacctaagttactgataaagtaaataaacattggccgagtgcgatggctcacacctgtaatcccagcactttgggaggccaaggcgggcggatcacttgaggccaggagttccagaccagcctggctaagagtctctactaaaaatacaaaaattagctaggtgtggtgatgcactcttgtagtcccagctactcaggaagctgaggcacaagaattgctcgaacccaggagacggagattgcggtgagccaagatcacaccactgcactccagcctggcaacagagcgagactcttatctgaaaaaagtaaaagagaatgaaaataaagattgagatatccaggaaagcatattccaaagcaccaaacatcctaagcctgatgcctggcttcatgctttcgtagcatgagttacttatggataggtttcattttttttttttttgagactgagtctcactatgtcgcccaggctggagtgcagtggcgcgatctcagctcactgcaacctccatctcccaggttcaagcaattctgctgcctcggcttcccatgtagctgggattacaggcgcgcgctaccatgcccagctaatttttgtatttttagtagagacggggtttcaccattgttggccaggctggtcttgaactcccgacctcaagtgatccacctgtctcggcctcccaaagtgctgggattacaggcgtgagccactgcacccggccatggatacatttcttttaaaatcacattgtcatgccagaattttctctcctcctacttgacagcctctcttagaacccagagagcccggtctgtgtctccctaccctctgttctctcaagctgcctgaatcgtaaggatttcttaattcagcatgtttgcaattaacctctagaccaaagtagttctgcactgctaaaactgtctttacctctgaaattctctgaaatttctcttccagtgatctcagccgatctgcatatagatattctgatttctttttaacctcgtcaaatggcatttccttaactgagacagacagttctctgttgccaccgtgatccctccctctagaactgcacctctctgaagccattggactctctcccagctcagggcccctccgggaatcgtgagctctacgtccagcccctgaaggccgtgctgcccatcccacccctgcctggtttcagcggtggcctgctgtgtggaagtgtctgactgcctctcccaccaagccacgggcgtgtacaccctctgcgtcctcagcaagcgttcacctcacctgtcttagttcctgcacctccaccccaaggatggatgctcagaacagtgggatgagccgccccaggaatgtggcatgccagcagcactaatgaacatgaacagcctggacacatgtcacacctatggcttgaaagcttgtcatgcgcatgctcattcccctcactgcagacctggggaacgagggcagcatcagcctggactagcatagctacagaatcagatgtggccctgccttagagccacgctgcccaatgctggcccgtgggcccctgcccagctagagcagaggcacccctggatcgcccatccagacagagatgccctgttcccctgcggagatgcagactccaggctctggggtggcggccgggaatctgttctcagtgagacagtactgtgcagctgcaggcagcggctgccccacgagcaccctcgcgggggtcatagccacgagcaccctcgccggagtcatagccacgagcaccctcgcgggggtcatagccacgagcaccctcgccggagtcatagccacgagcaccctcgcgggggtcatagccacgagcaccctcgcgggggtcatagccatgagcaccctcacgggggtcatagccatgaggcactaggttggctcttggagcctggggctccttcaggcaaggacaagcaccagctttgccctgagccccattctagttctgctagctttcagccagtgacttcatgcctctcagcttgcatttctcctctataaaacttaaaactgggatcattgtatgactcccaccccctagggctgtggtaagaaaggcagagccccatccctgtgctgcctgggtgcagcgggggctccatacagcaagctgcatcgtcagcactcgtgtctgtgtcctgtgccgcccaggtgcagagagggctccacacagccagctgcatcatcagcactcatgtctatgtcgccatcagctccttggccatctcaccatcctctgtggaaaaggggccacagcaactccagaacctcccgagccttcccacacacccgggtctgaggagggaaggagctggtgggctgagacacctcggcctccactgacgcggcgttctcttcccgcagcgcctaggactgagggcaccgtggccccaagtgaaattccttaaggcttcctttgtaactaatgggcatcttgttaagagtcaccacgttgctttaatggaataatacctaggacttacttttccaaaagaagagttcgtaggatttatctaggaaacgcagtttgcaggaaaatgacttgaagaaatagcagcacacgcttttgcaggggtttcttctcccccaccaagcagccagcggcctctgcgctattcttagcccaaaagtgcctctggataatcctctgggaatccctttttaagagtttctcacacatgaatccagatcctcgatataaaattaacaggaacatttctgaaatactccacttcctcccaagatagagcagccagaagctgacgctggcatccgcagccctgactgtgtcaagatccagtgggaaaattcactgtccaagtctctgaaatgtacggtattttcatctgcattggatcagacgcccccgtgtccttgtgaggtggcgctcccggaacaggagacagggtgggtctcattccagtccccgcttcagcagctgcaacagtcgggggtggataaaagacacctgcacctccatcttccaggcgtgttcatgtgcgcactggcccgagagagtgtctgtgctgagcattcgactgttagcaaagtcgtatctgccaccaccgaaggttggcttggggagtggaagaaaggccctgtcttgtagccgggaccttgaccctcttacagctgccgtcctctctggacgcagacctccctagagggcgtgtttgcacacccttgacctctgcaggctgcgagtgagccggggctctgggggtgtacatgctgagaagggcgccgtgtcctccaggcaggcctgggcccacagaggctgtgcgggccgcactcagccctccagtttgcatctccaaacccagcctctgccattgccgtgccctctctgttcacccttcctggtgctgcgctctctaagatggtggcagggaccagcagaaaggactctccctggtcctctgcctttgcccctgccccagccagctctgcagctcctgctcgctgcgtaccctgtcctcacaccgacaccgcaggcaggcaggtctgccaggtcacctctcagggacacgctactcatgttcacaatcttggccccacacccagcgcaatcaacgctgagtaaatgttgaacaaataagaagtgcacagctaaagaaagctccctccaggccaaccccctgtggtcactacactaatgggggtggggggggctcctgatccaggtgtgtgtctgtctcacgagatttccagaagtggtggaaaattagttttgtgacagcagccccaggtacaagccatgtgaaagcaggatggtctcatcttataaccccaggggctgcgagaattcatgccgaggcccggatcagttccctgcctggaagagtgggcagagcagagggttcgtcaccacggctccatgcggtactcccacgggcgcttccgtgcagggtggcaaggcgggagctgcacagaccccaggcggctcagcgtgacgtcccagggctcctgagtcaccggccccagcccagcagcgcctgagcctttgtgctccgtgagcgtctgagcatgtgtgggttttgctaaaggcttcatttcaactccagaagttttctgtcttccccgtcacctcccactgtttttccagacattttgagaaggcacatataaagttcacagtcgaaaacttgcttttctctttttagacttttgaagggatcatatgtctggcaggttctgtgggatggttgtatgtgtctagggctggccgaatagtttaataccaaaacaaaacaagctcagaaagaacatgtattactcttgtcatttaaaaaataggaacgttgcttaaagacaagttatggttccattttcttgctatttgcattttgaaggaaaggacaatctgggaagcgtgggtgttacatgagtgaagacttcaggatcgttttgttttccttggtgttctgttggctgaattgcaggttcaaggttcctaaattctaagtgaataattaaaagcatgagacattgcaggctccacgcggatgcggacctgaaggacagggttctgtctggctggagcgcagcctgggatgggccggcgctcagggaatggcttgtgcctgcgggatcagtgggcaccttcatggagcagctggccccatcctcctgacacagatgaggttgccccggcaccatcaggccccttctgaacgcgcacagcctctggagtccagaacccagcgggacccgcattccccccactgagcagtgtactcagaacaaaaccaccccgaagcacctgggccctcgcgaggtcatgtcggtggccgggcagcgcacgccctgccttgcgtggtttctcacggctgctcactaacgccgacagctggtctccagatccacagaaaaccctgctttaaaaaatcaaagcaaaacctcttgcctcctgaatgccagggctcaagctggtacaaatctttttctgtggtagaatttcaagccctgcaggtgtctgtggcaggaggctctcagagcccagggtcttggcttcatccacagacggctgggttgaaggggtggtttggagcctcatgctgcccactaggctgtgccagctgtgcaccaccctgctccccaccctccgggagcagccatccccttcccctgccagtgcgcccctccccagggcaggtttcagccatgtctgccctggagatgaaggttccccgtccatgcagtgcacccagcaccacctgcgtgcgcccgtggggaaggatgaccacagcccctcggccaggaggatgttaagggcggtcttgagtttcaggccccgtcacagtccaggcagcagagcccattttgccactggagagagcccaagccccctgcagtcattctctgacagtttctgtggcctcctgaagaacacgggggtgtaaacagtggcctgcgtggaggcctcaggctgctggtggctttccaccccgtgcccaccggccaggtcccgggtggatgaagcactccctgaccctccgtgaatgccacatcgcccggctccggaaagagcatggctggtggattcttcccgggcctcaactcgcagcctctgacccgagagctgaggtgttggggagaattggactcaaggctgggacagtgtggaggcccagcctcaggcaagggggaggacactgaggccgccaggagccgcccctctggcagggaaggtgaggagggtgggccgtcatccatctcagaggcttcaggccctgacccctcaggagcctcaggcagagcttcctccccagacatcccggctcacacggccacgccagggctagcccagtggatgcatgtccaagagtaaagaataccacttgagcttcaggattgcctttgcgggggatccagctggggccttccattggtgttggtgcttcctcggccaaaggccttttctgtgattctgaagcggctccacgccagcctctgcttcgtgtggcggcctccgcggagcacgtcctgtctgaccttcacacccccattcctttgcccctaggccaccgtgaacgcccggccgcagcgcgtcctggacacctcctccctcacgcagtcggcccccgccagccccaccaacaagggcgtgcacatccaccaggcggggtaagtgccgcccgctcagcctgcaggtccgtggtggtgaccggggccccacgggctgagctgtccctgagccggcctccccatcctcctccttccccgccctgtcttggcttcgtctcctcccccctctccagtgggcgctctttccctctccctcccggacaccccggtacccgcctgatctgagccctgccttgagctctccccatcttgaggaacccttcatgtgcacatcatctcagcaaaagttgaatgaagcctggtctctgtggcctttcagagtttgtaagaggggatctagatctccaaatgggtaaccaacaggtgtttgcacctcaggacgtggcactgctgtgtgctgagctcgcacatcccggcccactcgactctgagctgggttcgtcctgtccgcgccacctcccagggtgctggagttcaatgagggacaaccctgccccctgccaggcgggcaaccgagcagcatggactcggcaccagcagctggggttcgggagccatgatggcatgctgggtgactgaggacaccccgggccctggtggcacctgggagggtgcaggtggcccaggaagttgttccatgttccctctcgaagccccagactctgcagaggatgcagtgtttgtttttcttccaatggcaggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcaggtacgggagcccggctgcctggtgatctggacactgagagcgttgcttctcagatgggggctcatggcctcagcctcaggctgctcatatcaccatgggatggggcaggacccgccctgccgtcctgggtctgtgggccactctctgcctttgcagacccgggtgctggtcctcactcgtgcacccctctgcctgcactctttaggagcactgctgggtgtgtcccggtccctctgcctgcactctttaggagcactgtagggtgtgtcccggttctccgcccctggttctggtttcaccattctgggcagcttccatgtaacgaaacaggagcacggagttacctggctctgcccttcctgggcacacagcactctgcgtccgcttgggggcagctgcactgcagagcatttgttctgaatgtgttgtcttttctgtgaacatccaagtacgctgcataaataggtacactctctttgcctttaactaagttgaaaaagatatttctggagagaggaatgcctgctttgttttgccagggttatgagagtggtgtgaggtggcagctggtccggagacctcggctgtctcgtccaggtgctgccactttgtcagttgagggcacctgggctcaagaaggtggttcagggcgcacccagcacacccagctgctctgggtgctgacagcatgatcatctcagcaatgagtggggtccggggctcgcttggtaatccagtgattttaaaagaagttagcggccgccttgcaggatgccctggagcaggaacggccatgttggggtagaagagctgtcacggcaagagcggacaggtccccacaggtgctgctcagccccagcccacctggactttccgtgtctcggcagaggaggagcgagaatcaccaccgagccccaagtgcagggtcagcctcctggccaggccctggggagcaatgctaccggcacgtgcagctcacccacccgaccccccggggtgggggggatgcacctctcactgcacctgccctgagatcatggggagctccctgtgccaagacacagcgtgagagacgccagcaggccacatggcgtggcacaggagacccctggtgcccagcctcactccacaagcacacacagactctgacagccctggccgccacaggttccacaacaggaaacacccaaagctcagtcctcctcagctccacatcctctttctccagtagctgggagctccagccggcctgcaaagctgtgcgctccgtccaggccacttcacatgggagtccccgctctcagcctggtgtcatggggccatcacaggagctgtcctggaaccaagcggcagaggctttttgggggttgataaaccagcacacatggacgcacgtggcattgtctgaacagtcagttagaattgacttgggagctgtgctgggtcggccctggggatggtgggaccgacgtggctcacacttcacagcccgggcccctcaatccctggccagacgttcaggggttcttggtcaccaggatacggaagtgagcagagcacagaagtgccgtccttaggggcagcccggtgctcccggcagcgcctttgtccccagctgcagctcttttgagctcaggagtggcatgactgactggtgtttctttttccttccaaccctcctgcttaaaccctgaagactgcggacgacgcggacgatgctgctggacacaaaagtttcatctccgccacggtgcagacggggttctgcgactggagcgcccgctattttgcccagcccgtcatgaaggtgcgcccggggtgtggggttcagagtagagtcctagcgaacatgtgtctgtcccacttctttgagcataaacgctcaaggcttgtggctgtgggagcgtcccattgtggtcgtggtagtgatggtcacggttgaggtagaaccgcagaagaaacaaacttcacttaccttcctgtcgccaaacgaaaagagaaaacctgcctcgctggagcttcccagtgtgacaggtgtcactttgccttaactgacagggtcaccacaggccttcccactccctaatggtgaggatcactcgaggcccatcccaaggccacgcttgcgtggctccgaggtctggggactgttagacgcagcctgctgcagccaatcctagcgcatttggggttacaccacaagaccatctctgaggctcaaccctgacacagccctaacaagcgccgtgtgctgtggacgcagtggctgtgttcctgcaggctggggcagggcggcggctctcggcctcttcgaggaatggggcgggagctgctttgtcagcacagtcccagtgctcatctctctgccagggcccagcagggactcgtggagattttctataaatctaaagtgcattctgagcaaacctgcctcttccctcatatataattgaaagctgaaactctcagcttattctcgattgtatatcaagcttgcgtcttagtcatctctgtgaatggtatttggaccccatgacagctcagtccctgtggtcctgtcttcatagtgaatgctgatttctgttcataaaaacagaaccatcaggcagcccctgaggcaggcaagccatgaagcttgaactactgagcccctttactgcaaagagagaggagttcgcctccctcttctcacatgaacctgggtggacagtggcctggctgttctagaaagcgtcttgccgggaagcatcaaacgccttaaatagccgttccctttgacccagtcatgaatctgctaaaatactgtcttgagaaaataatcagagatgtagatgacttccgtgttgtttctaagaacgaaaattgagattcacttaaatgtccacagagggtgaatagttaaaaagttatgaaatatttgatgagatattattggagctactgaaaagttaaacattaaaaatagtgtcctaaggaagcgctcatgacaacattccttaaaaagaaaaaatgcaaaatgcagaccaagaagccagatttacagaacaatcacagccgtgcttctcatacagacacagatgtgcatacgacggagaccagcagagcccgctcctaactagagattcgcaaatggcgccacccacgactgcactgaattgggcttcttttgtgcctcttctgcagtttctacactaagcacgaagcacctttagagtcgggggaaaagaatcaaagaaacaaaccccaggagatcattgaggctggtggattcagtcctagtcagaagcccctcaccaggcccacctgctgggctcaccgctgcttacctgcgggtggcatgagggtggcggcccctgcagacagagggaagtgccccttcccatcactaggaggcttctggttaggaaaggaaagcatacacaaatcctggaattggatgcaggaagcaggagccacccaaactctgagtgagccagagctgggaggtggctggacactgtgccaggggtgccaggccgtcctctagaactgcggcccagtctgttgaaaagtcaatggaatttagtctaatgttaacaagcttggtgtccttgatgcggtctcgtgcttaaggcagacaaggtcaggcgactaagaaacccacatggtctggtcttcgctcttgctgggatggcagtggctgtacatgttggtaatttcttggtgtgataacgagaggcttttcttgaagtccttgaaaaatgcctattctcagtcatctatcctatgatgaaagaggaatggcatagataatccaaaactcattgctcttaaacttaaaaatgaatttgacttttccccaaaggatttgctttcctttcctaagcatttttaagtacacagcagctgattgcaggaggaagttccccagaggcatgtggaaggccgtgtgtgtgtgtgtctgtctgtctgtctgtctctatgtgtgtgtgtgtatccctgtgtctgtctgtgtgatgtgtgtgtgtatctctgtatgtgtgtatgtgtatctcgtgtgtgtgtctgtgtgtttctgtgtgtccctgtgtgtgtctgtgtgtgtgtgtctatttgttccggtgtgtgcaagccccaagccagcgtctcctctccctttcttcagattagcagcccctcctccgcctgccctcatctcctccatttgcacatctgagaattcccgcccgcacggaggagctggagggtgtcagccttgtggtctggccctgccagcaggtcctgctgtgtggacactgcagaggagattagtccaaggggatccatgtaggagctgccatcacacaggaggttgatcaggaaacggttgctgaatgagtaaacgattgtcttcctctgcccctgccaagtatttgaaaacaaatgctcacttggttgtcgttgaaacaacaggctctgggtgtcatgatggaaaagagcgccgtgttgtggtcggcgtcgtctgtaactcctgatagcaactgcagtcttaggagcgtctttaacattagagaccttttccaaacttcagaagaggaagcaggacgtgttttctcttgtttaaaaaaaaaattgttttcctactttttctaggtggtattcataaaggtattcttttactgatttaattcatcatctaatgacatttgtgtaacgagctgcattaggaacttcttgttattagcctgcttcacatgtaaactaaaaatagctctaaggctaggattgaacctaaaaaagaacagaagaactgcaaacccgaaactgcttcaaggtatataagaaactaaaacagttaccaggtcacaaaataatgaccagtttacactgacatgcaactagcgattagcaggatgagcatccaaggacaccgtggtaaggacagcgtctgctaacgtttttattagttcaccgtcagatttcgtacaggtccgtatgactagaaagagccgtgttctgtctgcggctcacctttgattggtgaagcaacctcctttcttcccatgttggtttacggagctcgtgtctacattagaaaccacaaaagaatattaaaaatggtctgccgtgtgcttaagaaagaaaaagatgtattgaattgtgttctgattacaaaagtcatacaacttttttcttctctcagttggaaggtttcaaaaattgattctatccagagaatcaatccctacaaggctgtaggggcatgtgaactctcagacactgttggtgggtgggtccagtactccctttgcttagggcaattaagcagtaactgtcaggattagaaaagggtatacctgcaaagccagcaatcctgctaggaggcatatattcttaaaaaccactaatatacatgtccatgaaagggttctgcccggagatgttcatgataacatgatttgtaatgggaaaaagttgaaaagaatcacttagtaggagagttaatttaaaatgatggatccatgggttagaatactatacaaccattaaaattctttaagttgtatctttctatgaggacttggttggatgtccttgatccaaaaggtaaaataatcaaattgtacaaaatgcttgcacgagctctgtgcttctgtagactggaacaagcacgggaggaggcttggccagttacacagcaggctggccacacagtgacttctagaaggtggagttggagccaggcaaggggactgttctttttttcatcatttacttctggatgatttgaattttttagaaagaacagttattagttttgcaatttaaaacagactaaaataccatttttaattataaaaagctttaagagtcgatacgctgttgggaggcatcacacgcagaacccagtttatttcacacagcccttaaagctacagtggggatttccgtttggcggctccgcagagcatggggatcttgttttgccctgagagcatctgctcctctagggtggatgcggaagctgcactgcccgtcatcagatctgcggctgtgcagctggggtttcagtgcaccattagaaactcaggcagtgaaggagcgacttgagatggccatagtccccacgcagggttccctcccagcactggggttgccctgcctgcatggcttccggtcccgcttttctcactatgcagtgaacattgagcatcctgtcatagattctcccacaaaaatgactttttctgttttgtcttgtttttctcctctgagaatgacactctgtgtgacattctttatataaacctgcagcaggcagagcctgagaagtcccctcgtgccaccctcagctcagttcatccttggctcatcctcggctcatcctcagctcatccctggctcatccccagctcatcctcagttcagttcagctcatcctcatccccagctcatccccagcgcatcctcaactcatccccagctcatcctcaactcatccccagctgctcctcagctcatccccagctcagctcatccccagctcatgcccagctcatccccagctcatgcccagctcatccccagctcatcctcagctcatcccctgctcatccttagctcatcttcagctcatccccagctcagctcagctcatcctcagctcatcctcagctcatccccagctcatcctcagctcatccccagctcagctcagctcattctcagctcatccccagctcatcctcagctcatcctcatccccagctcatcctcagctcatccccacctcatccccagctcatccccacctcatccccacctcatcctcagctcatcctcagctcattctcatccccagctcatccccagctcatccccacctcatccccagctcctccccacctcatcctcagctcatccccaggtcatcctcagttcatccccaggtcatccccagctcatcctcagctcagctcatcctcagctcatcctcagctcagctcatcctcagctcaaccccagctcatctccagctcagctcatccccagctcatcttcagctcagctcatccccagctcatccccagatcatccccagctcatccccagctcatcctcagatcatccccagctcatctcagatcatccccagctcatcctcagatcatccccagctcatcctcagctcatcctcagctcaactcatccccagctcagctcattcccagctaatcctcagctcagctcatccccagctcatccccagctcagctcatccccagcccaggtcatccccagcccatcctcagctcatcctcagctcatcctccactcatcccctgctcattctcagctcatcttcagctcagctcatccccagttcatccccagctcatcctcagctccgctcatcctcggctcagctcatccttagctcatcctcagctcatccccagctcatccccagcttattcccagctcatccccagctcatccccagctcatcctcagctcatccccagctcatcctcaccttatccccagatcatccccagatcatccccagctcatccccagctcaggtcaccctcagctcatcccagctcagctcacccttagcttatcctcagctcaccctcagctcatccccagctcatcccagctcatccccagctcatccccagctcatccccagctcatcctcagctcatcctcagctcagctcatcctcaccttatccccagatcatccccagatcatccccagctcatcctcagctcatgcgcagctgatcctagctgatcctcagctcatccccagctcatccccagctcatccccagctcatcctcagctcatcttcagcttatccacttcagtctgctgtgggcttcacccgcctcaggaggacagctggctccaccccagctgcagcttctaaaatgggtgcttcctgttctttcctggaaagttcagaaggaaagcaaatggataggtcgattcccctccaggaagaccagaatagaataagtcgttggttttggatggaagctgcgtgaagaacacacttggtgggtggaagtgggagacgtagcttctctgactttgtttccactcagccaccaccagctggactctggtgctcgcagtctccgaggcagcaggacagcttcctcccacagctggggcagggaccgtgcagtgccattctgctcacctttctccacacttggctgtagtgccagcgcctgtctggtaaattactgctgagtgttaaacagtcaggggtcaggtttatcagccaagtcagacaggcttgttttagagaacactgtgattattcagtgttgtttaaattaaatacgtggttattctaaccgtgcattcttagagagtttcatcctggttttgcttggctgcacgtgcagagggtcctgtgggcagttccttcggcctcaagcgtatgggaaatattgctctggtaaaagccgcagcctggttccacctccgcctgcagacagctggaaagagcaccactcccaccttggaaataagaaaagggcagaaaagctataaaattctgacttttcctgaactcatcagagagctgaggtggcaggggaagtgagttgcccagcagggaagggaagaggtgcctccaaggagagccggaccatgagcaccagttccctgcagcagagcagaaggggccagcagggagaaatgctcacctgaaattggcagtggtttgcgcaaggctaaacctggaccaatggagaatctcaaacctttgggagccacaggctgcacaggccatggacgtccactgggccctcacccagaagattgaggtgggacacgagaagagcccctcagaggtgtgggcccgcagcaggctctcctgtgctgctccccacagaacataacctgcagctcctgatgaaagacagcaaaccctgtcgcccccagagcacaggcgaagacccactgccacagaagaactgcaaaagaaaaccttccatctccagcagggcgaggacctgccacgtgtggcacactgcagggagcaggacagagtcactgagaaggttccaccctgagacccagagacacaggccctgcctcagtcagagtctgggctagagcaacagagagcccttcggacccttccaacaggctagcaggctccaggcagcaggcacagcagtcgagctgtagcaggggcacaggagcatagagagagaagccccccaaggtgcagacacacgaggaaagccaaaaaccaagggagggtggggtgggaaccctggcaaaaaccctcccgaaacccaggccctgcttgaagcatgaggtagtgtgagaggaatccgaagctggccacatgctgagtgtcaccatggcaacagtaaaacccaagcccatttcagtgcctcgctagattgactgaactctttaacagtctagtaatagaggcacacccatttccaggcatgcatatatatatatatatatatatatacaccttagtctctgctgttctacacatgaagtctggaattcattcagaaattaggagaggctgggcatggtggctcacacctgttatcccagcactttggaaggccaagacaagaggatcacttgagcccaggagttcaagactagccttggcaacgcagcaagacctcatgtctactaaaaagaacaaaggaaaagtatgagatgcccccaaaaatataagacaaacacgcctgccatcaagagacaaagcagagaaagacccaagggcaacccagatgttggaactatcagagatggagtggaaataaccaagattaatatgacctaaaggcattgacagcaaaggtagacaacaaacatgaacagatgagggatttcagcagagagttggacactaagaaagagtcaagtgaatgccccccagaggcctatctgtgacctcaaatagccaaggaaaaaaatcagtgaatttaaagacaggtctatagaaagtacccaaaatgaagcacaaagactacaaagagtgggaaaaaaacaaacaggattgcagatcatctgagagcttcaggacagtacaaagcagtccaacatctaaccacagatccagcaaagatcccaaatcatggtatatacagacacacacatgcacgtgcacacacacatatacacacacagctggacacatatctaagccaccacaaaccaaagataaagagaaaaccttgaagacctctggagcaaaaggacacattacttacaggggaacaaggacaagaatcaccacagacttctcattagaaactgtgtaagacagagatagtccagtaatatctttaaagtgctgaaagaaactgtcaacctagaattctgtacacacaaaaatatctttcccaaaagaaggtaacaagacaaacatatcctctcttgccacttgtcttcaacactgaactggaaattatagccagggaagttaggcgagcaaaagaaataaaacatatcatattggaaagaagaataaagccatctctgttcacagatgacatgatcctgaatattgaaaatcattcaaaatccattttaatagagtatcagaacttaaaaaccaatgcagcagtattgtacccacaagctcaatatccagtaaccatttgtatcagaatcccctacactagtaatgaaaaccctaaaaatgcaatcaagaaaacactttcatttataatcatagcaaaaataataaaatgcttaagaataaacctagtaaaagaaatgtaagacttgtactgaaacattattgaatgatactaaagaagacttaaataaagggaaagaaatcacacattcgtaggtcagaagactaacattaagttggcagaactccccaaatagctctacagattcagcaccatccctggcagccttttttgcaaaaattgacaagctgatactaaaatttgtatggcaatataagggacccagaataacaaaagaaaaatgtaagagacaaacatactgaacaactcacgcttcctgatttcaaaacttactacatagctgcactaattaagataccatggcattggcttaagagcagacatataggtcaatggatttgaattgagagcccagaaatataccttccgtcactgctttatgcctataaactctacaatttaggcgagatagacaaattccttggaagagattactacccagcgtcatttgatagcaaagagataacctgaatagttcctgtctattaaagaaaatgaagttttcttgctttgttttgtttgagatggggtctcattctgttgcccaggctggggttcagcggtgcaataccttccatcactactttatgtccataaaactctaaaatttagatgaaatagacaaattccttggaagagattactaccaaacgtcattcagtagcaaagagataacctgaatagttcctgtctattaaaggaaatgaagttttcttgctttgttttgtttcagatggggtctcattctgttgcccaggctggggttcagcggtgcaataccttccatcactactttatgtgcataaactctaaaatttagatgaaatagacaaattccttggaagagattactaccaaacgtcattcaatagcaaagagataacctgaatagttcctgtctattaaagaaaatgaagttttcttgttttgttttgtttgagatggggtctcattctgttgcccaggctggggttcagcggtgtgatcattgatctttgcaacctcaatctcctggactcgagagaccctcccacctcttcctccccaggagctgggactacaggcatgcaccaccagacacagcgaattttgaaattgtttacagagatggggactcgctatgttgctcagactggtctcaaacttctgggctcaagcagccacctcagcctctcaaagtgctgggattatggatgtgagccactgcatctagccaagaaaatgagtttttaactaaaaactcaacacagaaaacttctgacccagaaagtttcgctggcaactgtaccaaacctttaaggaggaaataataccacttctgcacaacctgtcacagaaaattaaaaggagtgaacacttcccaactcagtatatgaaggcagcatttttctgatatcaaaaccaaagatatcacaagaataaaaaacacagattcccaagtcctcagcatcgtattaacaagctccagccaggcacagtggctcatgcctgtaatccagcactttaggaggccaaggcaaggaggatcgcttgagtccaagagttcaagaccagcctgggcagcactgcaagaccctgtctcaaaaaaaaaaaaaaggcattatacaaaaatcagttgtatttccatatgagcaattggacattgaaatttaacatcagtaccattcaaaatagcaccaaaatacatgaaatacttaagtataaatcttttttcaaaatatgtgaaagatatgtattctgaaaaatataaaacactgatgaaagaaatgaaaaggtctaagtaaatggagaccatgctcctggtttagaagactcaataatattaagattccagttctccctaaattgatacatagatcaatgcaaccccaatcaaaaccccaataggattttttttggtaaaaatagagaagtttattctaaaatttatggggaaaaggaaactaaaataaccagaacaattttgaactagaagaacaaagttagaagcctcacactatcttatttcaagacttgctataaaaaaagtaatcaagatggtgtgggattggtgaaaggttagatgcgtagatcaatggaacagaatagagagcccagaaattggtctacacaaatatgttcaattgattttcaacaaaggtgcaaaaacaattcaattcaatggagaaaggatactcttttcaaccattggtactggagcaattaacaaccagttgtcaaaaaaaataaaaagaagaacctcgatcagtacttcacaccttatacaacaattaactcagagtgaatcatagccctaagtgtgaaacctaaaactataaaacttctagaaggaaacagaaaaaaaaatatttctgaccttgtaggttaggcaatgtcttctttaataagatgcaaaaagtacaagtcaaaaaagaaaaaaacgataagttgggcttcatcaaaattaaaaactgctttttaaagacagttaagaaaatgaaaagacaagtcacagacagagcgaaaattataaaacacgtaagattaagatcttgtggctgttatacataaccctcaaaattccatgataaaggaaataagcagcccaattaaaaaacagtggcgaaagattttacagacaccccaccaaagaagatatacaggtggcaaataaggacatggaatgatgctcattgttaaggatcttaatcacgggaaagtacggacccctgcagtgagatcccactacacacctgttagaatgtctcgaatcttaaaatctaccaagtgttggcaagggacacggagcatctgaaaccctcattcttggctactgcaactacaagatgctacagacaccttggaaaaggttgtcagtttcttacaaagttaaacgtatgcctaccatgcaacctaaccattctactcctggatattcaccaagagaagtgaaaacatgttcattcagaaacctgtatgtgaatgtttatagtgactgtattcatagtcaccaaaaactggaaacaacccaagtttccttcacctcgtaaagagagaagctgatacaaccatacaatgaaagactcatcagaacaatatttaaataaactattgataaacgcagtggcacagatgcatctcaagtgtatcatgctaaatggaagaagctgctcaaaagactgtatcctgtatgatccatgtatacaacattccagggaaggcaaaactgtgtggaactgttctatatcttccacatttatcaaaactccgcctgtacctacagagggcgaaattcactgtacgtaagttacatcttcatcaacctcatgttgcggggagaagaaactcttttccctcttgtgctgaagtcacatgaaagatgatgtaaatgccttgttgaggagtgaacgcgcatagcaagctccgagcttcattcagagcttctcccccctccacagcttggcgatttgtggtaacacaaaggctgtgtccttggacgtaatgtacacgagacactggcagaatcaaaccaactctgttgcctgtggactcacgacgcacaccactacctcttccgcctcctcctctgctgcctctgtccacggaggggactttattgttcagtggggaggggatagtttgttgctaaaccgtggggaaaataataaaaagcgtcaaggggaaaagcacatcacagaggcaaatttgccctcacttcaggtcatcaggagctaagcgggtggagagggagggagctggcagtgtgagcgtttaatgtgttagcgatcttttcccatgggtgcctctccccttttgccttcatccaagtctttctcaatcttgatagtcatgtacctgttttgaattttatcccctgcaccttgaacctttctaaattcagagggattgaagataagactcagctctaaggctcccagattccccggataagaatttatcccaaaactgccccaaactgctgctttcccgtaagtcttctggggaacctctaatctccctttattcctgagccccaggtttttctttgcaacaggaaaggagttgtgtttcattggctttcagctgaagcctctgtgggaggcttcagaatcgtaattggtttctgtctgagtggaagccaagaggtacaggagtgtcaagatcctcatcatgtaacaggatcagcggcacccacagcctccaggagctctgtttacagggaggctcagcctgcactgggcctgggcccttttttactgaaaagcctttattcagcctgaagagaaacaggtggagaggaggcgacagagccgatgatgaagagctgcggtgtcatttgctgcctccgtgctgagcggcggtcacatcctagtttcccagggtgggtgcccgcatcttccacggcatctctgccttcccctggcctctccatccaccgctctccctcctgcctcacgccgcacctccacttctgcccatgcttgtcctgtgaccctcgtggtcatagctggttgtcctgacacagacacttggggtggttccggaaccgcgtcccgttcagaaagtctcttcccagcccagcaagggctgtaaaggaaggctgtgggctctctcctagagctcagattagggaagtggcggcccctacccctacaggcagaagcccctgggccgggagagggcccttgcagtgccgtggcaacaggacaagtgtggggccccctgaaacccctcagctcctgtctccgggcgtcctgtgcccctccctgttctggcatgggccccctctcagccttgcagtcgtctttgttgtctttggagctgaggctctgaagccgccccatttctaccccccacgtctggattctttgcctgagctcaggcccaggaccatagagtgccaggccaaggagctggaattcccatcagttcctctcccttcccactcgaaagttccttctagactcttcctctaatttattcccagagaagcccgagtctcattaaagtgcaatgtctctgttcctgcacagctttgagtctttccaccgcgggttttttcttattactgttctatgttatttaccatttgtcatttcttttctaataagctcaggattgtcgtcaagtgaaaccggttgctaagaatccacagtctatcccatttgccgttgcgggattatttctaaatcagaaaatgtgcggagggagccatttgacaccttttgtggttactgtttccgggtttggatgtcttttttgctgtgttgttgctgttttatcgagtgtggttttgtgacttttaagaagaaaaagaaggaagcagagcaatcaaatgctaggaactgagccacagccacccatgagcacggggtcagacgtgaggtttggggcttgcctgtttctgttttgtattcagagctgacacaaagcattcgaggaagagacacaaagaatgctctgtaagcatttgcacatgataaccacctacaacgaccgcctaaaactccacacggagaaaccgttttctttctccgccacatttacgtgcaaggacgcaaacacggccatgcgccatagtctttattcccatttcttctatcagagaaagcgactttttaataactaatgcaggctctctttttcctttgtcgagacagagttgcttttagccaaaaggaattagggttcttaccttgtttatttcatttattttatattttgggtcttcacaagtcttagtttcttagcaaggaacagaatcagccagattgactggacggcatgtatgcttaaggaaatgcatctgcgtaacccagacaagtggccatcctcccgcggaaagtcgattaaatcctagttagtatttgccaagtgtggacctctcctagacgctgaacgtgcacaccccaacccacatgtgcgtgcacacacacagacacatgcacgcactcgcacacacgcacacacacgcatgcacgcaaaggccctgaagtgaatgaagacctttgctcagggaagagagggcagcagcatgtctagcgtctgcatatttcaagtgaaaataaacttggtctttctgaagctgtctcattagggaaggcactgaagttctcacgagttagtttaaccccagccaggcttgcagctcagcaccctcctagctcttccaccatcaggagcccagtggcaccccctctgctgcccaggaaggtcccacaccctctcggggcccggcctggcctctcatgaggctgtcttccttctgtctcgtaagctccctcatcttccagccagctgcctggttccctttggcattagagagagaataaaggcagtgtctcctcaagcgcacctgcctcctgattgtgttttcagtgtttgaagcggcattcggtgcccccctgccctgctgctcagtgctgacctcagtgccccccattccctggggaggcgtttcccaaggccctggtccccatcatacacctgtcagcctcacaggccactcactcaagggtctcagagcccccacactagtgaacacaggcgtggagagcgcctctcccagctccggggagggaccagcgatgtgttttgtagcagacacaggacccacaacagcccgtgcctctggtgcactggccagacgagaagcccaaagccttcagcctttgagaaagaggtgccttcatctgaaaataactacagccaaccctccatgtccacaggtgctgcatccgcagattcaaccaattttggataaaaaaacaaatgtaaataacaaaaataaatttaaaataacaatacaacaagaaacaatccaaattttaaaaatacggcatagcagctatttacacagcgttgacactgtgtcgggtatggcgggcaagctagcgagggtttgaggtgtgccggaggatgtgttctgcttgtacgcagatgccacaccctttcgtattggggactgagccgcgcaggttttgctatccgaggggtcctagaacccataccccattgataccaagatacaaccctgtttcatcgctgggcttaactgggtgttttctgttgttgaagatcccagaagagcacgacctggagagtcagatccgcaaggagcgggagtggcggttcctgcgaaacagccgtgtcaggaggcaggcccagcaagtcattcagaagggtaagggcacccgcacagccagccaggggctcattccgggggtggggcctggggcgagggtcccctgtgagcaggccccccgcggcccacgcacaaccttctccagccatccactgtcccacgacagacccgccccgcaccccacctcccttgcagataagcacatcaaggctggtggagatgaagctgctgctcctcaaggttctgcagcccagagtggggaggggaggggccgggtgggaacccagccaccgcctgggaagagggctctcccgggaccctgcctcttcctctgcaagggcagccctcagccctcgggattatcagcgcaggtggaactcatggaagcggaactttgcatgttgacatttccggaagggaaggcctctgagagcccacatctccccacccggacaggtgtcgttgcgccaggccctacacatggcgcatccttccctggaaacaggaagtgaaaatgccaggccctgctttcctcagctggcctccacttgtccctgaaatggtggccagctctgtcaccccacatctcagtcatgattttcctaaaccttctcccagatttgccactagatgccaaatcgctcccttcacctaccttgttgtttgctctcccagctgcacccggggtggaggggcagggagcagccctggagggggcggtgtctgttgccgcagacagcggagggagctccttgcggaagggatccgggctgcaggcggccccggtcacagagactgtgtggggagcagggaggccctgagagtcaacacagcaatgagggtgtcaggcagccccatcccagggaccctggcctctccccaggatccaggagagtacaggggcccaggcccagccctacagccccactgagggcacggagcagcagtggtgtctccgcactcctccccctgccctcgcggccacaggctcccaccactgagccagctctggctgggggacctctagctgcccccaaccaaatcagcaccatcaaaagtcaaggactctgaccccagtctgcaggtttattgttttgaccttgcatctttgtcctgtaaaattctggagattattatgggttactttctgaagttgaggttgatgacccgtaggacagatgtcctccctcctgccaaagccgagggccctgcccgcaggcagcacaggcgccatgagcgcgtcctcagcgagcgtgcctaggcccggctcacacctctgctctgctgatcaccgaaaacactgctgacttctggtaccagcaacgtttctgaagcgcattcccacgcagctctctctgtgaaagactgcggttcatctcgcattaacgcagacggtggctgttgtgctgaaagctaattgtggttgtttgtagccctctgtgcatctgaagagctggcggcagaccaggtttaaagcatcgcatgttgcaatccggtgcgtgctgccccggcggccgccgctgaaccttgcagccagggtggctttctccagcagagagaacagaccctgctggatgagcgtctccaggtggaggcgacaggaggctgttttcctggaggttagcgattctctaggaccccagcctgctagctgggatggccagcacacgggggctgcctgctgcctgagacaggcttgggagctgagtctgcctcacacagttcaacatctgaagatgagctggcccctgatggccaaggtgattctctggcctggagcctgtggtcagaattgagcagggtgcgaaacagagccggcattcgagacccaaaaccgagatttctagaccaaaaaaaagaatatatttgtaaaccagagtttgtccagacacacaaaggaggagctgctgagccgctggagacaccaccaaatgaggcctcaagacacaggggatggtgccagcaggcgtggtgccagcaggcgtagtgccgggagtcactgaggagtgaggccgcgccctcctcccagtcctctgtcctcggaattcggattcggtgcaggcgtttattttcatttaaggagccaactgtgtgctgggaaagatgtgagcattgagaaaaaggagaaattgatgcctgtagatggaagagaaccagagaagtcggcgtcgcccaggagacggggttgggaaagccctgtgtcacgcaggcccctgcccggctcttcagccttctcctgggcaacattcacgaccttggctgtcacgcactgattttcaaacgtaccaaatgcgtgggctgggtggggtttccctttgtccttcagtgcttagaattatgcccaaactccgtccagaactccctgcagctgggaatggaggcaccgctagggtaacacggtgctgccgccgcaccaaagccttcgggcctgcctgcctctgtgagtgcagcctctccttgtataacgtggcattcatttcctttccgtggttctgggtgtttgctggggactgacattgttggaaacagtagctcacccgaggtgccgagcacacaccaggcatcagtgaggcttcagcccgcagactccatggccctggtgccacctggacagtgccaggcacaagcggaggggctgtcagctgctggaggtgggcggccttggctgtgcttaagcccagttcagagcagcctgcagcagagtgcccaagtcgcgcggctttgaccttgcaccccgacggtaggctccttctgttgtaggactttttaattcagctaaaaacagggtctttgtcacatgaccatgaaaaattaggctcccagacactttgaagggtgggaagggcagggtttattgggtgagaaggaaaaaacgggaaacagggcctccccgcaaagccggagtcctgctggtgcacttcccgcctcgcagattggatcccaggttctaccccggatcgggaggctgggctcctcctgctgcaaagggcgccaacttctgtggctccccccgttgtcccagtgtgcaggctggtgggagtttctctggggacccctttatacttggctatctcacttcctgccagagcacaagcccaccactccccacagggaagactggaggcgggcaacggtcctctgagccagaccagaagttcaggtgaggacacggttagtaagagccagtcaggtgaggacacggttagtaagagccagtcaggtgaggacacggttagtaagagccagtcaggtgaggacacggttagtaagagccagtcaggtgaggacacggttagtaagagccaggcggtgtctctctgcaccacctggagctatgtctctggctgaggaaggcttgggggtccccaagacaccctcctggttgcccagaggccacgcaggtgaccgcagccaaggccaggaggcagcccagcttgtgtccttggtgccacaacagacaatgaggcttatgcacccacagatccccagctgccctttcagtcaccaggatgtgttggaatccatcttgcgccctctgcatttttagcttccttttatggttccttctagaaaaaagccttttagagtcacaagggacttacttcctagtgctcgtgtttgggggcctggtggttaagtccacgttcccctcttctgttaaatctgtgattctgtaatagatccctcagtcaaggaagttcatagttaccattctagactgaaagacccccggactttggctgcaatgtggatcctggcgaccacacccatgtctcctccttaagtctgttacgaatcagagccctaccgagcttattctgaaactttagcactttcttcatataatctgacccagataaatttgtacaaacctgaccactgctgacaagtattggctgaatgcttccacatgtccagctcggcatcaggagctttgggggttttgagcaaaggcattaaccctgcggccagggcccctgggccctcattctgggtactcagtggctgccgtcaccccaagagcccagatgtgcctgctcctcagcaggtggtcaggcccctcccttcagtccctgcttttcttctgcttcctttgtgcctctccaagtccccaaggtattgacgtcggccatgataagatacgtcgtgaatatttattgtaaattaagactggcttgccgggcatggtggctcacttctgtaatcccagcactttgagaagccaaggtggatggatcacttgaggtcaggagtttgagaccagcctggccaacatggtgaaaccccgtctctactaaaaatacaaaaattagctgggcgtggtggcggatgcctgtaatcccagcgactcaggaggctgaggcaggagaatcgcttgaacccaggaggcagaggtggcagtgagccaagatcacaccactgcacttcagcctgggtgacagagcaagactccatctcaaaaaaaaaaaaaaaaaagactggctactggctgggcgtatgcccataatcccaacacttgaggaggccgaggcgggaggatcgctcgagcccaggaatttgagactaccccgggcaacacagtaagaccctgtctcaacaaaaaacaaaaaaaagtagccaggtgtggcggtgcgcgcctatgtccccagctacatgcagagttgaggcgggaggatcacttgagcaggaggtggaagctgcagtgagccatgatcacaccactctgcaccccagccagggcgacagaacaggacactgtctttaaaaaataaaaaaggggcccggcgcggtggctcacgcctgtaatcccagcactttgggaggccgagacgggcagatcacaaggtcaggagatcaagaccatcctgtctaacacggtgaaaccccatctctactaaaaatacaaaaaattagctgggcatggtggcgggcacctgtagtcccagctactcgggaggctgaggcaggagaatggtgtgaacctgggaggcggagcttgcagtgagccaagattgcgccactgcactccagcctgggcgacagagcgagactccgtctcaaaaaaaataaataaataaataagggggaaaagatgctggctcctggatccactcttgtgtgtttcttttgacaggcattacgagattggacgaccaaatatttctgaacaggaaccccggcgtcccctctgtggtgaaattccaccccttcacgccgtgcatcgccgtagccgacaaggacagcatctggtatgcaccgcgctggtcaggcctcccttccggctgaccgacagccccagcgatgccctgttctcccccgatcaccactcctcttccttgaaaagcagatacaaggcactcaccccgaggcccttagcactgtttcctgagaaacggccctactcaccttctcctctttgaccgagccccacccacacctgccccgggcctggccctgtccttgtcactgaaggacagtccagagtcctgcctgcaggtcagaggggagtggcagggactccccagtcacacttgtaatagaggcgtacacaggggggccggcttgctgccctgcccgcagaagcaagcatgtgatagacaagcagtaagaagatgctaggtgccccaggagagaagtgagtttaactcacagcaaatatcgcccttagagatggagagagtacccacttcatgggggagggcagtgggagggggttccttttagagtttagagtttataaaatctctgtggttcacacctccatttctttttcctctttttaaaaattgtggtaaaacatacatagcctaaaatttgccattttaaccgttctgagtgcacagccagtggcattcagcgtattcacattgttatgcaaccatcacccccattggtctccagaaccttctcatcacacaaaaccaaaacttggtccccatcagacaccagctccccattcctgcatccgcctgagccagtgtttcactttctgtctctctgaagtggcgcacgctaggagcctcataccagtggagtcacccgggatttggccctttgtgcctggcttattcggctcagcgcagtgtctttaaggttcctccaagctacagcacgtcagaatttccttttcatggctgagtaatattccactgtgtggatggaccacactttgtcttatcattcatctgttcatggacacctgggttgcctccaccttttgtctattgtgaataacactgctgtgaacattggtgtacaagtatctgttcaagttcctgctttctgttttttggggatacgcccagagtggaattgctggaccatatggtgatgctctgtttaattttcggaggaaccaccaggctgttttctgcaggaaatcctcttcccttcccacccgcacagcctgtggctccaatttcccacatccttgccagcactattattctctctttgtttgtttgtttggagacaaggtctcactttgttgtccaggctggtcttgaactcccaggctccaacagtcctcctgcttcagcctcccaagtagctaggatgacaggtgtgagccgccgtgcccggctgtggtgtgtggttttttgatagcagcccggtgggtttcaggaggtatctcactgtcatttgggtttgcagtttcctaatgacttttttattcctctcttcttcccttaagcttttgggactgggagaaaggggagaagctggattatttccacaatgggaaccctcggtacacgagggtcactgccatggagtatctgaacggccaggactgctcgcttctgctgacggccacaggtgagcggggtttgcacagccaggattggaagccagggtctggaggagtggcggggagggtgtgtgatcctgagatgtgtttgtacatctgtcttacagaaagccctgctcacacgcgagggccactgtcattcagaagtggggaggtttatgagggaaagggcttcagcagcagagacaggaaagcaaagatgaccccatccttgagggttccagggacttgtcttctcatctcagtcctctagcccttccagcaccaggaaaagcctctgacagcctctgtccttaaacccctgtgagagacccggtgggtcccacgtgacacccgagaatcagggaaggatgccccaagccacaacacgtgccaggtcctccccggccagggtctcctggcatcgctggctcatttgccagttgctgtccccactgggagctggcactcaccctcctccagtcccgtcctgcacctgaaaggacatcgttgaccatcatggtcgctgaccagtggttcattgccgtagtgggtctcactcaggttttggttttcttgggttttcggggggttttttggaggggtccgaaatgtcttagtttcatcttcactttggaacaatcgtttgtttccatgtcagttaccccacattgacagtcattttcctttagcgctttgaaaacacgtgtccattgcctgttgctgatgagaagtcgctgtcagtcccactgcacttcctgtggagactagagagcgctgggcgggaggcaggcgggggaggccagcacggctgagagaagtgaaggccgacacccggatcccacccagcctgtccctgtcggccgcagcccctagacacctgagcctctgagagtgtcgagtcggttgtgctgacaagtgcgcagccctctcaacgcggttgcgggctcctggtgaggggcgtggccatggggacgtgtcctcgtgcagcccctcctccgagcgctgccccctcaggaccaagtagcatcaacctatgtcgaaagcccgtctttgtccctgtagctgtcagacgtgaccgggaggagatgcatagccggggcaggggccggtgggggcaagggaccagccaggctcagccagcggtttcggagagaccagatgtgagcatctcccaacaccagagggagagggcagttccttggctgagagagcgagcactggagcagggccagggtcctttgcagaacgggctccagacagcagtagaagggctccagctccaaaaccaggaacgtttggtgtatgcgatggaaagcagagagcgggacaggcaggtgggtggaggtgaggctgtcgtccaccagggcaatcagctggggcttgaagagcgcctgagggtcacgcaggaggggctggtgaggccagggggcgcggatgtggttcccggaaggctcagagggcccgcatgctttccccacacccaggccgacctccctgcctgtctgctggaggatgcagagggccgtttcctccattctaagccctgaagagcagggcggtgcgtccctgcccacgtcttaggcggagagcccagacgtctgcattgtcccttcaagtcaaggctactctctctgtggagcacagagaggaatggggcggagggtgctggtgtcctctgtgaagctggcctttcgttctgctccctggcacaggctggctcaccagagggtaaaacgcagccccacccacccaaccgagcttcacccgcctgcctccctccagggaacctgatgccctggagctggagggaggaagggcagccccgggtcccagggcagccaaacctcagagttgagctctgtggccagggtgggacaggattgtggtctcccatcccctgggctgcgactcctcctgctggctcgcccagatatggatctgaggacagagtccagtcggtgggcacccagagatctggaaccacgggtagtgagtcaggctggccgcccagggtcactgcagcacgtctgccaggaagggctcttaccaccacgcacagagcacaggccaggccatcgaggggcctggttcacatcctttcctctctccctccccagacgatggtgccatcagggtctggaagaattttgctgatttggaaaagaacccagagatggtgaccgcgtggcaggggctctcggacatgctgccaacgacgcgaggtgggtccgcccggctcctccccagagcagaatgtgttcccggggctgcggacgcactcggaattccaaggcccttctggggctgtctctaaacaggctgctccacctcagagtccccagaatcctaaagcaacagctccccgccaatgtccccgaaagcgtgagagccccaggtccctgagtgcactgcctggctggagtcccagccctgggcatggtctcagccactcgtgggtgcccctgtccccaaccttcatccttggcttgcagacatgtgctgcttgggacagcatcactgctggcagggcctaaagggcccgcatcacggggtccttctttggacctaaaattaggtctgctctttggacctaaatttaactcctccttgggggtcggggtgcacatggccatctggggcctcacgcgctcgctggcatgcctgggctggtgggacggagtggctgcagtgccggctctgggcacagttctgcgtgttgcctgcaccgctgcacggcctgggtgcggggcgaggcgcaggcccacaggtccttctggaaggactcaggcaggagttaggaggctcccggggtcaggcttctgggtctggatttccagaggcccctctgcagcaccaggcattcgcctctaggagtcatcgctcttcagcggatcctgcagcccttggcgatgctcagagtgaacgcgttaccccgccagcccccctctgccggctcctgccggtttgtgatttctgtgtcttcgtctgtggcctgtggatgtggccttacacctcgtggtcagccttccgtgtggggcctgccctggttctgccctaggttgcatggctctgtctccgcccttctgtctgagcacctgtcccgggagatgccaaccctcacgtgcctcgggacgtcatgggggcagctccagggtggacattgcctcgaacgttggatttttttttttaatgtagccatgttcttaagtttcatccagcaaaaaaaatcatccacaccccgcactccgtgggggccctttcctgttgcttctgtcctgatctctgggctctgcttcccctgcgaggcaaccctcttctggggtatgacagcttccctgggacagggcaggaaaagtgagccccagcccggggccctggtccaggaggggtcccgggagacagctggatggccagcctgggggtcaggccactcaccggccattgtgtgtctctccaaaagaccaattttggtgacactgtgtcatttgctagagaggaaagatcactgtttgataggctttccaggctgtttttctggggtcgctcagaggcagtggtgccatggaaggagctgggcttcagcacgggagcgcctggctgagccctggctctgccttgccctttctcttgtttgcttttgtgaaaacttccctccctgtccaaggctcggacctgccggaaatgcagtgctggaaggacacacccgtggctagccccggggtccatgagacccccctagaagcatccacatgtccatgcccagctggccccggggtccctgagaccccccagaagcatccacacgtccacacccggctggccccagggtccctgagaccccccagaagcatccacacgtccacacccggctggccccagggtccctgagaccccccagaagcatccacacgtccacacccggctgggcctggggtccctgacacccccagaagcatccacacatccacaccgggccacgctgcaggaaacaagacttggtggcctgtgctgccccacgggctctcagtctctccgggtcaggatggcagtgcccagcttacatatcaggaagcagcactgacgagaaaagcggccttctcggcccagaccctccagtgcttccttcagagtgggagcctgtgctgcacttcaggggtctcggggtcagagaacgaggctctcaccgcgggggaaggcagcagaggcgtctcgccagacgtaagagctccaggccccagtccccgaaggctgtgccagctgtgggctggggcaccaggcacagctctgggctccctcaggttgcacaggacatgggaaacctgggtgtgggcagcaggcgggtgtgtcactgctgctgcggctttgctatgtgtccaggactggttcaaaccagttcactcggcatcacagaatctgaactgaaaaaggacttagggttcacctgactatacccctccatggcaggacgctcgggccgagggacagctgcccagagcctctggttcagatggacacctgaggcccagggtcgggctgtgccatgtcccccatgccggcatgtcactgtcctacccgggtacgtcggcctatgtgctggagacagggcctttacagaggtgattaaggtcaaaccaagtcaccagggtggccctaacccaatgtgcctcgtgtccttacaagaagaggccaccaggacacagacacacgtgcagggacaggtgggcgttcctgggacgccggctcggcactcacccaatgaggtcacggtgtcaagggagggcccgagttccagcaggttgctgggggatgtctcacgggcctgagggtaattatttgtcatcgattggagtcacactgcctaaatccagagccgtgaacgctgaccacagcacagccaccactcttcttgaaagtcacagtcaccaggacccagtgttggcatttgatagattaatggtattagcaggttggtttccctccgcggtattacatttaagggaataaacaactcacatgaacggccaagggctgaagacagaagtggtgctctccatcttcgtcaggtgctcacggagggcccacagcacatctgatctggtcaccacggggatccgtggagccgcagaggtttcatcctcccctggaactgaggagctcaggccctccgccagcttctgctgcagggagcctgcaggaggcccaaggcgtgacctccgcttgccccagcccccactcgcctctcccggacccgcttgcccagttgggcacacccagctcaggcacacgcaagccaggctccccacgtcacccctgagactggtgctttggaggctgtttcttgttttctggcatcttgaatgttctccatgtgctcgttctcaccttttccctctgtttgttctgctcgtgtcactgctgttcccagggcacctctctgttcttcccgacccaaggtgtcgcttcctggcagagtcaccaggaggatcgtgcctgggacgtggctgctgccccccaagtgaccatgcagtctagaagtgcagagcccaggcccatgcatctctcccttctctttttcttttcttcttttttttttttttttttttttgaggtggagtctcgctctgttgcccaggctggagtgcagtggcgtgatcttggctcactgcaacctccgcctcccaggttcaagcgattctcctgcctcagcctcccaagtagctgggactagagggtcgcaccaccatgcctggctaatttttgtatttttagtagagacggggtttcaccatgttggccaggatggtctcgatctcctgacctcaggtgatcctcccaccttggcctcccacagtgctgggattacaggtgtgagccactgcacccagcctgtgcattttccaagttgtgcagccaccacctttatctagttccagaagattctcaccactccagaaggcggcctgctgcccattaaagcagtttcttcccatagattcttatttatctatttttgagataggttcttgctgtcacccaggctggaatgcagtggcaccatcacggctcactgcagcctcgacctctcagggctcaggcagtcctcctacctcagcctcctgagtagctgggaccacaggcccatgccccacacccagctcccataagttcctcacttaaacagagagaaacttagaaaatgtctgtgccaagccaagccctctgtgcttgtggatctgccccaggtctcagagtggggcctcagggcctcctggcgcagcctccggatggccgtgcctccaggcaggacagcactgagccactaaaagggatgcaccaggaaccctgggcggtgtcctcctcggtcacccagacgccacttcccaagagcatgtccgggtgggcagcaagcattctttgtgattaatgtaggtaacagcatatcctgagggagggggctccagttctgtgtcctcaggctctgttggctgcacagctgcagcaggagctgggctcttctgggcagaaacggggaagtatgtgccctcccgcccggttgcacaccggccctcactgtgctcacaaggcctcccagcggaggagcagggctgcaagttgaaagcctgtgatccaccacggcgctcgtgcttctgacctgctgggacatttcttcctgcctgggttcaggtgtatcacagtagagggactacacttctttttttgtttgtttgtgtttgtttttgagatggggtcttgctctcactgcagcctcaaccacctgggctcaagcggtcatcccacctcagcctcccaactagctggaccacaggcgcacaccactgcaacggctaatcttttttcttttgagacggagtttcactcttgttgcccaggctggcgtacaatggcggatcttggctcactgcaacctccacctctcaggttcaagcaattctcctgcctcagcctcccaagtagttgggattacaggcacccactgccacacccagctannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnacgcctgtaatcccagaagccgaggcagatggatcactgaggtcaatagttcaagaccagcctgaccaacatggtgaaaccccatctctactaaaaatacaaaaattagctggacatggtggcaggtgcctgtaatcccagttactcaggaggctgaggcaggagaatcacttgaacctgggaggcggaggttgcagtgagccaagatcacaccactgcactccagcctgggcaaaagtgtgagactacatctcaaaaaaaaagaaagaaagaaagaaagaaatcatagacaacgggaataaaaactgcaagatacctaggaatgaatctaacaaatgcactttcttcacagatcaaagcataaactctaattgaagactataaaaggcacatgcagtgttcatggcaccatagccatggatgaaaagactcatcattgtggagattggcagttctcaaattaatctgtggatttattaatacacttttgattatattcccaggagagatttttataaaatgcagaccagccaaggcaatattgaagaggcgcagacagcattaagaagctgcaattgcagggcagccaggccaagaggcaccagggccctcagcgcagcagtgagcccagaagggccgcaagtggcagggtacctctgcgcactagggaaggagccatgttgctaaatggtgttgggacagctgatgccatatagaaaaggatgcagtgatacccctacctcacaccatgcacaaaacacatcacagtgagagacctaacctgtaaaagcctttcagagaaaaatcaagaggaaatcttcctaacagtgaggaacaaaaagacagattgaacaagagattgagggtaaagacatcaataggtttgactctacagacttcttcatgaccacaagaaaaatgtcacggttgtaatgtaagtggcagaataagaaaagatatttgcagtatctacgagttacagaatatatataaaaatatgtgcaactgtctgtcgtgaaaaaaaacggcaaacaccacacatcgataaggatttggggacattggcttgtgtgtgtcctgccgagagtgtagatggtcacccatttggggaatgaaatggccttccctggggagatcagagtcatgcaggatacatgactggcagttccgttctaggcgcttccttctccacccgcaaggacacgtgaagttgttgactgtgacatggttcacaaagccaggggcagctcaaatgacggggttagttgtacagtggaaggtaacgcaagattaaatgagttaaccagagctgtgtgtcttgggccagataaatcctcaaagcctaacattaaagaagcaagttgctagaaaataggccccattttgacactgaagaggttttttgaaatgtggaaggcatgttacgttgttgatgagcgtgcgtaagcaggaaaacctcagcagcccctgggaggcgccctcagcccaagggacagccctcccaggcaggcgcaggggcagacgatgcttttactgtgtctaaaattatgcttctctatgaaaaaaaaaaaagagcaaacaatggtaaaatgttagcaaagttagagctgagtggtgggtacaaggattactatggtgttcctttctgtatcttaaaatggttatcattacagttttagaactgaatctggttttaaatacaggccatcacgtgaggtgggggttgctctgctctgtctaatccccacacaaagggcagcccttgccccattctctccgtccatcccttgctgacgccagccgtcgggagtcagccccttgctgtctgaaggctgccggcccgtggcccatgccgagctcctgtttgtctcagaagaactggcttcctcaagctttgatagggccaaaaggaggaccctcatcttcaagccttaacagccttcctaaagtcacccagacctgccagttctgcccaggcgtccagacggcaggcatcttagacgtcgctgcaagggtctgctccagatggtgagcaccttagacagacgttgctggaaggcactgctctgaacggtgggcacctaacagacgttccgggaaggcactgctccggatgttgggcatcttagatgttcctggaaggcactgctctggacagtggacaccttagacagatgttcctggaaggctctgctccgatgttcctggaaggctctgctccgaacagtgggcaccttagacagacgttcctggaaggctctgctccgaacagtggacaccttagacagatgttcctggaaggctctgctccctctagcgatgcctggggcatagtcgagtcaggggaagactcagagttccagctcagaattgtcgccccagcctggacttgggagttccagctcagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccggcctggacttgggagttccagcttagaattgtcaccccggcctggacttgggagttccagcttagaactgtcaccccagcctggacttgggagttccagctcagaattgtcatcccggcccggacttgggagttccagctcagaattgtcaccccagcctggacgtggggcacaccagggtccctagcgggagctcatatgaggcatatggacccaccagatgggctcgatggtggcaggggtaccttgtagctgctggccaaattgctgcccagagcaggccccaaagcctgcccaaggcaagggcccatggggtgatgccatgtcccactgtatctctccaggagctgggatggtggtggactgggagcaggagaccggcctcctcatgagctcaggagacgtgcggatcgtccggatctgggacacagaccgtgagatgaaggtgcaggtaaccatgcaggtgtcccccaagccctgggcctgtggggcagtgtgtgcagggctggtcctcgtcacagaacccagcaaagtgtgcggtgaggcctggccatcccaggggtggagtcagggcctgggaggacagtgccgggacaatgctgggaggagacgtgggctccctgaggcctctggatgaaggtgaactgcaacacccagccctgcgctgcagtatggctcaggctgcgccagctctgagtgtttgcaagtagtgtcttctctctgcaaattaaggaatgtcagaaatcagtagggtgaccaattgtaaattagaatgattaattatttggaggcgtttttttttttcttttgagatggggtctcactctgtcaccctgcgtcacccaggctggagtgcagtcgtgcaatcacagctcactgcagcctcaacctcctggtccaagtgatcctcccacctcaccccccaccgcccaccaccaagtagctgggactacaggcatgcacccacacgcctggctaatttttttaactttttgtagaaacaggggtctcagtatttgcccaagctggtctcgaattcctggctccggcaatcttcctgccttggcctcccaaagcactgggattataggtgtgagccgctacagaagacagaagatttttgtttctttttttttttttttttttttttgagacagagtcttgccttgtcgcccaggctggagtgcagtggcgcgatctcggctcactgcaagctccgcctcctgggttcatgccattcttctgcctcagcctcccgagtagctgggactacaagcgcccaccaccacgcccagctaattttttttttgtatttttagtggagacggcgtttcacgtgttagccagaatggtctctatctcctgacctcgtgatccgcccacctcagcctcccaaagtgctgggattacaggcgtgagccactgcgcccggccagaagcctctttgcttcttaaagcatctgctattttcagttttgacaaaaagcggagtacattggttttgcccaagacagcctggaaaagtggtagagacctaagcaggccgcgctcagcagaaatctaactgcattgacttcatttggagcagaggcgagaccacagatactgtgaggggcagcgcctgaggtggctttagagccagtattcccttcctctgggtccccagggagaggtgtggcacagaggccatacccagcctctctcccgggcaggccatctggtgtcaggagggatggctcagccctgctgccgtagagggcggtgtggagcaggcccagcagaggggaggcctgggcaccctcagctgctcgaagctgctgtggttgctctgggcagcagcagcccgagaacctggcccaggccttcccgtgtgggcagcctcccctctgacgtgaccgtggatccctcgaggcaccagcagctttcatggcaccttctttggggtgggggggtcttgcacctgtctggagctgtggctccacacgagacgtagccctcagggcacagcgtggacaccctgatcctcagggtctggtcaccagtgggggcttagaggcccaggtggcctgcggggcaggtgctgttcctgcagaggtgggtggaggcacagagcgcagcaggtgctcccagagccggctctgcccctcgcaggggtctggccccatcatccccacgcctgtgtttcctcctggagtgcacaacccagcaccgcccatcgtgcgtggaaagcgctctccctctcgtggcccttttcctcctgcgtccctggcaggtgccatcgcccccgcccccgcttctccagcacttagagcccccgagggagccagatgacccctcctggactcgtcccatagctcattagaagttctgagacgcagccagtgaggagtccttgccaaaatgtgctttgctttcctttttaggaaacagagagaggttggaagtttaattggcactgacagccagtccttcccagaggcgtttgcaggcctccgctcggggtggggctggcctctgcctcactggctgggtcccaggcgcctcagggcctcagggctgtccctccagggccaagggataagggcgtgactcattgtcctgccagcccctgcctctccctgggactcctgggctccccaggcctttgatgcttccctggatagagagaaaggcccctgcagccagggagggtgatccccacagccaggcaggcagcaagaggggtcctggcgctgcaggacagcagggagggtggctcggtgccccggtcttcaccgggctgcctgtgtttggctctaggacatccctacgggcgcagacagctgtgtgacgagtctgtcctgtgattcccaccgctcactcatcgtggctggcctcggtgacggctccatccgcgtctacgacagaaggatggcactcagcgaatggtaccttgaccctgtcctctccctccccgagtgctggcagggtaccttccaggtggtagggccgtgtcactgccatttggttgggtccaggtttctcagtgagatgcaaagcttccccaggagcctgcagtggcgtatttaggccagtcctgggctccccaaagccgccaggcccgtcccactgaggcccatcccacaaaggtctgccccacagaggtccaccccacagcctatggaggagcacaggggacaggccatgtgggatgagccagtggactggaggcagaggctgtcggggtgaggcagggccgcagccaggcacctgccacctctgagctcacctgaacagaatactgccactgcctgccacctcctgggtcatgcagcaagtgtctggggagggatgtctgagggcacacacgtgggcacagcagccctgggcactgcctccactgagcacccctgtgggcaggtgctgtccgcgtctggcagaggacagggtacacgcatgggcacagcagccctgggcactgcctccactgagcacccctgtgggcaggtgctgtccatgtctggcaggggacagggcacacgcgtgggcacagcagccccgggcactgcctctgctgagcacccccgtgggcaggtgctgtccgggcctagcaggggacagtccgtcttggcccacacggctcatgcagcagaagtaaatttcacccagcacagagcgaggattcccagaaggtccttgtgcctccagcttcatcagctttaggtctgggattctcattcctgaccctccagtctgcacagatcggggagacacaatgaggagttttgagggaagcaaagcaaagggtgggcagggcctgggagcgctgcgatggccgcctggcccccgtctctgggcagcttccatgtggctcagacagtcctccagcggcctgacggtgacctagggcccagccctgagccagcctggggaggacacagggggtctctgctggagcaggtcacctggagggggctctgaccctgcgtgagcactagcccctcgtggggagcagacgggcgagggcctgcggacccgctggcacaggcagacctgggcagctcccggtgagagccccgaagggtggggacgtccttcagggaagccccacgctgagcgtgccccctcccctacagccgtgtcatgacgtaccgggagcacacagcctgggtggtgaaggcctccctgcagaagcgtcccgacggccacatcgtgagtgtgaggtgaggagcgccgatatttagcagccgttctgctgtaaaaacattattttcccctccatttaaaatacgtccttggtatttaaacagctggaaggggatggcatttcgggcagtaattaactcctgccctggaactggccagaaagatcaggcgcagcccgtaggggcccaggggccacagctgctcccctgctgggggacacctgacctgcaggcgctttgggaactttcctgggctgccaactgcggagggttccggggggagttgggcagctgctctccctccacgggcaggggtggcagggtggcaggggcggcgcgtctgccaggcacgtggcagttgtctgcacataaattcagttctgcctcttggtaaatacagcaccaagagcagggaatatttatttgcctattaaaggaagagcaagatgtaatttatgaatgcaaagccagcatttcttcaaagagatgctcttttcccccttgtttgtgatataaaaaccaaacataactcttgggatggacgcctgctgggggtggaaggcaggagccacggggcctcaaaagggccaggccatccctctctcgggccacagcctgccatccaggctctgtctcccgggactgcaggccccggttgcatgaaatctaatctctagctggaaatgaaaccaggagctcacagcctcctcccgcatctgtgctcatggtcatttctctaggccagaaagctccgcgccttttctggctctgagagagcttgtgggggacagccttggccctgagaccagtatgggtgcatgtctgggccccacctgggcagccctcactggggacgctgagcatccaggcagctttttccttgagcagtgtgtgtgcaaacaggtgtgcgaccccacacacctggttccaccgtccccctggccaggcccctcatggggcctccgggaggaggtgtcactgtgaccctctcttggcagcgtcaatggagatgtgcgcatctttgatccccggatgcctgagtcggtaaatgtgcttcagatcgtgaaggggctgacggccctggacatccacccccaggcggacctgatcgcatggtaggcgccacccacctccctggcctgcaccgctcacccgcctcgggcctctgtgcaaacgggaggctcttgtgttcctgcccccaggagctgaaggagggcaggggaggatttcactgctgtggggacataaaaacaaaagatgtctgcccaccacatcctcccaggataaactctcagggccctgccaggcccgagtcctcagtgagagtgaccagagggtcacacctgccccgagccagcctgtccccgtggtctagccggcctgtccccgcggtctcggcatctgcgcccatcttccatcctcaaagaagagggcagtgatgccgggaccctttctctccccacagtggctccgtcaatcagttcaccgccatctacaacagcagcggagagctcatcaacaacatcaagtactacgacggcttcatgggccagcgggtcggcgccatcagctgcctggccttccacccgcactgggtcagtgtggcggtgggtgggggtcgggggtcgggggctggggtagagggatgggaggcaaggggacaaggcagcaggggtcctgcctggctaccccacaccacagtggggcccattggctgcctgagggagggacttgcctgggtcccaggatctctagggcccctgccccaccctgcactcgccccggaagcagagccccagtcccgtcactccgggaggaattgacacacagtggctggggcaaagctcctgccctcagaccctgcactaaagccatccctggggacctccaggagagtcgctcggggtgtccatccctgtgcggccctcaccccgtcccctgtgcggccctcaccccgtcccctgtgcggccctcaccccgtcccctctgcggccctcaccccgtcccctgtgcggccctcaccccgtcccctgtgcggccctcaccccgtcccctgtgcggccctcaccccgtcccctctgcggccctcaccccgtcccctctgcggccctcaccccgtccgctgtgcggccgagtcctcaccctgtcccctgtgcggccgagtcctcaccctgtcccctgtgcggccgggccccacctgcacggctctctggccttggttgcagcctccccacgtggcttcaggccgttgtttttagattaggattctgcccacctgccgccttgtgttgtgaggctccaggcatgtagctctgctgacacgtgtgacattggatcccagagctgccccgtggggcagtcctgaaaaaaccacgcagggcccggggcagcgccacgcccctcacggagtgcaccatgcatgggccctgcagaggactggtgggaccggcccggcatttctgggcctgaggtgggcgtgggggttcctgagaccccggcaggagctgcctaaggatgcgggttggcctgcgcccccccgccccccgcagtgtctgcccgcacctgaacccctgctcaccccttctctctccttgcagcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaacccccagacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagaccccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagactccgcggctggcggctgtgtctttaaggaaactgcccaccccaccgcaggggggcatcggtcagagcagagctctggggggtggggggacgttgcccgggtcccccctgctgtccccagggccaccagcagctctgcgtcccgggtgctctccaggcaggcactgtggccacaggggacctggcacgtcgagtgtgcaaaggtctcggtccttttctcccaggcagtgcccccagccctgtggcgcagaccccacatcagggagcgtactgtgtggcaagagccatcttgtgacgtaggccagacacgtgtctttctctttaaaatgacggttatcctctcacggttagaggccccattcaagtctgcattgaaatctgggccacgtcagagttcctgggggagaagccgcttccccgctcctccccacttctggaggcccccactctccttggctcgtggccccttcctccagttcagggcctctgacccacgcccaccgtcaccacttctcatgcaggccagaagtgtttccaggcctaggggccgtacccacctcgggctgtgtgggtccttagccctaatcacatctgcacatccctctggccaactctttttgggtttgctttttgttttgagatggagtcgcacgctgtcacccaggctggagtgcagtggcacgatcttggctcacctcaacctccatctcctgggttcaagcgattctcctgtctcagcctctcaagtaactgggattacaggtctgtaccaccacacccagctaatttttatatttttggtggagacggggtttcgccatgttggccaggctggtttcgaacttttgacctcaggtgatccacctgcctcagcctcccagcgtgagccaccacgcctgtccccgtctggccaattcttgaaaggctcccgtttccagatcacactctgctctgcaggtcatggcctgtcccttgaggtttttcccaagcaggaaggtccgtgcagggattgggagccagggggaatgttgtggaagccacagcagaggcaacgggcctgggcatggtcctgcggggcgagtgggaggcaagggtccgtggggatggtcatgtcagccacactgcaccacctcaggggcctgacttctggagagcttgggaacaggctcttgtccccccggcccctctcacctgccgaccagaaattgggtctcgggcactgagtagcttgcccaaagccctgcctgttgggtggtggcagggactggggtcctaaccccaccccaaggccatgtgcggagacctttactccaccacttgggctggggggtgtgttggggctgggggagccacgcactcgggacctacaggtgctgcttgtgcaagccccgccccgccctagagcaggcctgcaggagtggcagctcgggactcggatgcaccagggcgatatgtggagcaaccagccccgctgcgcacacagagggggcgcctgctacccgctgggcccccacccaccacggcctcatcaccagggctcgtggctccttgaggacgtcccctctcactcagtgctgcactgaatggcccttcggggcttccctcgtgttcatgtcattcctttttccaggatagattctggcacccactgcagcctgggccctcctcactgagcccggctcgcctgcctccctcctccactttttttttttttttttgacagggtactcactgtcacccaggctggagtgcaggggtgtgatcatggccactgcagctttgacctaggctcaagcaatcctcccacctcagcctcctgagtagctgggaccacaggcgtgcaccactacactcggctgatttttgtttactttttgtagagacaggactcagtctcactatgtggctcaggctggctttgaagactcggtctcactttgttgcccaggctggcttcgaactcctggattcaggggatcctgctgcctcggcttcccaaagctctgggattgcaggcgtgagccccacgctggcccctcctccacttttaaggaccttgtgatcacactgggccccccgggatgctccagggtcaccaccctagtttaaagtcagctgatccaaccttatttcatctgcaacctggatcccccgagccaggtagtcacaggctcccactaggatgtggacatcgatagggaacactatgctgccaaccaacccctgtctacaagccaaagagcatcccaccaggtagagcccacgaacactcaggggtcttgggcaggaggtgggtggacacagggcgggaaggagatgctcagtggggttgggggaagcaccggccgcgatgggcctcccagatctcagggccaaggcatgggaagctggcaccatgtccgggtccttggggctgtcggtaaacaagtggatcccccatgacacagcagctgctcccaagccccagccggggccggaacacagggcacgagcagttgccatggaatcctggaatcccgcgctgaattgcagtttgtttcaggcaaggacgcccggcactcacgcagctgtgccaggcgggctcctgttgagagagtcatatttttcccattagcaccagtttttctgtcaccgagatgagtacaaatcgagttcttgtaaacatggggatgggcacgctgtagaagccagcctcaggggaggccagggctgagccaggcccacacctgcccctgccactgccagaccccgtgtagttgtggtgaaggggccaggcctggtgatgccatgtggaggaatgctcagccttctggcgaggggccggtgagggccaggggtggccatgggggctcctgctcagcatggctctgctgggtgagactgcaggcacctgccagatgggcagctgtggcttccaacacacgtctgtgcctggcccccttccaggggtctcggcggatagccctcgggaggcggcagagcagttggcctctgggggtctgtgtctcagactcagttaccgggtggtccggagcccacacgtccccagacaggacagagcctcagagtcaggcacagaccaggaaggaacccttgaaggacacagggcgggcggggaggccagagtgggggccgagcaggacctcccacatccgcctgcggaagccccagtgcccggaacccctgcacccgggcctgcggctgtatttggagacagggcctttgcacgggtgagtatggtgaaatgaggtcaccagggtggccccaatgcagtaggactggtgtccttataagaaggaagattaggacacagctgtgcacagagggacggccacacgaggacacagcctacctgccagggagagtggtcccggaagaagatagccaagaggcccctctgtctccaagtccagcctccagacagggcgggtggagagggaatacaggcctgccgctcaggctgccgggcccacggtggtttgcttggtggccctgggacactggcgccaccatggcacctccaagccccagcctgtccctcactttaatgtggggacagttactgcaggcatgagtgctgtgagcaccaaacaagaccacagaagcttccagaacagcactggcaccagggaagcacccaatggacactgtccgaggtcacctgaggacttcacaactgcgggtgccacagggcttgggagctgggaagaacacagctctttgccacagctcagccgatgtcaagccccagggctgcatggtacccgcctggaccatcagaggagagcagaccctgagctgggcctggtcacctggtgccacccagctgaggccatgtcctgtcggtggctcctgagctggaggaggaagagcccaaccacatgggccctgcctgtccttccccctcctccaccttgggaaagaacctcactgcagctgttggggcggcttccctgcccatcccatcctccctccggtgcccaccccgtccgcctgactgccgcctcctctacataatgagctagagggtccctcctcctgagctccacagtccctgcgctggccctgccgtcccaggagcaggagcagccacagggctcctggggctctgaggctccatccgctgttgtgtgacccaggcacagtgtccacggaacacaggacgagagttacacacccagccccgccacaccactgtgaggacagagaaggcatggcgtgacctgccacctggtggagggctgcgaccatggagggtgctggatgcacctaccctgccctgctgcctggaagggggtctctgctccccagggccgggggaccatgagttcacctctgtcatcagtgtcagcatgacaaaccccactggtgccgctcacagcaggatcccacatcccaggccagccccctctgccatgccacctacctcacagccagaggtgggaacagcaactctggggagaactgagggtgctgtggccaccgggtccctgaggctcacggaggagagtgaggcgaggagaaccatggagctgggccctgccttgggaaccaagcactcgccctttgcagctgcagagccgtcctgatgggcaggcgggggcggggtcgctgtgtagctgtgcagagagcgctccgaatgggggtctgtcaccagctcccaagctcgtgggttctcccaagattcttgtggcacatgattcattgcctttcttaacagcatcgctgaaaggagaaaaggccctttggaaattgattgcagtccctggatgtgtctcttggagcacatgtccctcggttcccacttggcaaaccaggcttcatgtccccaagacagggccaggcagcccatgcgctccaccccctcccccgccagcctgcacatcctcccccatcgtccatgcagccccccagacgcccgctgtccccggccctgggtcctgacgtggcgggaaaggcagttcaggaccccccacctcccacctccctatccgaaacccagccctcactccccagaaggccatcactgcagcgtcctccaaacagcctgtggccccacaggcatgctctgagtttgcttccaggggccaggaagtgaggagcccccagtgctgaggccagggacactcatgcagggctcatggccaccagcgacagccaccaaggtcactgcccaaggctgcttgagccatcctgccaggtggcctcctgggcccagaaggctgatgtcacccacggctcagcatcggagggcagatgccatctgatgaggtcagaagaactgcccagaccccaggacccccactcagatccccacagcctggtgaggtacagaaccacagccgcatctgcagggggaggcgcaggagtactcagagctgtgggttcccctctggcctcccctcggaggctctcccggctgccctccagggtcatccaccatccaccgcaggcgagctggaggggtggatgggaaggctttgcctgagggtgtaagcccccagggccctccagggaggacaagctgcgcggccgggaagctccgcagcctccaacccagggctggcaggagctgggggctgggggctccccacatggggtcccaggctcacctcccagcagggggaggcccagagagctgcccgcacaccctcaccaactgctccccagtcctggcccctgcctggctcaccgtggtcagtttgcccccacagagaaccagcccccaactgccagctgcttccaccttcagcagctgctgggggccaaccaggttccaccctgtagccaggggctcctccaaacccagcgatgggggagccagccctgaaagcaccagccccagggcagcacagggcctgtcacaggcccccagcaagcagcccgggatccaaggtgccagggagtccaagagcaaggcacactgggtttaccaaccacaaccccctccatgccctctgtgttagaaaaagaaagaagaaaaggcagcaaactcagactgtggagcgggagcagccaccacctgcatggagcagaggcccaggtgggcatggggatctggaccagcagagccttcctgggctgcgcaccccatccacgtgggagacaagagcttaagggctcccagaaaggctcccaaccatagcagcaaggaggggctggatgcaggagagccacagagtttgtcgctggtacagtggcatgacctgccttgcaggaggaggtgcctgtgggcggtaacacagccgcccccatcttcatactctgagcccagcttctcccctaactggaagacccagatgaggcactgctgtcaacccaactggctatgaaagccctgaccacgtgcaggatgcccatcctcacagcctgtaaagggaggagaccgtgccgggtgcagtggctcatgcctgtaatcccagcactttgggaggccgaggcaggcggatcccgaggtcaggagatagagaccatcctggctaacacggtgaaatcccatctctactaaaaatacaaaaaaaaaaaaaaattagccgggcatggtggcgggcacctgtagtcccagctactcaggagactgaggcaggagaatggtgtgaacccaggaggtggagcttgcagtgaaccgagatcgcgcccctgcactccagcctgggcgacagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccacgttcatggattggatgacctaatattgttaagttagcaatactccccacaatgatctacagattcaaggcaatctctatcaaaattccgatggcctttttcacagaaatagaaaaaccaggctaggtatagtggctcacacctgtaatcccgacactttgggaggcggaggcaggtggattgcttgagcctaggaattcaagaccagcctggacaacataacccccattctacaaaaaatacaaaaattagccaggcatgatggcgtagtagtcccagctacttgggaggctaaggcaggaggatcacttgtacccgagaggttaatactgcagtgagccgtcgtcacaccactgcactccagcctgggtgacagaatgagaccctgtctccaaaaataaaaagaaaaaagaaaaaccaatcctcaacttcaaggggcctcagagagccagaacgatattgtaaaagaattataatatcataaaataatattgtaaaataattttcttcttgcaaaagaaaaaaattagccaggtatagtggcttgtgcctgtagtcccagctactgaggaggctgaggtgggaggatctcttgagcccgggaagggagtccagcctgggcaacataggagacgccatctctaaaaagtaaagaagaaatagtgttggtggggggaggaagaaattagaggattcacatttctcaatctcaaaacttactacaaaactatgtggtactggcatagaatagacatacggagcaatagaataaaatagaaagcccagaaataaacccgaagatctaatatgactgatcgatttttgcaagggtgacaagaccattcagtggataaagggtaaagaatggcctttttaacaaatgatgcgggggcagttggagatttacatgccaaaagcaatgacgctggactcttacctcataccatgtactgaaaactaattcaaagtggatcaatgacctaaatacatgaaataaaattataaaacagctagaaaaaaacatagaagtcaattttaatgaccctgggtttggcaatggattcttagatttgacaccaaaagcacatgcaacaaaagaaaaaatagataaattggacttcataaaaatgaaaaacttgtgcatcagaagacattatcctgccaggcacagtggctcaggcctgtaatcctagatctttgggaggctgaggcaggaggattgcctgagcccaggagttcaagattcaagaccagcctgggcaacatagcaagaccttgtctctacaaattaaaaaaaaaaatagctggttgtagcgtcacgtgcctgtggtcccagctacttggaaggctgaggcaggagaatcacttgagcctgggaggttgaggctgcagtgagctatgatcacaccactgcactccaacctgggtgacagagccagacccctgtctcaaaaaagaatgtgaaaagacaacctacagaaatggattaaactatttgcaaataatgtatgtgataagggtttaatatccagaacatataaggaattcttacaactcaacgacaaaaagtcaaacaacccaggccaggcgcaggagttcacacctgtaattccaacattttgagaggccaaggcaggcggatcacttgaggccaggagtgcaagaccagcctggccaacatggtgaaaccccgtctctactaaaaacacaaaaattagccaggtgtggtggtggacgcctgtcatcccaactactcaagaggctgaggcaggagaatcgctggaactcaggaggtggaggctgtagtgagccaagattgtgccactgcactccagcctgggtgatagagcaagtctccatctcaaaaataataataataataataagccaggcacggtggctcatgcctgtaatcccagcattttgggaggccgaggcaggcagatcacaaggtcaagagattgagaccatgatggccaacatggtgaaacctcatctctactaaaaatacaaacattagctgggcatggtggtgcgcacctgtagtcccagctactcgggaagctgaagcaggagaatcacttgaaccagggaggtggaggttacagtgagccgagatcgtgccactgtactccagcctggtgacagagtgagactctgtctccaaaaaaataaaaataaaaaatacaaataaaaaaattttaaaaagacaagcaacctaattttaaaatggtcagaggatttaaataccttctccaaagcaggtgaacaaatggccaataagcacatgaaaagatgctcattaccagtcattagggaaatggacatgaaaactacaatgag

SEQ ID NO: 455 - DNA, 7049 bp, Homo sapiens
gtttcatttgtaggattgactttaataacacgcctctactgaacaaatggcgattaactggggaaaacggaattatggtaaccgaggtaacggggtcggggactctttctccttcgctgcatgctgggtggcggggagagaccgctctgaggaggtttggtctgtcggccacgccgtaggccgcggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatgggccggtcgtggctctggttgcagcagctcagacgagtgcgggacccgcagggctgagagtggctggaggagacccagggccctttgaacccgatcccttggccggagacctcagcccagtcggcccagtgggcgaaccggcaccaagagcggcctgcctgtcttcggaactgctgaggcggtggaggccgagagcagggtcatcgtgaggcctgaagtctcttacgcttttggcagctcccctcgcagcccctctggaaacgtacagcctcaggagcagccagtggcttgggacctggggtggtgtgtgtctgcggagcttcttgggctgccccatttcctagcggcccccacctccccacttcccgctcagagttagagataaggatctcagacttttgcctgagtaagggtctccgcactctttatccatttggttttcgatttcccgtttttgtttcttatttcaccaattctggtacacgctagtttttaaggctggaggttctcgagcgcttgctgccaaggactccccccaccccctcccccactgatggagtccgaaatgctgcaatcgcctcttctgggcctgggggaggaagatgaggctgatcttacagactggaacctacctttggcttttatgaaaaagaggcactgtgagaaaattgaaggctccaaatccttagctcagagctggaggatgaaggatcggatgaagacagtcagtgttgccttagttttgtgcctgaatgttggtgtggaccctcccgatgtggtgaagaccacgccctgtgcacgcttggaatgctggatcgatcctctgtcgatgggtcctcagaaagctctggaaaccatcggtgcaaatttacagaagcagtacgagaactggcagccaagggcccggtacaagcagagccttgacccaactgtggatgaagtcaagaagctctgcacgtccttacgtcgcaacgccaaggaggagcgagtcctctttcactacaatggccacggggtgccccggcccacagtcaacggggaggtctgggtcttcaacaagaactacacgcagtacatccctctgtccatatatgacctgcagacgtggatgggcagcccgtcgatcttcgtctacgactgctccaatgctggcttgatcgtcaagtccttcaagcagttcgcactacagcgggagcaggagctggaggtagctgcaatcaacccaaatcaccctcttgctcagatgcctttgcctccgtcgatgaaaaactgcatccagctggcagcctgcgaggccaccgagctgctgcccatgatccccgacctcccggctgacctattcacctcctgcctcaccacccccatcaagatcgccctgcgctggttttgcatgcagaaatgtgtcagtctggtgcctggcgtcacactggatttgatagaaaagatccctggccgcctgaacgacaggaggacgcccctgggtgaactgaactggatcttcacagccatcacagacaccatcgcgtggaacgtgctcccccgggatctcttccaaaagctcttcagacaggacttgctggtggctagtctgtttcgaaattttttattggcggaaaggattatgaggtcgtataactgcactcccgtcagcagcccgcgtctgccgcccacgtacatgcacgccatgtggcaagcctgggacctggctgttgacatctgtctgtctcagctgccgacgatcatcgaggaaggcactgcgtttcggcacagcccgttcttcgccgagcagctgaccgcattccaggtgtggctcaccatgggcgtggagaaccgaaacccacccgaacagctgcccatcgtcctgcaagtgctgttaagccaagtgcaccggctgagagcattggacttgcttggaagatttttggacctgggtccctgggcagtgagcctggccttgtctgtcggcatcttcccctacgtgctgaagctgctccagagctcggcccgagagctgcggccacttctcgttttcatctgggccaagatcctcgcagtggacagctcgtgccaagcggacctcgtgaaggacaacggccacaagtacttcctgtcggtcctggcggacccctacatgccagctgaacaccggaccatgacggctttcattctcgccgtgatcgtcaacagctatcacacggggcaggaagcctgccttcagggaaacctcattgccatctgcctggagcagctcaacgacccgcaccccttgctgcgccagtgggtggccatctgcctcggcaggatctggcagaacttcgactcggcgaggtggtgcggcgtgagggacagcgctcatgagaagctctacagcctcctctccgaccccattcccgaggtccgctgcgcagcggtcttcgcccttggcacgttcgtgggcaactctgcagagaggacggaccactccaccaccatcgaccacaacgtggccatgatgctggcccagctggtcagcgacgggagccccatggtccggaaggagctggtggtggctctgagtcatcttgtggttcagtatgaaagcaatttctgcaccgtggccctgcagttcatagaagaggaaaagaactacgccttgccttctccagcaaccacagagggagggagtttgaccccagtgcgagacagcccgtgcacccccagacttcgttctgtgagctcctatggaaacatccgtgctgtcgccacagccaggagcctcaacaaatctttgcagaacctgagtttgacagaggaatctggtggcgcggtggcgttctcccccggaaacctcagcaccagcagcagcgccagcagcaccctgggcagccccgagaatgaggagcatatcctgtccttcgagaccatcgacaagatgcgccgcgccagctcctactcctccctcaactccctcatcggagtttcctttaacagtgtttacactcagatttggagagtcctgctgcacctggctgctgacccctatccagaggtctcggacgtggccatgaaagtactcaacagcatcgcctacaaggccaccgtgaacgcccggccgcagcgcgtcctggacacctcctccctcacgcagtcggcccccgccagccccaccaacaagggcgtgcacatccaccaggcggggggctcccctccggcgtccagcaccagcagctccagcctgaccaacgatgtggccaagcagccggtcagccgagacttgccttctggccggccgggcaccacaggccccgctggggcgcagtacacccctcactcccaccagttcccccggacacggaagatgttcgacaagggcccagagcagactgcggacgacgcggacgatgctgctggacacaaaagtttcatctccgccacggtgcagacggggttctgcgactggagcgcccgctattttgcccagcccgtcatgaagatcccagaagagcacgacctggagagtcagatccgcaaggagcgggagtggcggttcctgcgaaacagccgtgtcaggaggcaggcccagcaagtcattcagaagggcattacgagattggacgaccaaatatttctgaacaggaaccccggcgtcccctctgtggtgaaattccaccccttcacgccgtgcatcgccgtagccgacaaggacagcatctgcttttgggactgggagaaaggggagaagctggattatttccacaatgggaaccctcggtacacgagggtcactgccatggagtatctgaacggccaggactgctcgcttctgctgacggccacagacgatggtgccatcagggtctggaagaattttgctgatttggaaaagaacccagagatggtgaccgcgtggcaggggctctcggacatgctgccaacgacgcgaggagctgggatggtggtggactgggagcaggagaccggcctcctcatgagctcaggagacgtgcggatcgtccggatctgggacacagaccgtgagatgaaggtgcaggacatccctacgggcgcagacagctgtgtgacgagtctgtcctgtgattcccaccgctcactcatcgtggctggcctcggtgacggctccatccgcgtctacgacagaaggatggcactcagcgaatgccgtgtcatgacgtaccgggagcacacagcctgggtggtgaaggcctccctgcagaagcgtcccgacggccacatcgtgagtgtgagcgtcaatggagatgtgcgcatctttgatccccggatgcctgagtcggtaaatgtgcttcagatcgtgaaggggctgacggccctggacatccacccccaggcggacctgatcgcatgtggctccgtcaatcagttcaccgccatctacaacagcagcggagagctcatcaacaacatcaagtactacgacggcttcatgggccagcgggtcggcgccatcagctgcctggccttccacccgcactgggtcagtgtggcgcctcacctggccgtgggaagcaacgactactacatctccgtgtactcggtggagaagcgtgtcagatagcggcgtgacccgggcccaccaggccacggccgcctgctgtacatagtgaagctgtcactcgccggggcacggggcgtcggctgctgcggccccgcagtgtgaacgttggctgctgccttagctgctgatgacggcaggagggccctgctactcgcttttgtctgtcttcgctgtcgtgtctggaatgtcagggaaggggagggctcgggttgacggtggcttcccactgagcaccagcatccaggtgcacccccgcggccacggcgcctctgtccctctcctgttctgtgtttctctgagacgctgaaaggggaaacacctcactttatttccatgtaatcagagcattagctgcagaaaaacccccagacagagccctggcggagaggcaggcgctggggctcctacgggtccctggggcagctgtccccatcaggccaagagcgagcgagaggcgctgccccagccaggcccaccacctctcacagtcagtgcacgcaagcagggacatttcctagccagctgggggacactggaaattcgggaaaccaagagagaggaagaaggagacgcccctccaactggcgggtgtgaaggaagccgcccaggggtccgggctgtccttggccgctggcagcatcactgagcaggaagcgcacagcccaccctccccgcacctccaggtctctggactccagttttggcccctctcacacagagctgtcagcaggggccgctgtggcggtgcacaggggaggcaggtccttggcgaggtagcccctgccttaatccacggggctcctttccctccgaagggctgctcttccccacaggcgcggggacagcagcccgacctgtggtctccatgcctgtgccctcacacaggtgtagcacacgcatgtgcagatggcaccacggccggcacctgggggcacacacatgcaggcggcgtggtctccctgctctgtccccacacgttcctcacatacaggcaagaggcactgccgggtcccggacggctccgggtgacaccagccccgtctccagccttgagccgcccatgctgatgcgacctcggctgacagctgggcctgtggtgcagacaggagctgtgtggacagtcccgcccaggaggggccgcagggcgtgtatgagcagttttgcaaacagaacacaaccacaatgatggtattttgaaaagtgttctttccgtgttcgtcgggaatcaggattattgagaggtgaaggagccaggtggcttcattctggcggtgagaggcccatgaccacgggagtgagagctggtgtggcgaggcccggctctcctgcggtgtggctggtggcctgccgtggccaagagcatcttctgggtggatggaaccctgcctggtcacatttggccagagacacacctggccctcagggggctgagctggagactgagctggggctggccgggacgtgacaaggcaggacagaggcggcccctccgctgctcctttttggaatgcgagctcccaccagaagaaggttccggcacgaatcccatccccacgtctgggccgagaaagcagcccgggtccggaaggtgtagagagtcccggcctcactcagctcacagggcgtgccaggcggcaacaccagaatcttccagaagcccagctccacccgcacacgcagcttcccatccagtccttcaactcaattcttacccaacacgcgtttctgtttgttttgagacaaaatcaccacctgtcaaaaggcaggtggctccagaggggtcaagaccccccccccgcccccgctccaccctggagcccacccccatgggcaccgcgtgccgcctgcacgtgggctgtcttcacaggtctgatgtgaaaattcaatcacgacgttaaccggctcgagagagcgccggcctagaggctcattatctatttattttaccaaacgcgaattgagacggactttgacaaaacacgaaatggtaatgtgaagctaagagcagagagtgaccaacagtaaacaacacgcgcagac

SEQ ID NO: 456 - protein, 1358 aa, Homo sapiens
GWRFSSACCQGLPPPPPPLMESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMIPDLPADLFTSCLTTPIKIALRWFCMQKCVSLVPGVTLDLIEKIPGRLNDRRTPLGELNWIFTAITDTIAWNVLPRDLFQKLFRQDLLVASLFRNFLLAERIMRSYNCTPVSSPRLPPTYMHAMWQAWDLAVDICLSQLPTIIEEGTAFRHSPFFAEQLTAFQVWLTMGVENRNPPEQLPIVLQVLLSQVHRLRALDLLGRFLDLGPWAVSLALSVGIFPYVLKLLQSSARELRPLLVFIWAKILAVDSSCQADLVKDNGHKYFLSVLADPYMPAEHRTMTAFILAVIVNSYHTGQEACLQGNLIAICLEQLNDPHPLLRQWVAICLGRIWQNFDSARWCGVRDSAHEKLYSLLSDPIPEVRCAAVFALGTFVGNSAERTDHSTTIDHNVAMMLAQLVSDGSPMVRKELVVALSHLVVQYESNFCTVALQFIEEEKNYALPSPATTEGGSLTPVRDSPCTPRLRSVSSYGNIRAVATARSLNKSLQNLSLTEESGGAVAFSPGNLSTSSSASSTLGSPENEEHILSFETIDKMRRASSYSSLNSLIGVSFNSVYTQIWRVLLHLAADPYPEVSDVAMKVLNSIAYKATVNARPQRVLDTSSLTQSAPASPTNKGVHIHQAGGSPPASSTSSSSLTNDVAKQPVSRDLPSGRPGTTGPAGAQYTPHSHQFPRTRKMFDKGPEQTADDADDAAGHKSFISATVQTGFCDWSARYFAQPVMKIPEEHDLESQIRKEREWRFLRNSRVRRQAQQVIQKGITRLDDQIFLNRNPGVPSVVKFHPFTPCIAVADKDSICFWDWEKGEKLDYFHNGNPRYTRVTAMEYLNGQDCSLLLTATDDGAIRVWKNFADLEKNPEMVTAWQGLSDMLPTTRGAGMVVDWEQETGLLMSSGDVRIVRIWDTDREMKVQDIPTGADSCVTSLSCDSHRSLIVAGLGDGSIRVYDRRMALSECRVMTYREHTAWVVKASLQKRPDGHIVSVSVNGDVRIFDPRMPESVNVLQIVKGLTALDIHPQADLIACGSVNQFTAIYNSSGELINNIKYYDGFMGQRVGAISCLAFHPHWVSVAPHLAVGSNDYYISVYSVEKRVR

SEQ ID NO: 457 - DNA, 30072 bp, Mus musculus
  misc_feature (1)...(30072): n = A,T,C or G
cctggtcacactttggcctccccttcctggtccccagaactgtgaagattaactcttgtggttttgagccgggtctgctggccatttctaaccatgaccctaggaaacattgtggaaccttcgggtgtcaggccaaggggcagggttactggtgaccaaggtgacagacaggaggccatttctcggctgagtgtgcaggatgatgtggggagtggtgggctctggggtcttctttcaggacagacgtgtcatttgggcaggatcggctcctctcctgagtggagagtctcctgagctatgtggtcattcatcctgtattgccatttacctgtgacattcttgctatcattagtccatgagcagggttagcaaagcctcactcagtctggtgggctggagaatgacagccatggggacagctagtgtctctatacccctcccccttcttttttcttcatctgagacaaggtctcctgtagcccaggctgaccttgaacttgttatgtagccaaggatgactcctgatcctcctgcctccagcttccccagtgctgggatagaccgttccctttccttcttttctgaattaccattttactttctaatataaacggaaattcaggattcatggaagaacaaacaacaaagataaaaatgtagcaggttggcgtggtggtcttgataatcaaactgatacactacgcctatcaggaaatctgaaaaaaaaaaaaaaaagaaaaaaagaacatggtgagagcaaactttaattgtgccatctagaaatgtccgttattataacatccatagcatgagtatatggattaaatctgtaaggtatgttttatatgatgtcatattgacagcactgaacatcatgttcttcatttgatgtatatactatgaacctttttttcctagttattaaatacttttatgaaacattttatagcaactgaatggaatggggtcctatgaccttaccaagcccgtctggtagtgacactgagctggtattggtgtgtgtctaaagcctccacggtggctcaggggtcaagctcttgccactctggcacaggacccaagtttggttcccagcacccatgtcagacagctcacaactgcctgtgactccagctccggggtaactgatgctctttttgacctcagcaggcagtggattcacacacacacacacacacacacacacacacccctaattaaaaataaattaaatccgagctggggagatggtttaatagttaagacccaggtttgattcccagtacctacagggcaactcacaaccatctttaactccagttccaggagatccaatgccttcttctggcctctgagggcttcacccgtacatatgatgcacaggcatgcatgcaggcagaacactcctacatgcatacaggcagaacactcctatacaaaaaataaaaggtaacaataagtaaagttttaagaaataaaaaaaagaatctatcccaaaagctccactggatagtaactgctgttcagtagtgcttgcgtgtccaacacatgcagtttggccagtgttggcgagtatggtgcatcgctgagcagccttaccacagctcagacaggaagcgctgtctctgcgtctggtacccctcccggtcctgccctgcgtgactcacctgcaccctagcaacagtgacacggagtgagccagagacacaagccacaaaaggaaagaagacagatcagaattcgaaatgtgtgtgtgtgtgtgtgtgtgtgtaagttggtacatcaaacacaatgcaaaaacgaaacccacagaatgcacaatggaaaataaacttagaaatcacacatctagttaagagattgatatccaggatatatagactttctaaagtccccaaatgagacgtttccccaaagatactcaaacaggtagcaagcaggagggcaggtgtcactgaggaaagctacccaaagctgcagggagaggaccccaggctctgcatggctgtggtaaaccagaggagaccattacaagggttggtgggaatgcagagaaagcagaaccttgtgtcgtgtgggtggggtgaacacagctcccacttctgtgggagatgggggtggggggcacttcctcagaaaaacctaaaaacaatgatttagaaattcctcttcagggcttgtaaccaaaaggtcagctagcagagattcgagggggtgctcgtgttaaagaagcatcaggacacagtggacaggcagacagacagacagacagacaaatacgctgaagtctgtccacttcgtggaatgtcgctcctccttggagagccttggagaccacgtgctcagtgaaacactccagtcacagaagggcgagcgctgcatccgccacctggatgaggcccttggggcagccaagttcacgtacacagagcataggatgatgttgcagggatctagacggcagggaagtgccaaagaatttcattgatatcacagcacctctgttgtatacaaccagtgttccgggggaggcagagagtggctgcatggttctgtgattcactctgtaccgctgaacactactctcaaagatgattaagccaggggcctggaggggtggcttttgtgattaagagcactggctgttcttgcagaaaacctgggttcaattcctggcacccatatagctgttcacagctggctgtaactcttgttctaggggatccagtgccctttcctgacctctttgggaggcaagcatgcagtgtgcaactatacatgcaggcaaaagacatgtacacataaaattatatttaaaaatctaaaaaatgcttaattcagggaatttgatattttgggaagtcaggcccatttgtacagacctgtggtcctagctactcaggaggctgagacaggggaattgaaactgcaaaatagcctataaaactcagtaagactctgccccaagtaaaaagtaaaaagagggctggggtatagctccctgttagagcttgcctaagaatgtggatccagtccccagtaaaacattctcacgagtgcatgtacacacacacacactggacacacatacgcacatacacagcacatatacacactgcacacaccatactctgcacaaaccacacacacactgcacacacactatgcacataccgcatatatacacacagcacacacacttcagtttctgtcgttttggggttagtcatttgggtacatttgtgtgcagatggcatcgaacagtgagtgtgctctgtttcgatctggctgtttttgctcagtgtaattgcctgtgttgtgttgcctgtgtgtctgtggcctagctcttgtcactgaatgccttttgtggcctatgcaccacaatgtcaatcttttcggttgggttgttctgggtcttggttctcaggcttagagcactgtacacatgggcctaagtaacagtgtcttcccacacagcaccgaggagcgcagtgtctgattgtgcaagcagagacttgccgcttgccccaggctacccttgaatcacagtcctcctgcctcagcctccccaagatcaggattacaagcctgtgcagcctcacccggctgagtctgtatgtaagagtttcttataaatattcaagacacgagttcagccggacatatgttttgtgggaattttctctcaggcggtgacttcctctctttctttgtctttttcctttgatgaggatgctttgaagaggagttttcttcttttattacctttgtggttcgtagggtgtatgccaaaccctgcccgccctgttgcaaggtctcagatgccagaatagcttcgagattactgatactgatacaggggttttggttttatattgtgttttaaaattacatttattcattcatatgtttgtgtgtttgcttgaggctgtacacgtaagcctcagtgcatgtgtggaggtcagaggacaatctgcagaagaaataggttctctcttcaccatgtgggttctatggatccaactcaatttgtcaggctcagtggcgagagactttagctgctgggccgtgtcattaactcaaaggcggcggtgtcggggagttccccaggattaccggtttcacattatgatctataatctatcttgagttaacttttgggtgtggcatgaaggagttgactttagtttgtctcgtggagatgtccagtggatacatactcattgaggacatagacgtgctgtgcctttgcgggctgactgatttctctcagcagccctatgttttcagcctggaggtcttaactgtgatctctattcgctggtgcatgtgcgtgtttgatggcatgtgggcatgcgtgtgtgcatgcatgtggaggttgacacctggtgtcttcctttatcaggctcctcctggtctctcacaaacccagaactcctgcttcggcttggctacccagccagcttgctccaggaatcccttctccaccccccaagcactggggtgatgttgggttttatttgggttctaggggtccaaactctggttgctctgcttccacagcaaggccttatccactgagccgtccccctcggacatggcttcacttcaggcgtatttaaatgtgctcttccgttttccagttgtgtccggatggttcaaggatgcaaggcgttcttctctattaacctcgctcagttcactcactggctcgcagagttgttttataattccccagagaggcttcatataaacagtcacatcctctgctcgcgctctcctcccgtctttgtggtcccccttcctcttcctgtcttgtgcggaggtgagggtgagcgctggaggatgcaggatagcagcggaagccagtgccgttgttacctagctcctggtttgttttaatatagttttagttgtttactttttaacatttatttattttatgtgtgtggttgttttgccaacacgtttgtctgtgctggtgcctcagaggtcagaagatgttggatcccatggaactggagttacaaatggttgtgagccatgatataggtgctgggacccaaactgcagtcctgtgcaagagcagccagtgttaaccactcagccgtctctcttgtcccaagctcctgtttttgacggaaacaattctatccttctccgctaagtccgagagtagagtgtagtgtgtgcagtgtccttccttttatgagatcggtctcttctattcctagtctgcggattttgtcaattttgccaataggatgtcctgtatctattcatgcatgtgatactgcgactattgtccttgaattaattgctagaaaggaagtaaaatggttaaaacacaaagatatgttaagccttttgcattttatttctagattgacatttagagaaatcaggccagtctgctgcactcttctaagttgttccaagatgttcctgagagccctggaataataataattcattattattattattattattattattattattattattttatgcccgtttggtttgttcttgagacagagtctcaggtgctctgacctggcctcaaggatgactttagccaatccctctcaagttctggaattacaggcatatgtcactcctcttagtttagattttaaatatttattttttactcttagctatgcatttctctctatgagtacaggtgttctcagaggccagaagaggatgccagatggtgccctgaaactggagttacagggagtggcagggagttgtgagtggcctgatgtgggtgttgggaactgaacttggatctgctctaagaacaggattcacgctgggcatggtggtgcaggcctttaatcccagctctccggaggcagaggcagggggatttctgagattgaggccagcctggtctacaaagtgagttccaggacagccagggctacacagagaaaccctgtctcgaaaaaccaaaaaaaaaaaaaaaaagaacagaattcacacttaactgtgagtcatctctgtggcctcagctaagattttgtaatctttgaattaccactaatttaattcctactttcagaacagtctctttcatatttgaattcattttattactctagatatgagtaaatatagttaaaaaactatttaaaaatagtaaaaaatagtttttgtgtactctccagcaaattcttttctttttgatactctgctgtgtagaattcctttctataatttatgtgcatttttatatattaacagtattaatctttagcatttgcaatatgtgaccagtttgttccttgtttttttattatcattattaacatacatttatttggtttatttgttttgagtaagcatcttatgtaggccaggttagcctccagctccctgtgccgatcacccttgctgactttaggctcctctctccttcctccgtttccagagcacagccttatgggcttgcaccacaacacctggcttgataggcttttagcttgatggtctcaggttcattgaagagatttctcatgtgcccttggcgccatggggactcggacaccccagcatcagcatcagccatgaggtctcggatggaccacactgatggaagtccacagtctgcacaaggcgttctcttgctgttgggtgctctctggtttcatacagagggtcccgttgtcccgtgctccacagtgtgtgtctccttttcgccagctcctggtaaacactgatattttaactgtctgcataactctccttttcctgaatgtcgccatgttgacaccagggcaggaagcctgcccacataagcattgttttccagaaatgtcttacctcccgacactcccaactcccagggaccagcagtggcctctgcttgtggcctggctcagttgcctgctcagtggggttctgggagtttggagcgtggtgttgtagcatggtatagcgacgccgtagcaattaatggggagcggccaagggcagacccagacactttgcacatagcttatcgatagcttgcgggaagcggtaggcagcagctcttggcagactctcacctagactgtgcctgaggactttacagtgtacagaaagaaacaggatccactcaggaagacctgggcgcatcctggacctaagggaggaccctgctgggatgactctctgacacaggagagccacatcacacactgggcaggcattctgggtaccgtgaagggctctaccttctacttgatggctgagagagaagggactagacccaggtttccaagggagctgttcactgggtggtatacactgggggcttctgctctggcagagagcggctactgactgtgctgagccagcgcaaggcgggaaactgactctcgcctttgctcagactataccgcagctgttgtctgcagaacaccactgtgacagctccaggatttaaccagtgatgccccaaacttcataattaaatatttttgcaaaagaaaatatgaataatcggtgattttttttttaaagtaaaatgacgagagcatagcaaactgcacactcgggttccaggcatagctccattagttgctagctgtgtgaccttggggaaattacatagcccttctgggccttggtttcattttctgaacagtggggtaatcccagccctcatgtaataagatcatgtgctataaaaacacctgcgggctgggcacagggcttggtgggtaagtgcttggtgggtttgatccctagcttacataagaacaccttgtgttcttgtagactcctagcagtgggagttggggtatctccgactcttttgcctacttttgggaccccttttctcctactgggttggcccctccttgatatgagggctcgtgccttgtcttatcatgacttgttttgccgtgtttggttgcgattccaggaaggcctgctcttttctgaaaggaaacagaagaggagtggatctgagggagatgggaggggcagggaagggagtgaaggtttggtcggcttgaaatgtatgaaagaagaatggataaacaaagaaataacaggccatttaacacgtggtttcctcagtgttgcaggaagcagaggcaggaggaaccctgggacccgtgctgggcagccagtcttgcccctgtgccggggcgggtgggcaggcgggcagccagtctggccaatcatcattgacctgtgccaggtggacgggcagccagtctggccaatcagtgacctacgccaggcgggcaggcagctagtctggccaatcagtgagctccagggacactgaggtatggaggaagagccccagtgttgactctggcctttatacatgctctcccccacagcacacgggaagtggccaagcccgcatccacaagtcattacagatgcttatagttaatattagttaagtgagttatattagttagttaatattagtagcccctgtgtttccttcaataaccactgtctttaagaaacagaagaaatctaagcccccccccccgggaagccccatcctgtccaagctctgtcagctgccccagggactttacagctgctaattccacacatattctgttgctacctccattttataaataagacgtaaaggctcagtagaggcctggtaagtcgccttaagtcactcaggaggagacttgagctctgctgtcctgacaacctgctacctgtattaaggtaccgcggagtctgctcatgaaaaaaacaacaacaacaaccaaacaaacaaacaaaaaaatgctttcccattcaacccagactatcacttttctcaaagagtgctgggatctgctctcagtggcatcgttcactgacacctgggtcgcggtttccgcggggcgtgttccatcgtgtcctccgtatttaagcccagggtgtatgttacgcgccccctccccatcctttccctgggatagcatagcacagaaatatgagatcctcacaccacctcctcctccagctccccctccagctccgatgccaacctgcggttccctgacagcaatggcctcctgcagacgcctcgctgggatgagccccagcggggatgtgctctggagcagatctgtggtgtgttccgagtggacctgggccacatgcgctccctgcggctcttcttcaggtaaggagctgtcctctgcctcctggaagcatgcatgtgtgcctgcatgtatgaatgtgtaggcacagatgtggggggtgggcacacgcagccatgtgcatttctagtctcatgtgcagcagagggctgcaactggtctagccaatgctagcagtttcctccctggcccatagtcgcctgtgctctcccaccggagccctcacagccccctgctgtggtgggtggcgaagggtaggtggccttcaggaaagaaagcccagcaggtgggtgctgaagactgctgtgtttcagggctccacagatcatttgcacagctgacatccagcacctcctcgatggaggtggcttttccttcataaaccccagtcgcagccacatcagcccaagtcagcacccgcaaaaagtacctataggaaccccagacccatattccagccttcccctgagggtgctgaggtaaccggttggggtgacagccttgaaggagattttgggaaaccctctcctgtgtcctcttatgatccagccgtgagattagaggaagcttgagaaaccccttgcggggttgagagctccatccagcaagccggccctaacacactgctccaggtcctcagggcagctcaggaatggtgtgccaggggtcctctggatccagctgcttggcttcctaggtagagggggtactgagttttgttgactctgctccccacacaagcagccagactcccttgggactcactgtttcctgcctgaggtggctgacagcgggctctgattaaactcggaaatcaaaacctgtgttaatgcgttcacccctccccccaccccgtggcccttcagtgacgaggcttgcacgagtggccagctggtggtggccagccgagagagccaatacaagatttttcactttcaccacggcggcctggacaagctctccgaggtgttccagcaatggaaattctgcacggagacacacctcagggaccaggtagcccagccgacggtggggtgggatgtggttggttacggcgaggggatggaagctcctctctcaggatgccaaccctgtgggtctggggctgtcccagcacatcttcttggggggggggggtcaggggggtctggctctggggattcccctctgaggagaatggcatttggctgtctgtggttgaggtggttgaccgtcagtgtgcctgacggctgaagtctgtgcctaggcctttctggaagtcactttgagcatttgaaggttcatgttttcataaggctttctgccatatttcgctcaatctgcatacagaggtaataggagcctcttaatcacctgtttaagatgctgtatgtgcttattagaannnnnnnnnnnnnnnnnnnncctcccgccggctcctcttattacgatagtggcaaatgcccccccctcacccccccgcgctgagcaacctttgatttttgaattaaatgtcagctgcagtttcgccctggactcatgactgcgcatggagacaatctgacagtctggctccctgctcgcccgaacagcgggcctttgtatgtggccgatcgaatggaatctattgcaggctttccctggcagagggacgttgggctgtaaggggtattaattctggttttctttgcggctggggcaggaaggggatgggggcagcggaggctgtgagttgcaaagggagagagatttttaggatgaaggtattttcattttaattgtgtctaattacacttgccatttaggagttgtgtgcacagacagcgcctcccctcctcccagaggagagagtggctttgacattctgggaacagcgtctcaggcttcttttgaagcccaggctctgagatctgctctccaccgggtccctcccacccgtccagcaggtcacggatgagaggacatgtatgcagttctccatccgaaggcccaagctgccgtcctctgaaatccaccctgaggagagcctgtaccggaggctggacgtgtctgcctggctcaaccacctgaatgacctgggccaggtggaggaggagtacaagctacgccaggtagggagggggcacctagccagcctccacggagccctttagtcaagcagcagggctggagggtgggtggccagtcaccacctcaggagggccggtccctggcgtcaagttctgtccgaagcacccaggcagcttcattgaaaagacaattgcagagtttggggatcccttgtgggccctgcggactcttcagtattgaaacccccaggattaatccatgacgtgagaacggcgtgttgatctcagagtgccaccccgggggggctttgacattgaaatgagccagtttgtatcctgtatgggaatgcctctccagcgctttccccttgtaaacatgtgcaaattgccggggtctgaatcgaggctcgccaaaggacccacaacacccttctctggggatttgggggttctttgagcttccctgttttatactctctccccccaacccctctcaatttgtactgcttcctccaggccattttctttggtggcattgatgtgtcgatccgtggggaggtctggccttttctgctgcactattatagccacgagtccacgtcggaggaacgcgaggcacttcggtcgcagaagcgaaaggaatacgcagccatccagcaaaagaggtgcactcggggccccgaagtcccttcagacctcggcgggaaagtgcaattcaccgctgaccttgtattctatgaaccatagtttcttagaaccgtgagtctcccaagagccaacaccattggcaggataagggcagtcactacatgacacccccatcaccttggtccaggccctttagttcgcaagccaagagttttagaatttgtgtttaacagacttaactaggggccaatgttcgccaagtacagccgggttggaagcctgacttcagaggctgaaggttgctccgcacttcaacaggctgcagtcagctctcctctgaggggctagacctgttagatgagtcaaaatgaggatggccttgaatacaccccctacacacacatatacatgtacacacatgcacacacatgtgtatatgcacatgcacacacatatatacatacatacacacatgcacatatcctgttgggcacaaggggggtctgtgctgacagtacacacacatgtgcacactcacacaaacacacacaccacacatgggcacacacatgtacacacatgtatacatgcacatgtgcatgcacacacacacacacacacacacaccctcttggaagctggagggttgactgctcatagccctagcaacagaggttagagctcctcagagcacaggcttctgtttccggggtgtgcagctattccaggtccagttggctgctgtgttactggctccctggcactcagggcatccccctttcatagctgacctcagggttgtgctctgtctgcctcacaggctctccatgactccagaggagcagagagccttctggcgtaatgtgcagttcactgtggacaaagacgtggttcggacagataggaacaaccagttcttccgaggggaggacaatccaaacgtggagagcatgaggtacccggtgactctggcctccctctgactctctttacacctcccctccccccagcccgctgtgcagtgctccacccaggcccagaacaggggacccataagctacttcagcataggtcttagcttctgaacctcgtggtggccatcccgatctatttgataggaccagcaaagcccctgatccctctccttgcttggctcccgtttactaaggacgatgctccccaaccctacctctgtcttctcatctcacgaatgaacggacagtcataacactatgcagagccagagactgccatcttttatactctgctgcagcctggcaaataactgcacaaaattaacagccaataaatacatccccgccagcccaccctctgtcacagacagtgaacatgtaagagagccacacccacgtctctgcacagcctctgctctgcagtccagccttggctaatggctgatatcacttgcaaagggagtcccactgacttacttgcctcagaacctagactttttttttttttaaggcagcgtttctctgtgtagctctggctaccctggaactctatgtagatcaggttggcttcaaaatcaaagagattatactgcctaccaagtgccgggattaaaggtgtgtacaccatacccagccagtaccccatacttttttttaaagatttattaattattataaataaatacactgtagctgtcttcatacgtaccaggagagggtgtcagatttcattacgggtggttgtgaaccaccatgtggttgctgggatttgaactcaggacctttggaagagcaatcagtactcttacctactgagccatctcaccacccccaacctagtactcttgagatagggttcgtggcacctgccagtggctgcagcctcccctgacaccgggatggagggacccagcactgtcacaacaggccttggtggagacagcaagggtgggatggttcaagccacctctgctcctgccccaccaggaggatcctgttgaactatgctgtgtacaacccagccatcggctactcacagggcatgtcagatctggtggcgcctatcctggctgaagtcttggatgaatcagacaccttctggtgcttcgtgggtttgatgcagaacaccatctttgtcagctctcccagggatgaggacatggagagacagctggtgaggcgtggagttgtgtgtttgtgtgtgtgtgcacacgcgtgcacatgcatacgtgtatcactgtgtatcatgcatatgtgtatcatgaatatatctgtgcttgtgcacatgtgtatgcgtgtgcacgggtgtctgtgtaatgaagggctcagagagatagcacactgcctcctgttgctgcttgggacttgatggtgagatgcagccatgttatcggggggggggggggtcaagaggtcagcagaaatccagaatctctgctgacacaggacataggccttctgggaagggccagctagtcacctacaggagatgtacgtttgggtctcagtcagcctctaatccatttctcctgaaacaccagaggacaattgttcaaggtcctactctggtggcttcctgcagggccattaatccggcctcctcgatagaccaaggagaggagaggtccatgctacctggttcaggtttgagtgactagcagagcccaatacaggcagtcagggtagctgtgtgcagtgggacatccagcaggtaagtctcacatctccacccacaaaggctgacgtttttgggaggctcagctgaccctggccacaagtcctcccccacagagatcagctgtacacaaaccaggcagcaccaggtgaccgggactagatcttgtcactgcaacacacctgcatttgtgtcaagcccctgcccacttccaggtcctggatgtaggtagtctgccctcactcctgcagatggcctggtctggaaatagaaaagctgacacaatgaaggtatgaacagaaggcactggaccctagagacaggagtgagtcccaggtgccccctcccatggctgtgtctatggcatatgggtcagacctcagacattggagactcagctaaacagagggttttggataatcgtgatcagtggtcttatacagtgagggcagagccgagggagggccaaaagcatgccccatagatcagccactgggaacagagggctgaccacagcaaaggtatgagggagaagcagctggctgcaggaggaacggagcatcctggcaattgtgcagattggacatccatcaaagagctgtcagccataccgtggccttgaccttccgtgggccacaggctggacatcctggcccgtcaggaaggacttctagactccagagccacacagctccagggaacaacagtgtgcctgctttggagaggtgcagagcctgaggcccagctgtgctcagcagcactgaccctaaccaggcaccaggtccctgctgcaacgcacacgcctgtgatgtcaggtttccacggtacccagggaggcaattacagggtctgacgccatcactctggagcctggcggcacatggccagtgactcattagctgctggaggctggttttctggtggcgtcagtgaagtcggcagcccccaccgggtgctaccagaaatagcctctgtcgtcaagtcccatgcaacctggtgacccgacatgcaggaatccagggtcttgaaactcagacatgaactctcccttaatcaactctgggagttgctgaaccgtggtgggatggaaggaactcaccctgcctggtcgggcacacattagaaacagcccctgggggtctgctgaggctgggggatgacttcacactgagtcagcctccttgaccaccctggagatcatactgtgccgagggctatgccatggtctccttctagaatatctttaaatctaagatgaactagaagacaggtgtgagcgaggttccagtggtggaggctgggggtgactcagacagcaaagtgtctgttgtacaagcattatggacccgagcctagatccttagaacctaggtaacgtgctgggtgtgccctggggaagttcacacaggtagatccttagagctgctcagccagcagagctaattgccaagtcctaggttcagtgagtgactgactccatctcaggctggcccggaggttaatatcatatactgctcttgcagaggacctgggtttgattcttagcacctacaccaggcagctcatggttgcctgtaaccccagtttcagagagatctaactcctctggtctccctggctacctaaagtcctgtctgtgcacacactacacacataatttaaaataataaaatgagggctggagagacagctccgtggttaagagcactgaccactcttgctgagggctggatttggatcccgggacccatatggtggctccagggggtccaacctcctcttctggcctcctttaacattaggcactgctgtggtgtgcaaacaggcagggagatcactcataaacacacaaaataaattggttcaaattttaaaataatacagaaagtctttaaaagaaaaaacaaaataaggtaaacagaagacactcagtatcacacacatgcatgcacgtgctcgtgtgcatactggtgtgtgtgtgtgtgtgtgtgtgtgtgtgtgtgtatgtcaggaggtccagtagtaggcagacatagtggctggctgatgtgtctggcagacacagacttcctgtgtgagctttggagttgaaggcattctgagtagtagtctttctagccctggtaggcaggctcgcccagagcctgggtaacacccgctccactctcccaccccaagctgtacctgcgggagctgctgcggctgacacaccagcgcttctaccaacacctggtgtccctgggtgaggacggcctccagatgctcttctgccaccgatggctcctgctctgcttcaagcgagagtttcctgaggccgaggccctgcgtatctgggaggcctgctgggcccactaccaggtgagtgagtggtgcaggtgccacccctgagtgcaggtgccaccccctgagtgcagccaccatcctgttgggaagggagggtcatgggatcaccccaagcctcctctcttgtgtgtggcatgtcctcctccttgctccacccactcaccacaccacagtctctctcacagctagtattttccaggcctgagcagccggcttcagacctcccctcccatgtaattgaaatcaatgtaaattgctggctgacatgctcattactgcattctgggctgagctgccttctgtcacggtcagctggtgggagggacatcagcaccgcaggacagttaggcagcccaggatatatgtgcccgcacaagccgtggctggtgctgtcctgtcctgccctgccccctggggctgctgggctaccctgagctcctgccttcccacagcatcagtcagagagcctggatcagtgaagcgggcaaccacctgtgttcaccatgaccggtgtctcttctgtcaactcctctctgaccacagggctgactgccacacggcttccacgcccaagccgtcagtgtaaaagagtaggcaagtcattgcactccgtctgccttagacatgataataccaaaggcacaacggctggggagattactcagtggtaagcgctcatcttgcaagcttgcagatctacatcggagtgtctgaacctgtgttttttaaaaaaccaggcgtgccaggtgtggtagcgcacacctttaatcccaacgtttgagaggcggacagaatttttttttttctggtgagttccaggaaagtcaaggctacacagtttgaacctgtctcaaaaagccagcgcacacctgtggccccagtgctgaagaaacagcagatactggcgagtccacagagctctctggccagtcagtctagcgtaatggctgagttccaggtcccagtgagatactgtcttctggcctcccgtgcacgtgcacacaagtacatgcatgcacacacttgcacaaacaaacatcactaccacctgtgtgtccaggacgcagctctgtctgcctccacctcgaccccccagctatgaaaaacactcgctgaagtctctcttcttctcccacctgcaacatcagtccaccagctagtacatcctagacttaaggctgttctagatagatattctgagaggccagggaggctgggtcatgaggaagtcacccatccatcctccgaggctgttggcagcacagatccttggccacccctgttggctgccatcttgttcaaagtccacaaagcaagttcatgttgcttgcagatgtggggacctgtggtcacatctggaaccacctctgtctcccatcagccgaggttaggagaaggggaaaggacagtgaacgagttccaagggggaagacgtcatacagtcctccattgtggcttactgcggtgcacatgcccaggagctggcatttgccctgtgctctgctccactctctgaagagtgtgtctggcactcctatctctccactcctgcagaagcgttccctcctgcacagctaggggacagggctgggcactctagcacccatacctctctctgcactgtgctggtctggttgggaaatgacaggccacatgatgctatcaggatactcaaggggaattcctagaccaccgctcccccgaaagcccccatccttcttccgtgtcaggattgaagactttcagctgtccaggctggagagcctgtcgtgaatgcctgccacctggccaggcaccacaaggtcccagcagccccggatggagctgccaatactggcgctgtcttcaggtgaagtggaggatgatgggtgatgttccctagagcagggacctgtggacccaggtggcctgaggcagactcagacttggcagggcccctctgagtttttctgtgtccccccgcagacggactacttccacctgttcatctgtgtggccatcgtcgccatctacggggatgatgtcatcgagcagcagctggccacggatcagatgctgctgcacttcggaaacctggccatgcatatgaatggagagctggtgctcaggaaggtgggtgccctgccctggcccgtcgggcccaccctgcccataaagcagggcatatcatatgctttacggcctcacccctgcacagggagggagggaggggtgagcaagatagtagaggaaggacaaggggttctaggaattccctgttactgagccctgatactcacacctcacagccccacccctacatgtaaggccttgcccttacctcaaggacccagccctgcacacagaaaccctcccatacctcacagccccacccctgcccatggagcccagtccacaccacagaacattaccccaaacatggactcagcttgcatctagagcccctctcatatcacagagaccccgcctctgcacacaggtaccacccacaacacatagctccaccctaccttgttgggtttttctctaccaagtccgtgtgattggcacctgtgctgcctccttagcccagtggggctgccgtggctctccttggtccccgtggtcctaagagggccatccctggacacagcctctttgatttgctgcagtgtatgaatgtccagctagtcttcacccaggagtgcctccttccagtccacagttaggaaagtaaggatgaggagacagagcctaagaagagcgtagctcatccatggctggaagaaaagcgccctcgaagctcagccacctcccgtttcccatagctggcagtcctttggattcaggcctctgatggtccatggggacaagaaggtcctcaggcccttcactacactgggctcccagacagaccttgcaggggccgagggtaactctgagaggcatggacggagtacaggggccttgtactatccagaggggactgggactgagtcgaggggtctgtaaaggggcaggacgggctgtgtggctctatcatcggtggccacctattcactctgggaactctgtgtcttaaactgcccaagaatctcatggtccctttttggcagccaaaggagacccagggcactgtgctgttcccacatagcccatgggtgtggcccttgtttctgttgtgttccactgttctcttgtgtcccgatggcatttcagtctcctttagcctgatctctctctacaggccaggagcctcctgtaccagttccgccttctaccacggataccctgcagcctccatgacctgtgtaagctgtgtgggacaggcatgtgggacagtgggtacatgccagctgtggagtgtgctggccaccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnggcaggtgttctggcctggccttctcacagtgtccatatgagtgttctgtgtcctgcaatgtatgggaaggacacgcctaccccgagccaagtgtcagatgcaccctccactgggatcctcccctgaggatctaaggtgtgtgcagaaacagcaacccactggggcctgaataggttgatgggtgtggtgtgcgcagccacgatgtcctctgaatacttggtcccggagaagggggagaatataactccccagccaagacaaaggcatctggcctggcttggaagctgcctccgccgccatgctggacctagggaacttctgggatgctctcttccttttaataaggaaaacgcccacactccatcctccaaagctgaggattgtggttggataaaagtgtgttccagagctttcctagccagtgtcccaaaagctggtgcaagcaaggagcctggattcctccacggagggctgaatcctcatagtgggtgcaggcggcagggtcggtggagatgcctctgccttttggcttttctcactaagagtggtgctgcaggacagtgccacgtttaaaggtgctgaccagaataagagggggcggagcctcagaatgagaagggtgggccctcagaatgagagagggcgaggcctcaaaatgagatgggcgggatcaccgattgaaagggcggggcctcggaatgagaggggcgggccttcaaaatgagagggggcaaggcctcagaatgaggagaggctcagcataagagaggcggggcttcagaacgaggggcggggcctctaggcctcctttctcagcttcccttgctccgtgagctcatcccctatctgaaggccctcctgagaatgtgagtccttctaggaagagactttggaagtggatgtgctaatcttggggggtactgtcctttgtgagcaacagtgcagtcctgggagtggcctttcatctgaattgctttctatactggcttctgactcttcctggaagctagagccacaaacaggtatatccacactgcctatcaccccagtaacagaaatgcagggcagagcctcagtgacctagaactctgtgcacctggctggcacagactgcagtccaggttgggtggttctggtcttgtgtagtttgcctcatcacttctggggttgtcgccatctctgaaatccccgtgggtaggtatatgggtgagacagcactggcctctgggtcttaggtcaccccatgacggtagaggcagaaatgggtggtgtttttttagtaagtggatacccccacttgctaaccatgtcaaagcaagttgaacggctgaagccagcatccagccctgggaaggtgaacccttgtcttggggtcttctcttggtagtcatgtgacagaagcctggtaattcagagggggtcccataagcctacctccccaggatcacacttctgtcctgcaccccagtatctacactccaatgttttgattggggacagctggagcagatccaaagacttactggccatggagagtctcagcatttattctaagtctctagctcccacagtcctcccccctccagtgctccccaagacctgacccaacctgttcagtgacagccttgtgccaggtatgtcccctctagtcctatggactactggaccttggtgttacctcaggccagctggggcctctgcagccagacatggtgtgtgggctctcggagccctgctctgctctgaggacgagagaggccccgcgcagagcagcaaccttaatctggatgcaattagaggaaaccagccaaatgccctgtggcagctgttaccccaggattattcccagtcagcaaaaggcattagagtgataattcagtcattagacttctagctgtctcacagccaggacgtacaaatcacgggtaatcagcaagtacaccgtcccctggccacgaggcttatttaacccatttttttaaaaaaatgatgcttaatgctattggccgggcgcatctgtgtgcgcatgccccaccgataatgtctgtgctgacgacattgcttaatgtcaccaaggccttgtcatctagggctctgggagagaaggacgcctttgatgtgcgtgtgtgctgtcactgctgagacatgatgcctaccttggaaagggcgccctcacttctgactcaccctccaaggagaagggagagggcaagggagggggcagcagcagaatgtgtcctcctctctctgggttagaggatgtcttcactgggcacaggaaagacattgcctgcctagaaagttgcacctggagtgccagccaagaggcctagctgtttctgcagaggagggccgaagtccccagagaggctctgttagtaaccttgagctgggcgatctgttgcagagctatgtggttgctgatcaaaccgacccgggttagggaggggcacatgctacattcagaaggggatgactgggggcctggctttgagtgcaggacaccagcccaagagaggctctggagctggtgccttcgatggccagggcaggatggcagtaaataagtgggaagaggaatgcttgctgtcagggtcagctcctgaaaggctcctttgacctctggcctgtatttgtgttttccttactgctttgctggggttttgctgtgctggggaggggggagtagggggtgcagtacgtggaacttgctaggccataagcgatgcagtcgtctttgacaacattaatttagatggcgatcaaccccagggttcctggaatccacctgtgacctccctccgctctgtcagttcccttctactgcagtcaggccaggagtgtcaggcatacccggggctggccagacagagggaaggaacctggcagagatccctggaggccaccctgcctagaacggagacgatgatgacaggttcccccagaaaacttatgcagggctatgctatggcctgggttataggggagccaggactgccacccagctgggccaccagagacgacatagggaaactggctagcctgaggctggacctggcagatccctggagtctctgaagagacaagtggcctctgggtgttagtgttgtgtttctacagaagctgtgatgtgttttgtcatgggctagcctggtctagccggattgtgacaccccaaatctaagaagccagtttctcccagagcttctgcagcagggagcaaggggttcccccagcccacttccttgcctataaaaggagaacaaggccctcccacagactccttcaaaagacttctctgaggctgccatgagggtggctaactatggcccagggacttcacccgccactcagggacgagcccactggccttagccttccgcagcattgaccgagaggggttgtccactcccagtcgaatgccctcccaggtctgaagtcagcaaaccaatgcctctcctgcacttctaccttgctgagtgtcctccgcagagggcaaatctctctgtaacgttcactctgtgccacccacgcctaccctgaagaaaaatgagccacaaagccgcctcagcggtctcggtctgcgcctagctatgcacataggtgtttgcagagctcttccatggacggccctcggagggggagaccctttctgaggactctgcactttctgagcagctgcgtgcagatgcctgctgccaccaggcctttaaatacattgtgttcaattccaggtgggaagatagcatttcaggtttgcagaaatcaagtcacatgactgtcttccttccacactttgaggataaggaggacagcttttttgtgtgtttcgttttgtttttaaagtaaggaaatacccccattgctgatgtctatagcaagtgattcgtttctctgttgcattttgtttttttaagcagtccccttccggtcaaggtcaggactggtcaccatgacccctgtgaataatgattctcatggattcctcacaaaacaaataaaatagtatcaccacacacatggtcctgtgccttgagagaaaaccctagtgagagtggccaggtcaggagccccagggctgggcagagaggctctgtggaagagccatgggggtctttagccacagccagcctgcccagctccttggctgctctgagagtattgggaaggggagtcggtgaggcctgagatgcagaaccagagggaagatctgcaggccctgctctgggaagggcagggacatgtgaaggtcgctctgggcctggcaacggagagagaagagccttgacgaacccaggaatgctttacgggcttccagaccgttccctcagagcgcacagagcccaggctacccaatggctggaaactttaacagtgtctgacagagccttagctgccctgctctaatttcaggagaaacccgagtcagactatgtgaacttcctttgggagacaaacactatattgaaacctggtgggtgtgggctgggtgttaagggggaaatccaggtatcatcagcgatgcttgctgttttgccagctctgggagccagtcacagggacgtgcagcctagggtggcgccaaggcacatggggtctgggttctgaggagcttgtggaactctaagctgttttcacaaggcttctgtatatactggtgtgcccctgtatgtactggtggtggttggaggggccaggggccgggtagactgacaggtgcttcactggagggggggggggaggtcccatgttaagggtttgtccaccttctgcctgtctgtcctttgttggacatattcgtgcctagcatgcccctatgaggaatggaaaatgccagccaagcccggagggtcaactcacgaaggtgcgggaggctggttccctgtaaagagaatcccatccacttggaagctgttggctcaacctgcttagaagctaaactccaactgtcagtgtcatgtgagatgctggtggtgatcaatggccaaagggacaggaggtagccaggcgttctcctagcctcattatctctgaggcctgtgacactgtggagtgtgtcatgtagctgagggacaggagtgacttgccctcagggaaggacagcctatgctcacagaccagtcaccacaggggctgaggcccgtgatgacctccattttgagccacagattggatagtcgccccattgaaacagggtggacttatgtggagttgcttagggctagggcacatatcctacatttgtaagactctcaagtagacgaggccacccacacctctgtgccttcagttaggcaaaccccgagctcctcgtttctatagcaccttcctcccgcctctcctacaacttgagcagcaatgttcataagctgcttcccctcaccccagtgaaatcctgcctctgtctcattactccagagcagtcctggttgtcaggaccccccattatttcccaaaaagccgagtccagaaatggtggatcatgcaatcacaaagcacaccctgcgctccacactgacctctggtcaccgagtcacccccttttaaacccaagctctgtctgtgctttacctgggttctcgtaaccaccatatctctgtcctgcttgtcagggaaagggtatccaggcagacccataatgaggcgactgcaggccaactcttcatccagttaccacacagaagccttctgccctaccctctaaaaggccaggaccagaatccactcacaccctctgaggaccagaggacacctgccactggcctggtgggtgacattcagactttaacattcctacatttcgaaagggacagctggctccctacctctccagacccctgtcctcctgggtctgtcctcccgtctctacatctcaagagagttacagctctccggcttccatgtgtgcaacgtaatcagggggtgggcgatgatttacacagtggaaaagctgcttcatcttcaaattggagagttggtctcaggccggattctgctggtcctttgaccccaggtagagggagacacttcacgttatcaaggatgacagagtcttctgagttcaggatgcagagaggacacagagtcctcagtttggcacggcgcttggctctagccacactctaccacaaagtgggagtggccactgaactgagacccatctgagagaacattcatttatccctggccataagcaaccatgcacagatgcaatagaaaaaaaaaaaaaagacatcaaggccaggggtctcttggctgcaaggcaatgaggggatgaacagcttggcccaggagtggggatggaagagaccagggccatgggtggtgcgattaagatctgtgcccagcatgtgaacaccagctgcaggcggcaagcagaagaggagagcaacgcatagttagcaggagagacgtcagaaggcaaagggcagggttggtgaaaagaaaggccgtgtgggagtcaatggtgctaggtgttcattgaagagcgagcacacattgcttttcctatggagagtcctggacaaagagactagtggctgcaggaggcagagagaacctgcaggctgtcccatcccagagacaacctgtctgtcttcccccagaacccaggagctctgagatcaagctttgggtgtggatcaccaggcccaggagaagttgctgcctacagaggagactctatccactagcccatgaggaccgcccatgtgtaggatgctgggtgagggaattctggtttccatgagagggaatcctgtctacttgaaaagctgaactctgcaggaagtccactagtaacacatctcaaggaggtcgcagaaggaaggagcaaccttcatgacggccgcaggctgagtccctctcttctgcccaccccttgccaccattgtagactgtagcaaaaagcctccaaatccacgggccacctgggtgtttctcaaaagcaggctcgggtctcttccattaaaagcttgggctttcagtctcccaaattttccttctgggttcttgggaagtgtccagttgtgccaaatgcaccacttggatggtgtgttccctcagttattgggtttttctgtttgactgactatgggaccgcctgcctcaggcaagcagcataaatggagtctcggctgtgatcggcatccctgaaatggagaactcctggcacaagtatctatggagcctttatgcttacgtgagatctgccagttttaccaggacagggtccaggtaggtggctgggacaagtgtgtctgcaggtgcgcataggaaggctggaaacgaaggtcctgcttcttgcctgggcgtcccctatccctcctttccaagtggccatggtgtcctcacccccaggatgctgcagatttgcaagctgagcaaaaagacaacaccccccccccaatgcctcaggtagaacacagttgttggggcacttttttttgagacagggtttctctgtatagccctggctgtcctggaactcactttgtagaccaggctggcctcgaactcagaaatccacctgcctctgcctcccaagtggctgggattaaaggcgtgcgccaccactcttaaggtggactgcagttcaactatgctcaccaaaccagcctagctctggaatctctgctcagaatctctgtcctgagagagatgagtgtttgtggggtgtacagagagcactgggtccccaaccccatagttcctgggttccacagggcttactccattgagggagctggacagaggaggtacttggccaggcagaggacctaattgttcctctgatctcaagatgggctgcaccagcctccccgcccctccttggctcttgtccacttgatggatgtcagccactcttctgcacaaggcacagagattcagcagcagttcaaagctacaggacttgggcttctcactagccctgtcttctgcgaaggggcaggccaggtctgagacattctggcttccccggaagaggctgcgtgctcccaccgccccacgctctcctctgcagagacccttgtggtggcttctgacgtcatacccgatgtgatcatcctactgtgcactcacacccccaccacagagccaccgtgacggcttgcctacaaagtaaggagcagggtcttgggagagggagtgtgcaggatgggagagggactgagggctacctgagctggggggcttggggacactcaactgcaggagcgcaggaggaagaccaccaatccaatcataacaggtgcactctaggtaagtattaataactcgtgacacaggggacaggggagaatctaatgacaaggacgccatgctgtgccagaccacagcactgcaagggaaactgcagtgcgctggaagcccggatgcactcagagacctcccgctccaggcctctgactccagcccctctgaatctacctacccctctctcactccaggaactggctgtagccaggacaccctggccccagcagactttctctgtctgtccttctgaatccgacacacacacatgatgcctctactcctgtggtcacagaaaagagctgttttaggtcttaaagagtgcccagtgtcaggagcctccatcgactgtccctgggtgggctgagcagttgggcacagagccatatgatgacaccatcaaacttgacctcttcctgtccctgcaggaggttagcacgtgcaccatggggcttcacgcggctgtcttaaacatagccctcacaaaccctagagttgggcgtgcgtctgacctctgccctggacagttgtcagccaacagggtctcttctcagggggaagcacaaacgtccttaaaattggaagtacgatcactctcttggtgcagtgcagtcttcggccaagacagtgggatgagttggggagaagaagccgaaccaagctagcctcagcccctccctagtcagttgatgcagagtcctgcctggctcgggctcagccttcgcctgggcctttggtggatgaaccctggagagggaagaatgggcttctggacctgaagagttccatggcagacacctccttctcataggtagacaagtacctccctgtagatgtgcaccccacacctcacaccaagtactcagcaggacagcactcgcaggaaagcattccactcagggttcatttaaaaccgagtacctcaaaggggcaggaggtccaactgccactgactgtgttccccaggaatgagaagcaggggacacactgagctcacaggatggccttggggaccacacctgccctctccgggcctcagatgccacct

SEQ ID NO: 458 - DNA, 1138 bp, Mus musculus
tgacgaggcttgcacgagtggccagctggtggtggccagccgagagagccaatacaagatttttcactttcaccacggcggcctggacaagctctccgaggtgttccagcaatggaaattctgcacggagacacacctcagggaccagcaggtcacggatgagaggacatgtatgcagttctccatccgaaggcccaagctgccgtcctctgaaatccaccctgaggagagcctgtaccggaggctggacgtgtctgcctggctcaaccacctgaatgacctgggccaggtggaggaggagtacaagctacgccaggccattttctttggtggcattgatgtgtcgatccgtggggaggtctggccttttctgctgcactattatagccacgagtccacgtcggaggaacgcgaggcacttcggtcgcagaagcgaaaggaatacgcagccatccagcaaaagaggctctccatgactccagaggagcagagagccttctggcgtaatgtgcagttcactgtggacaaagacgtggttcggacagataggaacaaccagttcttccgaggggaggacaatccaaacgtggagagcatgaggaggatcctgttgaactatgctgtgtacaacccagccatcggctactcacagggcatgtcagatctggtggcgcctatcctggctgaagtcttggatgaatcagacaccttctggtgcttcgtgggtttgatgcagaacaccatctttgtcagctctcccagggatgaggacatggagagacagctgctgtacctgcgggagctgctgcggctgacacaccagcgcttctaccaacacctggtgtccctgggtgaggacggcctccagatgctcttctgccaccgatggctcctgctctgcttcaagcgagagtttcctgaggccgaggccctgcgtatctgggaggcctgctgggcccactaccagacggactacttccacctgttcatctgtgtggccatcgtcgccatctacggggatgatgtcatcgagcagcagctggccacggatcagatgctgctgcacttcggaaacctggccatgcatatgaatggagagctggtgctcaggaaggccaggagcctcctgtaccagttc

SEQ ID NO: 459 - protein, 379 aa, Mus musculus
DEACTSGQLVVASRESQYKIFHFHHGGLDKLSEVFQQWKFCTETHLRDQQVTDERTCMQFSIRRPKLPSSEIHPEESLYRRLDVSAWLNHLNDLGQVEEEYKLRQAIFFGGIDVSIRGEVWPFLLHYYSHESTSEEREALRSQKRKEYAAIQQKRLSMTPEEQRAFWRNVQFTVDKDVVRTDRNNQFFRGEDNPNVESMRRILLNYAVYNPAIGYSQGMSDLVAPILAEVLDESDTFWCFVGLMQNTIFVSSPRDEDMERQLLYLRELLRLTHQRFYQHLVSLGEDGLQMLFCHRWLLLCFKREFPEAEALRIWEACWAHYQTDYFHLFICVAIVAIYGDDVIEQQLATDQMLLHFGNLAMHMNGELVLRKARSLLYQF

SEQ ID NO: 460 - DNA, 101209 bp, Homo sapiens
  misc_feature (1)...(101209): n = A,T,C or G
cccagccacgccctgagccgggggggcgggggccggcagtagttctcgctcctggcctgcaccgaggtgaggaatgcctggaagggtccctgggtgtgcacagcctggaccagtgggctgtgcgctctaagtggcactgagcgtctctttcagcagtggccacacgaagcaggattgagattcggggaagaagtggccgcaggggctgtgggcctccgcagggaagggtctctgacgagcttgccctgggctcatggggaactgtggcttcatgctgggactgcggggcggaaggagggcatggagggctgtggctgcccgggtactgtcccatggtagcctccgagcagctgtcgctggagcccgttcgcaatacccctggagggccgcctgcccatcaaggggaggggagcagctgggcttgatctttggaagggacatctggtgaatttctgaaaacgtattttattgcaggtgctttcagcagggtggagggggtggcctggggaggaagttaaaatgaccccgcctgtcccatttcgcggtaaatcttgcctgtgatgagccattactctcaccagagcgtgtgatagtatgagaaccgtggatctcacacacgtgtttgtcacatgtgcagcgttgcggcagctgagagggtgtggaccatgaggtgggccaaaccacataggcctccgggtcacggccaaggcacctcttaaaattgtccataaagttttatataataaatgtccccggccagtcatggtggctcacgcctgtaatcccagcactttgggaggttgaggcgggcggatcacctgaggtcaggagtttgacaccagcctggccaacatggcaaaaccgtctctactaaaaatacaaaaattagccaggtgtaatggcaggtgcctgtaatcctagctacatgggaggctgaggcaggagaattgcttgaacctgggaggcggaggttgcagtgagccaagattgtgccatttcactccagcctaggcgacagtgtgagactccacctcaaaaaaataaaaacagggccggacgtggtggctcacgcctgtaatcccagcacttttggaggccaaggcaggtggatcacctgagggcaggagttcgagaccagcctggccaacgtggtgaactctggtgtctactaaaaaaatacaaaaattagccaggcgtggtggtgggcacctgtaatcccagctactcgggagtctgaggcaggagaatcacttgaacctggcaggaagaggttgcagtgagccaagatagcaccactgcactccactagcctgggcaacaagagagaaactctgtctctaaataaataaataaataaaaataaacgtcccagctttattaatttatcatagatttcagtgtttttgtcagataactgagtaagcaataaaaacagggcctagcaataaaaacaacataaacactcaatgaactgctcgatactttagttaacatgtgagtccctttcaggtaaatatatgctttgaattaggcttttgaaacattaaaagtagttcattgaacatagaagaaaatatagaccaatgtttaacgatctttagcttggaaaggattatattaagtataaaagtaataaaggaagttactaagaaaaagttaccatcaatttacataaaagttttaaacctccgtatgtcaaaataggtaatataaataaaaggcaaacaacaaattaggagaaatacatgtgtgtcatggtatgtgtttgtgtgtgtcatggtgtgtgtcatggtgtgtgtttgtgtgtcatggtgtgtgtgtgtcatagtgtgtgtgcctgggtgtgtcatggtatgtgtgcatctgtggtggatgtgtgtgtctatggtgtgtgtgtagagtgtggtgtgtgcctatggggttgtgtgtgtgatgtgtctatggtgtgtgcagtgtgtgtgtctgtggtgtgtggtgtgtgtgtctgtgatgtttatgcagtgtgcctatggtgtgtgcctatggtatgtggtgcgtgatgtatgtatctatggtgtgtgtctatggtgtgtatgtagtgatctttactatataaagagttcttacatatcaatgaaaattccatctcagcttaatctctgtattaaaaataataagaattccaccacgccagcagaaaaattgtcaaagcacaccaacagataattcacaagtgaacacaaatgtctaataaatataggataatctgtcacccagggtggggtgcagtggtgcaatcatggctcaatgcagcctcgacgtcctgggctcaagtgatccaccttagcctcccgagtagctgggactacaggcacacaccaccacccccagctaattttttagaagtgggatcttgttatgttgcccaggctggtttgtttgtttgtttttgttttttgagatggagtttcactcttgtttccaggctggagtgcaatggcacgatctnnnnnnnnnnnnnnnnnnnnnnnnnnnnnnnnnnnnnnnnnnnnnnnnnnnnnnnnnnnnnnnnnnnnnnnnnnnnnnnnnnnnngcatgcaccaccaatgcctgtctaattttgtatttttagtagacacggggtttctccatgttggtcaggctggtgtcgaactcccgacctcaggtgatccacccgccttggcctcccaaagtgctgggattacaggcgtgagccaccgtgcccggccctgcccaggctggttttgagctcctgggcttgagcaatcctcccacgtcagcctcccaaattgttggaattacaagtgtgaaccactgtgcccagtcagaaaaccatttttcagttcccagcctggtggagatttaaatccctggcagcactcttacatttcggggaacccactgggcaatacgagttggggtccagtttatcctcctggggaaacagtaatcctggaaataatgaggatacagatgaagatttatgtattaaaatgtggagtttattatttcagtagccactagttggaagccagatgcctagcaatggcggctgattctatgaagatggagggttggcatttataatttttatttttatttatttatttgttttgagatggagtctcgctctgtctcccaggctggagtgcagtggcgccatctcagctcactgcaacctccacctcctgagtacaagcagttctcctgcctcagcctcctgagtagctgggactacaggcacccgcccctacgcttggctaatttttgtattttttagtagagacaggatttcaccatgttggccaggctggtcttgaactcctgatctcaggtgatccgcccgcctcagtcttccaaagtgctgggattacaggcgtgagccaccacacctggccttatactttttaaatgtgttaataatgtggtatatttgtttgctagggctgccctaacaaagtaccagggtccaggtggcttgagcaatagaaatctctctgacagccctggaggcaggaagtctaagatcaaggtgtcggcaggattgtttccttaggaggctgtgagggaggggctgctccaggcctgctccttgctggtaggtggcatcattgtattcacacagcactctccttgtatataggcacctgctaccaacttcctctttttataaagacaccagtcatattgacctcaaggtaacttgatcacctctataaagatgctgtcttcaaaaacagtttcattcttgggtactggggtttaagacttcaacacaggaattttaggggatgtacttcaaccctaaagtttgttatatcataagtatacttcacctgggaaaatatatttatgatccaactgaaagcaagatatgatataattccaaggagtggggtttttcattaactcattcattatagggcacaaaatatagtagagaatacataaatgtcttaggattatgtgatttaagggacacgtattcttccttttccttctctgagtgtgtttcataactaaaaaaaagttttaaaaaatgggccaaggattctccacttctagtttgctggtgaccagaggttgggaactaggttggatttcgatgaaatagcctcttgcgaaacagcaaatgcactttacaaataaggagaattgtttttagagagcaaacagtcctgtctaatgtttaatagacatgctccatttctccaaaaagagcccagtctctccagaacaatctgggaggggcgggggggggttgtcctggtgtcccaggtggcgggtgatggaggagccggagttctgcacgtgggggacgaaggtctcacgctgcagggtttcccgctcacgaaatgaccctgagtggtcagaacctgtcttctcctccgtaaagctgcactgttgggacgcacctcgcagagccacagtgaggttctgcctgtcatggtatgggagaaaatgctgtattttgaacacttgtatttcggaatctcctttaaagcttccagcacattcttttgattatcctcagtgctggcaaaacattttcacttaaagagggttttgatttggggaagcagctgagagctgtgtgcagccagctctggcaactggagcgatcacactgagtagagccatttgaaacacagaaggaggtgggctccagccccgctgcggccttgtccagtgtggacaccgcgcaggctacagagcacccaaaacgtggctgagcagaactttgacgtgcttaagtgcaaaatgcacagcagactttggagactttaaggacataaaataggccaggtgcggtggctcccgcctgtaatcctaacactttggaaggctgaggcaggaggatcacttgaggccagaagttcaagaccagcctgggcaaaaaagtgaaacctcatctctacaaaaaataaaaaaattagcgggacctggtggcatgtgcctttagtccaggctatttgggagactgggcaggaggattccttgagcccaggagtttcagaatacagtgagctgtgatcacaccactgcactctagcctgggtgacaacctgtctctaaaaaaaaaaaaagaatgtaaaagatttcattaataattttttcaggctgggcacggtggctcacgcctgtaatcccagcactttgggaggccgaggcaggcggatcacgaggtcaggagatcgagaccatcctggctaacatggtgaaaccccatctctactaaaaatacaaaaaaattagccgggcatggtggcgggcgcctgtagtcccagctactcgggaggctgaagcaggagaatggcgtgaacctgggaggcggagcttgcagtgagccgagattgcaccgttgcactccagcctgggctacagagtgagactccgtctcaaaaaataaaaaaaaaataaagaaataatgttttcatattgactatatgctgaaataataatattttggatatattatgctaaaaattattaaaattaatttcactttttttttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttcttttcaaggccaaataatattccattatactacatttggtttatccactcccagttactaattcttttttttttttttttttttgagatggagtctcgctctgtcacccaggctggagtgcagtggcgtgatctcagctcactgaaacctccacctcctggatttaagcgattctcctgcttcagcctcccatgtagctgggactacaggcacatgccaccacacctggctaatttttgtatttttagtagaggcggggttttgctatgttgaccaggctgatctcgaactcctgacctcaggtgatccgcccatctcggcctcccaaagtgctgggattacaggtgtgagccaccgctcccagtcagaatttcctttcttttaaggccaaataatattccactgtaccacatttggtttattcactcccagttgctaattcttatcatgttggcttcaagtcttttcttccttcaaagaggtgaaggtgaagcccctctgtggctgtcgtctcccagccccctgacctctgcagacttttgtgaagccggcctgcacgcagcccagctgtggtcagagtcctggacatcccccatcagtgatcaggatgcagcgtggctctgtgcctgtcttttattttttttatttattttatttttttgagacggagtctcactctgtcgcccaggctggagtgcagtgactcaatcccagctcactgcaacctccacctcccgggttcaagcaattctcctgcctcaccctcccgagtagctgggattataggctcgtgccaccacacccggctaacttttttttctatttttagtcaagacggggttttgccatgttggccaggctggtctcgaactcctgacctcaggtgatccacctgcctcggccccccaaagtgcttggattacaggcatgagtcattgtgcccagctgtgcctgcctcttcactgacacggtcgttccttggcgtggcttggtgtgtgtgtttgtgagctccatgtgtgtatagaagtctagttggttctcatctgctatctagaggtttggtggtttcatttttgttggtagaaactggctgcaaagcatttgattaggtgtttccttgggttcctccaggcagagtcatcacatgtttcaggtcacagcgcattatatatacatttcatacgtcccaggtcgtcttacccacatgaatgtgtcctcacggggcagaagttctctgacccagtgctgagcctacctatggccagggttcaagggcattttctattttttttttctttttttcttcttatgctggtgttgacccactaaattgatttcaggatctatgatagggctgcaaattgcagtttgaagaaccaccctcaggtatttcctaagggaggaatttcagggggctttgggccttctcagtggtgccagattctgccatgttgctcccgcattggaggagacaggactggtgacagctcccctttccctcatcctcagtattttttgacttaaaattgctttttgctggtttgttgggtgttgaatttttgtttggaactgagaatctctttacatatttatcagttctttggttttcctcttgtgtggagcacccatttttttctgttgagatgttgctccttttcaccatgaatttataggagttctttatatattctgtatactaatcctttagtttataaattttccttctttctttttttttgagacagagtctcgctctgttgcccaggctggagtgcagtgatgtgatctcagctcactgcaccctccgcctcttgggttcaagcgattcacctgccttagcctcccgagtagctgggactgtaggcgcccgccaccgcacctggctcatttttgtatttttggtagagatgatgtttcaccatgttggccaggctggtctcgaaccccttacctcaagtgatctgtctgcctcagcctcccagagtactgggattacaggcgtgagccagtgcgccttgcctgtttatttctttttaatgaattagaagggctcatttgtgctgatgcaggtgggaaactgagaaaagaaaacgtttttttttgtgaaaaaaacgtttttgtggaggtttttgtgaaattgctaaggtgggaacagggtttctgtagcttagtggttctccttgggagggattttgccctccagggcacatttggcaaagcctggagatgttctagttttcgtactgggaagggaggtgctggtggcatccacaggttgagccgagggacgctgctcagcctcctgcgatggacagggtggcctggccaagatggagaacgtggcctaccctgtacagagctgttcaccagcaggacacgctcctgtggttaaccagaacccaccgggtgccgaggcgacacgtactgctgtgagacagaacgcaagtccacaaccttgaccatctcctctctcttcctcccccaggcaggtcttgacgagccctgcccgggccgacgcatgcggaggatggaaacacttgcccggcaatgtctctgggccgcctccttcgcagggcctcctccaaagcctcggacctcctgaccctcacccccggtggcagcggcagcgggtccccctctgtcctggatggagagatcatctactccaagaacaatgtctgcgtgcacccgccggaggggctgcaggggctgggggagcaccacccaggtgagccagggcaggcgaggctccagggtcgcacagcccaggttattttccgagccagggctctaaaggccctgggccacagcacgtgagagtgcatttggttcctcttccagaacgtgtaactaacagcagctgtcctcccggaaggagggtctggggggtgttaagtctggctcatggcaggctgggtgagtccctcagccctgctgcttccaaagggagggacaaaagatgggttagtgatccctcaggcctgcctggccccttgtcattcgtgtgaatgacttgcaacaaataaatgcattgctttgttcatctgttgctttatttaatttgcacaacaacctcatgggagtggccagggccccagcaggcctcttaggtgggtaaggacgctggtgttcagagaggctgagcgactctcggctgcacagtgccagtgtgtggtggaggtggggctgcagggcagtctctggactctctcttctcatttcttcctgttgccgtccccttccctggctgctaaaaggatgtttcagggccccagtgtcctgcagcctggctgtggcctgccccggcacaccctaacatttgcttggcttgggcaagagtacagacagaagtcccagacaagatggcaaaatagtaaagttgtcatctgggcgaggtggttcacacctataatcccagcactttgggaggctgaggtgggaggattgcttgaacccaggagtttgagaccagcctgggcaacagagttagatttcatctctattaaaaaaaaaaaagttataaattacagtgagatctgggcactttatgcagattatgtttcaatcgaatactgaataaataaatttttaaacaagacaaaagtttaaattatgccaatgaaacatttaaagagagtgttctgtccccctgccttgataagtgtatctttatagccaccggctggttggctgcggctgtgtgggcaggggcttccctggagtgccctagaaaggggtgcaggttctgggcgatgcggcccctcgacccggaggttgcctggcctgagggtgttctagagagagagaccagggagtagccacctcggaccctcttgccgatctcaaaggatgtggaaacacttctcagcctcaggctcatgttatcctaatgcccagctggctgacattccccaaatttcccagcctgttttggcaacaggagcagtgcttaggagattctaggggtctgagttgtagagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgcaggcaggtgagccctggggccagggtcagggctctgaacacagggaagcagcccctggtgtacttggtaaaggtgcatggcaagcctgagttcgtggctcatcgcctgtaatcctagcactttgggaggctgaggtgggcggttcgcttgagctcaggagtttgagactagcctgggcaacatagtgaaaccttatttctaccaaaaaaaaaaaaaaaaaaattagctgggtgtggtggtgtgcacctgtagtcccagctactcgggagctgaggtgggaggattgcttgagcctaggaggtgggggttgcagtaagctgagattgtgccactgcactccagcttgagacacagagcgagaccctgtctcaaagaaaaaagaaacaaacccaaaaaccaaaaagaaaggcgcatggcaggccggtgcttggggaccagtgccccctggatctgccggaagtgtgtgttcttaaaaaacacgcatagctggaattcatttcaagctccacagtttccctctagtgtttttgctcagggccaggctgtatctgaggccggactggcactttactaaagggcagtggcctctccgagcagctcgccaaaggtaccacaagggcctcatccacagcctcctggcctctaacgtgccatccccctggctcctcacaggttacctgtgcttgtacatggagaaggatgagatgctgggagccaccctcatcctggcatgggtccccaactctcgcatccagaggcaggacgaggaggccctgcgctacatcacacccgagagctcccccgttcgcaaggcaccccgccctcggggccggcgcacccggagctcaggagcctcccaccagccctccccgacggagctgcggcctaccctgacccccaaagatgaggacatcctggtggtggcccagagtgttccagaccgcatgctcgccagccctgcgccagaggatgaggagaagctggcgcagggcttgggggtggatggtgcccagccagcctcgcagcctgcttgcagcccctccgggatcttgtcgacggtcagtccgcaggatgtcaccgaggaggggcgggagccgcggcccgaggccggggaggaggatggctctttggaactgtcagccgagggcgtgagcagagacagctcctttgactcagactcagacaccttctcctcgcccttctgcctctcgcccatcagcgcggcgctggccgagagccgcggctccgtgtttctggaaagtgacagcaggtgagttcctggttctgggcgtgggctctcgggaggcccccaaggcctgacctgggcaggaagcactcacctgcgtcacctgtgatgccaggtgagcgctggaggcatctgcccgacctgcccgcggctgtggccgtggctgtggcaggagcccctccctgaggcaagggcttcagcagggagtccccactttacaccccactgagaggactgtgaagggtgcgtcggggtgtccacattcttctctctccttgagactcactaggactaaacaggccctaccaggtctgatgggcccatgaccaaggctaagcccccgggagtcctggtcccttctgttcccatcaccggaggggcaggagattttcagtccccaagcgagtgcccaagaggcccgggtggcatcattaggctcacgcacagggctggcccaagcccagatgtgctggtctccagctccccgctctgccctgcagcccactgggcacgtgacctggccccctgtggtccccggaggcttcagcctccctctttctcatagctgtggaggatggatgtagtcccggggcagtgttgaccatattcacccgacttggcagccgctatgcaccctggggagtccagccagagtatctggactccttgctggccacacttgcaggagctagagttgggcccgtgccctgcggtgggttccctgggccttggaacccaaagagaccttcctgagtggggagggttgcatggtgccacgagggccctcatggccttggggtgagtgcccgtgtggtcgcataagcccggagccccagagccagcacagggggcctgcatccgacttccacagccccttcctatgccccggctgtggtccttacgctcattagatttctgggcaaataatggtggtgaccacagacaacagtaagagccgacatcagtcagcgagcaggtcattaactgttgagctcgtggtgtgagccgggcgcatgctggacgtgggtggtctgggtctcgcctgggcgctggacaccgtgggctatggatggtacgtgtgtgctttccacagccccacgccccgtgaggtgggccctcctattatcccctgctatcgaaggggaaagggcggctcggagaaggtcagcagcttgccaggggtctcccagccagtgcccgggccaagctgggatgtgaacccagctgggtctgccccagggctgcagcataaaaggtcaccccaggccgattaagccggggagtggtggggcatgaagtaaggacacaggctttgctggcctcagcaggggtgactgtgggacgggttcttccctgattttatccctccagtaaagatgcagtccattagagccccagggtgaaccgataacattcatctcagttattggagagtgcagataaaaggaagccgtgagccgtaactgaggactccaggtgccaggaggcttgctgagctgggtggcgtcaggcgccagggaacccgaggaggtgtgggggaggcggggcccgaactctggtcctggcctgggtcccgcaggccggactcagtcggagctccccctggtggtgccaggccaacagtgcagcagaacctgcaggcgtccccgtgtccctgcatccccagggcccaggcgaggggaaggtcccagttgtgtctcagagaggtggtggggttggcccacggtcttggggctgaggattctgtggcagaaccacaaccagaagctggccggtcagctctctgtcccgcagccccatctcgtagggagctcaagtttaggagttagggagttgagtgccggttgagtcctggcatcactggttagtgtgaacctgggaaattctttcttttcttggagcctcggtttccctgtttgtaagatgaggctggtaatatccactttctgggggtattgtgagaatgcaccccggttcgcttttccccgcccttcgccttgctggttcttcaacctggctgcatgtgggggttcctgggggagcctttagacgctgatgcccaggtccctccaggttcttctagagcagtgattctcacccggggccgagtctgtgcccagggggtgtatggcaatgccaggagacactttttttttttttttatcacaactgagggtggggatgtattggcatcagtgggcagcggacaggcgtgctgtgcactcactctggaagccaggctgtccctctgcctgggacccaccgggggccgcccatcattttcaggatgaagcaccatctccttcactcggggtccaaggcccatcaccatctggccctgctgagcgatgctgcctgcctccccaccccccactgtgcacacctccaagttcgtcgtcctctctgcctctagatcttgtggggctctctctgcctcatgcctttggctagggatcccctctacctaggcttcctccttcccctctctcctaaccggccagcttatatgtttgagactcagctcctggggcgaggcaccttcatgtcagcttttgggggaggcttctctattcccccgaaccctgggctgaggagggccctccccatggcccccttctctgctctgacactcgagtccccactgagacaccctgtccgcctgtccgtccccagctgctgggaggcagatggtggtgaaggagtaaattttggggtccgacagatctgtttccagtcctggcatcatcctgagttatgtgtgatcttgtggccattacctcccacatccaaaacgcagatgcctcacgggtgtgaagtgcggccaagaacccccttgtagggcagagtcggcgtgagggttgagcaccagcctggggtatggggtcagcgagcctggcctgggactcgtccccacccggagaccgtgctggggggtgcttaccacagcccggccctgctcctgatgaaggctcagaaaatgcctcttggccacatggccgcgggctcggtgtggctcgcacctcaggcctgtgtcagcccggtccaggggaggctcgctgaacgtggcgagttgcagctttgtgctgggacgaggtggatgtggatgggactctccccaccccgccagaagcgtgtgcttcagtgcaaggctggagtgaaaacagcctgtctccaagacagactgctgagagctttctttttatttttaaaaagtagatatggaggccgggcactgtgactcacgcctgtaatcccagcactttgggaggccaaggtgggtggattgcttgagcctaggagttcaagaccagcctggggaaaatggcaaaacctcatctctataaaaaatacataaaaattagctgggcatagtggtgcatgcctatggtcccagctactcaggaggctgaggcaggagcatggcttaagcctgggaggtgaaggctgcagtgagctgtgatcatgccactgcactccagcctgggtgacagagagatactctgtctggaaaaaaaaaaagaaagaaagaaaaagaaaagcagacatggattctgaaaggggctgggcgagccctggaatctgcatttccctggtctttccttgctcctgtgcgcttctggcccccaccacatggtagacccaggaagcagaggtggtgctccttgccccatccccatcccccggggccttcgtatgatgggactggagatccttggctaaggtggttaattgtcctagacgctgtagagcaggcgtccccagcctggctgcccatgagaatgccctgggcagctttaaaaatcctgatgcccaggctgcacccagaccaattaaactaggatcgctggggtggcgcccaggcatgggaatgttttgaacttcctgggggtttctgaagtgcacgtagcgttgagaacccctgctgtgaaggggctgagagagagagagagagagagaaagaaagagagaaagagagcgagagagcgagagagagcgagagcgctcctggtgctctggggtggggaggggtgtcagggccgaggaccccagatgactggccatcccgccaggcaggggtgttggtgaggactcgggtgcacccatcgccactctgagcggtggggcgtctattaataattaacccggagttgagtccccccggagggcagagcaggtaggctggctcgagggtcccctctagtggtggatctgaagaactgcatgtgcaggctgcgtgtctggctgagattggccaggagggacaactcccccaccccaccccgggggcctagggtcccccaggtatatggttatttggcaagtagttcacagaagagcttaggggttagaaatggcagtatcccccgggctgcccacattcgtgtgctacctgtagagtatggccaggtggggtctgcatgctggaaggtgagcccacctactaaacccagaggtctcctttggaagccccaggccccaggccccagtccagcgacggcctggaaatccttgaccaagtgagtattcgaggctgacttgggggatggggtgatacggagagctgctgtcgccaatgcgtcgtcctgcctccccgccctgagaccccaagaccctgagcttccccgagccgggggtgagccctgggctatcttggtcctgtgccctcctcagtgtcagaaagcaaggctctcgggtgtgctggggagggtgaccaccaagcgcgactggtcatcctgcccttggtttctgtgctggaagctaccgtccagcctaaaaggccagttgggcgagggtgtggaataacggggcgccatggggctggtaccgtgtccactgaccctgccccggggatgtgcattggtgacctggataaagaactgaaacaagcctgggcaacatagcgagaccccgtctctaccaaaaagaaaaaaaaattagctgggtgtggtggtgcacacctttaatccaagctgctactccggaggctgaggccggaggactgcttgagcctgggaggtggaggctgcagtgagccatgatcgcaccagtgcactcaagcctgggtgacagagtgagaccttgtcaaaaacaaaaacaacaacaacaaaaacaagaacaacaaaaacaccagattctgctccctaagtgaaaatgtctcctctggacctcatcctaagaaagaatccaaattacagatagaaaggccaaagtggccggcacgtggcttaagcctgtaattccagcgctttgggaggctaaggtgggcagatcacttgaggttggcagttggaggccagcgtggtcaacaccgtaaaaccccatctcaactaaaaatacaaaaattagttcagcatggtggcacatgcctgtaatcccagctacttgggaagctcaggcacgagaatcgcttgaacttgggaggcagaggttgcagtgagccgagatggtgcccctgcactccagcctgggtgacagagctagaccttgtctcaaaagaaaataaaagtagaaagacaaacgcttctgcatgaagatgttcatcgtggtattccttacagtggggaaaaaggagcagaacataagaatccaacggcagaggaggtggaccgactaaggtccctctaaggtccctctgttggatcagggagttttcaaacctgggctcacgaacccctgagatccttaccccacttttttttatatgaggaggaggcaccatctgacttcccagaaggtctgtgacctgtaaaacgttcagaagctcggtgctgccagataggagaagatgtggtattgacaaggactgtcaaatggtccatgcagtgttgcagtgtggaaatttagagtgaatcagacgcaaagcaggaaacgggttatgattctgcccgttgcagttaaactctgtgaagaggcctgaggtgcggatgaggctctcagggcagggctgcccagcagagcttctgccagggcagacagaacccaggtctgcgccgtcccgcactgcggccactggcttcatgcagctcttgaacccttgaaatggcgcaagtgcaactgaatttttaattttacataatacggattaataaaattgtttttaattttaaaatgtttttaagtttcgtttttagagacagagtctcaccgtattgctcaggccggcatacggtggcggcagcacaatcacagctcactgcagcctccacctcccgggctcgagcgatcctcccacctcagcctctcaagtagctgggattgcagacatgcaccaccatgccccgttcatttattttattttttagagacagactcttgctctgttgcctaggctggtctcaaactcctaggctcaagtgaccctcctgcctggacctcccaaagtgctgggattacaggcatgagccgcgtgcccggccctgatgaatataaatgtggatagcgcctgtggtcagtggccacggcagtggatggcagaggttgagaggaaggtgtgcccacgtgttagcctagtgtgattatgagcactttttttttttttttacttttctgttttcaaaaatgttattctgtgattatattaagcttagaatgaaaaccaatgtataaaaatagacagaaggggagaacctgcacatttggggacgctaagcatctcccactgcgctgcacgctgctaactagtgaagaggcctccagggcgagctggtcactgaggtccttccagtgacaccagtgccgccggcctgccaccttgggtcccgtgccgccagcggggcctccccctggggaagtgagtgtttcgttctctctctccctgggtcctcttgtcattcccggcatgcgttcccggggtggccagcctaggcaagatggtgtttgggtgttgggatgggctgggtggcctggcctcagagtttggccacttgttactgtggtttctgtcatgcagttcctgccaggtcagactcagtccaagcgggttggcgcggccacaggtgggcaagggccaggagcaatgtgctgcccacctgggggtgctgccgggaccccctgccctcccactttcctcttgccctttcctgcacacacactgggcacttcaccccaagcatagccgcttcccaccttgctgcccgcagctggaatgttctcctctctcctgctgaatccccagcccacctgcaggtggaagagactttcttctccgtgacccctgctgggacctgagctttctctctggagagctcctatcaaggccgcgtggtgttccctacgtgcgccaccgttcccgggtgcttcctcacagggtcctcccagtgcctgggccagcgccgtcagcagagcgtcctgcagtgcacgcggtcctgtgcctgtgccccactgtgtgtggccaccacgccctagaaatgcagcagatgtggccaagcaactggactttggtctttctttatcttcaatgaatgtgaagtttggtggtcacagcgggaggcctccatgcctgacagcacaggtctggacggaatgttcctgggaggatggaaggtggaccctagaaacgtagcgaccctcccagcaggacaggcccgaaaaactctctgtccaaagtaatgggggaaagacgagatgataagacaaggcccctctactccctcagggtggcccctgtcatgggggcgatggcacaagggttcacctggagctggccagtgcttggacagcagaccccatggggcggccgctccccacctcacatggcttccctggcaggtgccagcccaccccgcagggcgtgcgaggcagtaataaacggcatctaagtgctttctgcctttaggaggaaaaggctccctgtcgaccgagtatcagcggcagcggctgaattattaacggcgttatcgttcatcgttggtgtaatggcccctgtcctcctacacggcacagaggacagaaatgaggctctcggggaagagtccagtctctgagaatgagctagagccagtgcgcttggtgggccaggacccagtgctgggaagcatccttgcaggagctcccacggaaggccctgggggtgtcgccctggactcacaaagctctgctcgttccggatcccttctgcgtttcctgccgttccttttctgcccaaccctccaggcaagcccgaggaggattagaaactcctggaggtgggcgaagaagtgagcggtggcacacgaatcaggacacactttgcccttcccgtctttgttccggggcgcagcagctgcccagcaaatcagagcctggagcaggagacggggacacaaagcaggggatgaggaagggagcaggaggcggggggtggagggaagggcatgtgagagggtccagggcaagagacagcagggaagggggcaaggggtgagtggggagggtgggccgtgcgtgtcttaggggccactccagcagcagcagggaccaggggcaggtgcagcacagatgtccaggagctgccgccacccaggggagggacaactgggtcccagagagacctcggaggtgggatggccaggagctgggagggctgcatcctccattcctcccaaatttcaggatcaaacccctgatcccggtcgtgggccaaccagggcgcccggggataccccgagagcgcccgccgccccctgaggatgctccaggaacccccgcccacccctccgggcccagcgcagcctggcagccgggaagccagcagctcctgaaggtctgttgtttgggtttgtttgtgcttctgtaaccgggagctgagatttatttctttaaaacatcccattgcccgacaccctgcaatctgttctgtgtgtcgttcagactaatctcgtcttgtttctgtagcacttggcaggctctgtgtggcgttcctccctcccccagactcccccctgcccaagccaaggtggccaccaccagctgctccgcctgcacccagagagtggccgatgccaggggtctgagggaagctgttacgggaagggcagctggctggtcagagccccatgaactggcatgtggccatagtcagtctagaaatggccacaggacatagcctcgccccagcagtctcactgtcaggcggagaagccaagcaggcgcccagccgagcactggtcccctccctggctgcccctcagctctgggagcttggaggggctgccaaagaattcgactgggatgccaccgtgcccagccctctggtgtgcaactgtggcatggctgtttggctcacacatgatgtctaggcagagaaggggctggcgggcttggttgggtgaggcctgtaagtgagctttggtcagagacccagctgtgaatccaagctccactcaagacccgcagggggtggccttggacggtgttgaaccactctgtacctcagtttactcctctgtgaagtgggggcattgtgggggttcaggaaggccgtgcgtgtaaagctctgcacagagggctcagtacagggcagatagacagtcatcatcactgtgtacctgactgagttgccagccccgttggacgtgctcgtatcagtgtcctggggctgctgtgacaaaggaccacaaaccgggtgcttgaaacaagagaaatgtattctctcacagtcctggagccagaggtccaaaatcaaggtgtctgcagagccacgctccctctggaaggtctaggggagggtccttcctggtctcttccggtttgagtggctgcaggcattccttggcttgtggccacatcattccgacccctgcctctgttgccacatggacagggtgtgtccctttgtgtgccctctcttcttctcatacggatgccagtcattagatagggcctactcaaatctagggtgacctcatcttagcttggtgacatctgctgagaccctatttctgaataaggtcacattgggagcttctgtgtggacatgaatcttgggggagcactgttcaccgcggcatatgctctatgggtgccaacctgaatcccagaaacagctcccgacatcagtgtggtcatcaccccgttttaggaaagggtgacgcagagctcaagccttcagcacaagtgatggctgagcagtgactctggttaaaaacaaaaagcaaaaaaccaaacacaatcagggccctgagaaactccttgtttctgtcatgtcagttgctcctcatggcccagcctcgtcgacccctagagctgagcgagtgagtctggtcaggagtcccagacaggttgctggggccccggcaaagacactatagaaatgggcttccaaagagacaaaagagattgtgttcattttagaaattcgagggtggccaggcctggtggctcaggtctgtaatcccagcactttgagagcccaaggcgggcggatcacctgaggtcaggagttcgagaccagcctggccaacatagtgaaaccccgtctctactaaaaagtactaaaattagccaggcgtggtggtggatgcctgtaattccagctactcgggaggctgaggcaggagaatcacttgaacccaggaagcggaggttgcagtgagccgagatcacgccactgcactccagcctgggcaacagagtgagactccatctcaaaaaaaaaaaaaaaaaaaaaaaaaaagaaatttgggggaaaggcagaagggaaatatttgtgatctttgatccctctggtgttgccgttatcattttggttggttttcttcctggactttcaaagttgggaattgtaattgtctattccaggggttggcaggtgggccagacagcaagtattttctgctttgggggccagatggttttggctgcagcttttcaattctgcccttgtagcatggaagccaccacacaatgtatgttaattggcatggctgtgttccattaattttttttttttttgagacagtgtctcactctctcgcccaggctggagtgcagtggtgtgatcttggctcactgcaacctccacctcctgagttaaagcaattctcctgcctcagcctcccgagtagctgggactacaggtgcccaccaccacacacggctaatttttgtatttttactagagatggggtttcgccgtgttggccgggctggtctcaaattcctgacctcaggtaatccccccgcctcggcctcccagagtgctggggttacaggcgtgagccaccgcgcccagccccattcacgttttattaaggatactgaaagtggaatttcatataattttcatgtgttgtgaaatattctcctctggatttttttcaacatttaaaaatgttcaaaaccatccttcacatgaaacctgcacgcaggtgtttgtaaccacttcattcatacgggcgcggtggaagcagtcaggataccctgtggtggtgggtggatgtgcgaacggtggcgcttccctgcaagggaatattgtttatggataaaaggaaatgagctgtcaagccttgagcagatgtggaggatgctgaaatgtacattgctacgtggaagaagccaatctgggccgggtgcggtggctcacacctgtaatcccagcgctttgggaggccgaggtgggtgatcacttgagctcaggagaccagcctgggcaacatggtgaaaccttgtctctacaaaaaaaaaaaaaaaaaattataataataatacaaaaattagccgggcatggtggctcacacatgtagtcccagctacttggggggctgaggcaggaggattgcttgagcccagaatgcggaggttgcagtgagcttagattgcaccactgccctccaacctgggtcacagagtgagaccctatctcaaaaaaaacaaaaaacaccagtctgaaaaggctgcaagctgcatgattccagctttaggacattctggaaaaggcaaaattgtgaagacagtaaacagatcaacacctgctgggggctcaagaggagaaaaagataaatgggcagatactggattccaaaggcagcgacactattctttttccttttcttttcttgtcttttttttttttttttttttttgagacagagttttgctctttgtgcccaagctgaagtgcaatggcacaatcttagctcactgcaacctccacctcctgggttcaagcgattttcctgcctcagcctcttgagtagctgggattccaggctcccgccaccacacccagctaatttttgtattttcagtagagacggggtttcaccacgttggccaggctgatcttgaactcctgacctcaggtgatgcaccctccttggcctcccacagtgctgggattacaggcgtgagccaccgcgcccggctgcagtgacactattctgtgtgaggctgcaatgatggacgcctgccactgtgtctctgaaaccccatagactgtacaacaccaagagtgaacctagtagaagccctgaacgtcagttattactgataatgtatcaatattggctcatcagttacagcaaatgtaccacgcaaatgcaagacattaatggtatgggaaagtgtgtacattgaggggaaactcgctgtactctgctcagtttttctgtgaacctaaaatcgctctaaaaaagaaagtctattcatttaaaaaagtcttcgttcatgggctgtacagaggcagagggcagcctcaatttggccctcgggccatggtttgtggatcccccggtttaggctaacagtgcccaatagaaatgtaacgtgagccacctctgtgatttaaaattttccattagccacgtttaaaagtttttatttcgaagtaactacaggaagttgcaaaaaaaaaaaaagtaccgggaggccctatacacccttcacccacttccccccatggtgacatcctgcatagaagcatagtacactctccaaaccaggaaattgaggttggtacagtccacaggtctcacgggtattacaggcacccatctgtgcttgtgtgtttagaatcctgtgccactgggatacatgtagcttccggcaactactaccactagctagacgcagaaccactcccccaccgcagggttcctccacgctgccctggcacagggcaaccactcctctgtaagaattttacgtaactggaaccctgcatgatgtcagctttgagatggactttttttggttcagcatcatcctgtgaagctctatccaagctgtcctgtgtgtcaagaacttgttcctttctactgctgagtagcagcaccccacggtccacgcgctcacggactgatggacatgaaccatggcttcccattcaggggcgactgtgaataaagctactaggaacattcatgtgtggggttttgttggaacctaagttttcgtttctctaggataaattcccacaaatgcacttgccgagtcatatgtggattgattgtgtgattagttttttaaaatacgttttttatctagtaaaaatagagacagggtttttgccatgttgctcaggctggtctcgaactcctgggctcaagcaatcctcccgcctcggcctcccaaagtgctgggattgcaagcgtgagccaccgttcccggcctatgtgcttagtttttaaagcaattgctaaactgttgcatagagtggctgggccgttttacactcccaccagaaatttacgagtgccttgtttctccacatcctcatcagtatttgaggttgtcactattattttttttaagcatcctgatgggtgtgtagtgacatctcattgtggttttaatcagcatttccctaatggctcgtgatgtcgaatatcgttttgtgtgtttatttgccatccaggtatctgattctttggcggaagatctctttgtctcttaagcatcttcttatatcttaataatatatatcgaaaggcttatggggacaacctttggttggaggattttggaaaaagtcataatatgatttattgtggcaaccagaagcgataatattgttctagtgacaggtaacaacctgcttttttattcctgttaatacatgatttcttttgtgactgtaataaaacaatgtatacaaacgattcactgcaatgaagacagatacccaaagagacaaagagacatcgtctaatccattttttgtttgttgactactgagttttgagagttgattatacactctagaaactagtcctttgctagatatgaggattgcaaatatttctcccagtctgtagttctttttttcatcctcttaacaggatcttgcacaaagcaaaagactttaatgttgatgaagtccaggttatgagttgtgccttttatgaatcatacttttcatgtcaagctcaagaactcctgacctagtcctagatcctgaaagtttttttctttttttttgtttttgagacagagtttcgctctgtcgcccaggttggagtgcaggggcgcgatctcggctcactgcaaactccgcctcccagattcacgccattctcctgcctcagcctcccgagtagctgggactacaggcgcccaccaccacgcccggctaattttttgtatttttagtagagacggggtttcactgtgttagccaggatgatcttgatctcctgacctcgtgatctgcccacctcagcctcccaaagtgctgggattacaggcgtgagccaccgcgcccggccgatcctgaaggttttctcctgttattttcctaaaagttttacggggtcgaggtttatttatttatttattgcctatggatgtgcaatgactcccgcgtcgtttgttgaagaggctgctcttccttcattgagacgctttgctcttttgtccaatatcagttgggcatatttgtgtgggtcttataggtacaattttttttttttgaaacggagtctcagtttgtcacccaaactggagtgccgtggtgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttttgtaaattacccagcttgttcaaaatagtatcattccaatgtgggatcagtatacacggccgccgatgggaagtgttttacattctctctgtttaccaagtcctgggaatttcgcgtgtactttacacctagaccacgtctcaagtgtgatgccacatgtggcttggggtcactgccttggccagcacgagtctacacagattggcgacctgcttttttgaaaaaacattctcggccgggcgcgatggctcacgcctgtaatcccagcactttgggatgccgaggctggtggatcacctgaggtcaggagttcaagacaagcctggccaacatggtgaaaccctgtctctattaaaaatacaaaaattagccgggcgtggtggcagacacctgtaatcccagctacttgggaggctgagacaggagaattgcttgaacccaggaggcagaggttgcagtgagctgtgatcacgccattgcactccagcctgggggacaagagtgagacttcgtctcaataaaaaaataaacaaaacaaaacaaaacaaaatattctctggccagcccttcttcatggactccctcttcctttgtccttgatggttgggcagcctctaggaggagggggtttcattgcctcttgtcgggggttcacagccctggcacccccccggccctgagctgggattctagaagtcaccagccaggtatgtcccccaagggagctggattctaaagagatgggggcggagccagtgcatctggtgggccgtcttaaaccatgctgttattgactgtcttccgaaggactgacagctctttaaaaagctgacctttctagtaaaactgtcaggacagggaggaaataagtgcctcaaacctcctgaaccaaaaagaaggaagttcaggctcctggagaggcagtgctccccagggatgggcgctccctgcatcaggagggctgtccaaggtcagggaaatgaaacttgtcagccttttccaccgcagctcagaaaccattgacagctgctccgggaggccttgacgcaaccccggccggtggttgcatgggggctgggggctcctggtgctctcgaggggctgagctgctctgaatacacagagctgcccttgggaggctcccgagccccagctcttgcatcaacagccctggcaggggcctcacaggccacgtgagcttctgagagctctgagcatgaggtcacgggctcccagaggcagtgatgtggcagcgcctgtctcccggtgagttggggagctcacaccgtacctctggggaaccacgcctggctgttgcaatgtaacccagcacctgatgaaatcttccctgaaagttgcaggtagtgggggcaaaggaccttttgtcttgcggtcgaaagactcccgtagctggttctgtttggcttcatatccttcccagcagagtaaacagaaagggcattttcacgtggctcttccttccagtctgaacaatgttccctaaacacctgcaaggcagaggacacagggctcctggtgcccgtccacctaagtgcctcctggcctcagggaatctgctttggggacctgaaagtaaggttccctgaccatcaagaacagacagacactcagccacacttctggaaacctccgccctttgaaagggactggctggtggaagcaggcggcctggggcatatccctgaccttattacccccaggtggtgacagagatgatctttaagtgtgggagcctggagccaagtccttggccacatcccagctctgcctggctgtgtgctggtgggttattaccctcattgcctcagtttcccctctgcacaatggggctggcgctagtgctccccaccccatagactgtcatgagaagtagcatctggacaggccctgagagcagtgcccatctctgtgccatccgctgggactggtgttggcctggtactgtaccgtctcacccttgtgtccccaggaggggagtggggtcgagaccagccccaggggttacatggacaatggggttacatggacaaatgcctcttgttacattttgttcactggttcccaaaatgaggtgcaggctctgcagagaaagcaggctttccccgaggggctctggagcagaaagagctgtctcaaggtaggtgctggggctggggtgatgtgagagcagagttggaagtgggaatgttctggaaggagggagagggctagtggcagatatgtggtcaccggaggaggagccctgcgatatatatcaggcagggacagggagaggagaggcgacctgggaccccgaaaaccgggtgggtggtcgctgtggcctctcctgggagcctcggactggcggttagggcagactccagtagattgtaaaggcatcaggatctgtcttgcttctgtaaatatttaaacactgggaggattatttttggtagctacggtctctctccgagcctggcgggctgccgggacgggtgtcaagtgacatcgggtgcaaggataccccaccccctggccccaccggccccaggctccgtgtgttcacctttccaacggccacagtttgatgtgggtcacggtttccccttctaggagacgcagagagatggtctcgggcgcgaccagcagggattcctcgtccacacagtttcctgacagcggttgaaagggacgggtctacgcaggccaagaacagcagcggagtgtggggtcaggggcccagcggggggcaccccggggaggggccgcctccgccagacccaccccgggtgaaaggacgcattgtgtgcccgcagcatgaggggagcctgcagagaggcgtctttgtagggtccacgagggggaaagcgcttcccggcaggcggagcacacaagccagccggtggccacggccgggacaggcttgtacgcaggacattgaggtccggcgaggatgggggggccaccaggcccccggccctttgcagagtgttgctcgttttctcccaccccagaattgggcttggccaacacggcccccccaaccatccccccacccccgccagctgcccggagcctctgtgaagatggcggcaccgtcccttgcaaactccatctgcgtggaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntagcagcaccgtccacagtagcccatggtgaaagcgtccaagttcccccgtacgggtgactagagaaacgcggtgtgttcacacacatgttccacacacacccagcggaacgttcagccttgggaaggcaattctgacacgcgccgcaacacggtatgagttgaggacgttacgccgagtgaaatgagccagacataaggggccaaatctgtgtgattccacttgtgtgcgacccctggagttgtcaggctcagagagggaaagattggggtgccaggggctgagggaggggacgttggggagctggtgtttcatggagacaaagcttcagtttgggaagaaggagagttctggagatgggtggtgtcatggttgcacaaaaataggaatggtataatgccactgggctcgacgttgaaaacggttaaggtggtgaattttatgttatggacattttaccacaataaacagagagaaggaaaaatcagttaagaccttttaaggtgactgggactgtgagactggtgcacgttttcccatccttttgagaactgccttcttggattaggtctgtaagcctgtgtaggttgtccccaccccagcaattggtcgtgaacttcaagcattgggaaatcacgtgggaggtggctgcccaggctcacctctgcccgggctgcaacaggaggctctcatggggcaggtgctgcgctgtggccagagtgctggccgggggcgtgggctcccaccacctggagccggcccctcgctggctgggcgcccgagacccgtcaccgcacatgccttgtgagggctacggctgctgtccacgcggctagttcaggctgagttgaagcctccgtccgagcagctgaaagtcaaatctagtcgttagactctgaaagctggttcatgtcagagacctgacatggagtgtgggaaaaccttgacggaagcttccagagcctggcaagattagatcaggaagtaacactttacctagtgagcttagaaaaatagactctccctgttgtcttctgggaactgggaaatctgagcgcaggtttctgggcatggatgctgcacacaggcctgcccctgggggtgggcagcaacaccccagccaccccaggagggtggggacccctcggctgacttttgggaatccagagggggtcattacagaagggctggcgctagagtggccatgagggtacagtgggtccctctccgcaccccttgaccccagtcatcttttcaataccgttctctggtgggacttgcgagggccgatgctgaggctgctctgcttgtgcagagaggacattcgtgtatttgaggatgttcgtgtatttgaacaaaggttgtagtgtcttggcctctcggcctttggcattgccaggtatctgggcagaaccagctagagctgctggagaatacatgagcagtatctagaacaattccgaactccacaaggccagtttgccatgccagactgttgggaagaggcaacgacaactcgtatttatgactctgtccatggcaggcaaagcgaaccgtggcttttcatcctggaaataccccagcacagtgtttttgtgggagcctgttactcaaagcaggcacagagtggaaaagggcccgatcaaggccacagtgtgggagctgtcagagcagggcaggcccgaggcccagggctctgctgaaccaaccaccagtgagaggggctttgatgcgtccagtgataaaacccgtcgggcaggtcctgggagggattctggctttggggactttgctgtgcttaagtcatgggcaaaagttcctgcgctggccaattttgttttcatcgaatgtggggatccctgttcagggggcacacggtgctgcatttgagggtcttgagtggtcctccacatttggggtgtcctttgggccatgtggagccctgagaaggattgacaggtgtttgggagtttgtgtttgtatcttggacgatggaggagtttccctaatcatggtgttttttcaagttaagaaacttcctttggagaagccgttttctcttttactgatgaaaggcttcttctcggcaggaggactgaaggtgctgggtcctgagggagggcctggggccggcgggcaggtgcgggttggggagggtggcaccgtccagcccagcagagcccagaagacgggaccaggctgaggacttccacggggctggccgggctacacagcaccatgcttagcgggattggactttgattttctgtggctctaactgataaaacaagcaggggccttctaagttttgctttgaggttgactgccaattaaagagccaacatctggtgcataggaccctccagaaaaagtctttttgcccttaatgttaattttttcccctttgttggagttgatttgttaagttgctggtgtgtgttgacaactgtttggtacagaacgcaggcacgtgcgttcaccaggaccctggcttgccgagcgggaggtggtcgactgtggactctgggcgcgtttgactttcagccatggtcttatgattgggcagcttccgtccggttgctgccccctctgccccttgggcatacgcccagtggagcttggacctgactcatagctctctacagtcgacaaaaggaaaatgtttcagtttgggtaaatcagccacagctggagccagggagaggcccatgggctggtgacttttcagggtggtggtgtttgttcagcgtgttgttttgctctgtgactttggagagtgcatcaaaggctcggcggacgcccacttgccgaggagccacggccctggctggtggccaggcaagcacctcccaggtaggcgtcaggggaagcatccaaactagtaaataaaacggcttctggcaggacgtgctatcatccccctctcccttctaaacacacacacgctttcacagagaagaacttagaagtatttcgtttgaatcagaaggaaatattgaatatcgtctcattctcccccacctaattttttttttaaaccacattcagaattgctgggcaacctcatttccccacatttaggattcttccctcgaaatctcatgcaggcgtaaaatccgagagcctcggagggtttttctgagcctctgcatctcccagcaccccgcccccacccagcactcatgtgtttgtctgctttaaaagcttcaggatgggaaattcctcaccagcccgtaagccgctgtttgtaggagcccctaaactctgtggaacccaaatctcccagtactgacttaattcccttttccctgagaaccagctccctgcagcacccagggttctgcccgcagagggaggctgtggctgggagtggaaaatgcccagccaggggctaccttcatggggacattccctacccccatccccaccttcattcggaaagagtcatgactcctggtcaccaggcaaacttctgtacctgcttattctggtttaaaaataggtcaggcatgatgactcatgcctgtaatcctagcactttgggaggccgaggcaggaggagcgcttgagcccaggagttcaagatcagcctggacaacatagcgagaccccatctctataaaaaataaaaaatttagctgggcgtgatggcgtgcacctgtggtcccagctactcgggaggctgaagtgggaggatcgcttgagcccaagaggtggaagcggaggttgcagtgagctgtgatgtcaccacagcactccagcctgggtgacagagcaagacccagtctgaaaaaaaagtaaaaaaaaaattccttaaagaaatgcttattccccgctcccacccagaccgagacgctctggaacaattttctccagtgcttgagtttgggatgagggcctggaaagaccatccagtctcctgcccctggtgggcagccagttctgccttgggcagcgacactgggcacagcccgtgacccatcctggccctgatctcttctggctctcaagggaggttctgtggccccacctcaaaattcagggtccctctgtggaaacaaaacatatcccagatggatttgctacaaggccatcccgggaagggagccaagtaaacacagcagcagagaccggagggcgcgaggggacggctgaccgcagtccagctcctcccatgcatcacgccctcccaccggcccggcctcaggcttctcgttcacccccatcttcccgtggacctgatcggaggtgtcatctcccgctgcgggctgaggctctgaggagggccgggtgtgtagagccttccttggaagggaaaacccaaccaggatgttggtttccgagaggaagcccgttcacccaccatggtggctctgccctttaataagaggcaaagaactcgggtgctgcgggtactggtcactctgtcagggcagacataccccttgccgttcatccttcaaaggccaggcttcggcagggggcggcacgtgtggtctctctttggccttttctggtggaaggtcctggggtagggagtcctcacgtggttgctctgcagggaggggccctccaaaaataatcccggggcctcttacccaccactgcaacgctgacgatactgcactgaggaatccactcttgagctttgctttgaaacgctgcacatttgcgtctgcccagacttctgtctaagaggtgctcagagatcaccttgcgtttatgaagcgaacgtggccttgggatatagacctggggccccaagtccaagaccagtgaataaagtgagagatggctttgccccaagtgggtgaggtggacccagcacccatgcttgccgcctcctgccctccctcccgcactttgggaccacgaggaaattggcactgcagtgattcatgcagctgctaatcaaaagcttttatttcctgattatctctccgtttgagggatggcagatgccagtgcagtcaaaatataaacagattctagtcaggacctttcaaagcagacaccagccgttctgaagagcggagggccgcgccccttatgccgcctggcagaagagtttcgttgggaaaaatggtttttcataacctttctgctttcttatttaaattaagctttgccgggagagtttggtagtagcagagggcccctgatttggtcccctttgacctccacagccttgattggcagtttgttgtgggcattgaagttgtggctgcgaggtgggagccagcagaacaaatactctaggacagctgggcatccccgaggacccagccgaggggggagtgtgcgcaattagagaggtcttcacacagaaagttaattagctactaaatggcatttagcacagtttatgagaattgcatgtttgaaaagcaaatggagatcaatgcggaatggctgccaccggatggggacccttggacccagcaccagtctcagggcctgggatgccccccaccccgagcgtgagtgccaggccagtgcccgctgagactggactgggagatgctcctcgaggacctgcctggccttggggggcagtcctgcttcgcacccacagccgagcttccctgtccaaaaaaagtgagtaaacacgtcttcagtttcggggaactgtgtctgccgtggcctggatagtgactcccttccccgcaaattcatggccactcagaacctcagaatgtgactttatttggaaatagggtctttgctgatgggatcaagggaaggatccagttgaggtcttcctggattagggtggccctaaatccaacggatgtctttaaaagacacggacggacacacagacacaggaggggcagggagatggaggcagagatgggagtgatgctgctgcaggcttgggggcttccaggatccaggacgagcacctccagctggaagaggcaggaaagactcttgcctggagccttcagagggggcgcggcccgactagcaccttgactttgacctccagaactgccagacaatacatttctgttgttttcaagcttctggtctgtggtccttcattacagcagccctgggaaatgctgtgtcaccaccaaaacgcagcccccaaaacatagccccagctccatcgcagggctgtgtccgaagctggaggatggtggggtgggtgggggggagccagagggaggccttaggacctgctttttgtttctgttatgatctgaggtctgacttcagtgtggtcttttcacctgcttgtcttagttccctgttgatcctatggagggattgcttggggctatttttgttttggggagggtggtttttgctctttttaactgttttttttttttttgcctttactgttttccatgttttggagggcttttgtttgtctcctttccttccttccttccttccttccttccttccttccttccttccactccctccctccctcttttctttctctttctttctttttctttctttctctctctctctttctttctttttaattataaaagtagcacctgctcctaaggaaattctgggagatagggaaaagacaaaagaagggtgtgaagccccaccatacccagctcaccaccgttaactttttggtgtatttccttcagccttgtgtttacttttattttttatttttgcttccgatgcctaagttattttacagagttgtagacaggcaggctgtatataaaattcactttcttggtttaaaattttttttgattttaggccaggcacagtggttcacacctgtaatcccagtgctttgggagactgaggtgggagcatcacttcaggcctgggcaacattgtgagatcccatctttacaaaaaagtattgaaaaattggctgggcgtgctggcagatgcctgtggtcccagctacttgggaggctgaggcaagaggatgggcttgagtctgggagttcaaggtcagcctgggcaacaaatgagacccccgcccccccaccccgccatctctgtaaaaaatacaaaataaatagtcaggtgctgtggtgcctgcctgtagtcccagctactcagggaggctgaggagggaggatcccttaagcctgggagatcaaggctgcagtaagccgagatcatacccctgcactccagcatgggtgacagagcatgaccctgtctctaaataaatttaaattttttttaaattttgtcatatttgatacatgccaaagaatatttgtagcatgtaaaccatgaaacacaatcataaatgaaccccgtgacccagcgccccctgtgtctgaactagagcttcctaggaggccagtgctccactccttcctccccagtctggtcgttccgtgccccggtctccagaaggaaccaccttccggaatgccgtgggcggcacttccttgctctcctaaagcaggctttgcacacatgtgcacttctcaacattctgccttgctttgagccctaggaaagcgtccccgtctttgtagccgtcggtggctcagctccccgtgcctgaggtgctgcgggtgctcactccaatagggggacactgtctccatggctgttccccaggttgtccacactcctgttgatgaccatgtggtttagtttgggtttttctctgtgaatgatgtcaccttgacagcttctgtgcacacctttggtgcagagggacaggagcccctccgaggggcccctgggccctgcaatgtgcactcaacctcctaagacacaccgactgcatttcctggggtggggccagctgagagtccctgagattacatggtctgtcttgccattctcaattcatgccctgccataaacccctcccgcgctgccacgtcttctgaaccgccactgggtttcacgcctgcacagcggcctgttggtgagggacgtagcatttcacttgcccatgccccttccatggacatggagctgttcccggcttcccgcttgtccttgatgaacacgtctgtgcttggagctctgcacacagaggctcggggtggatgcgtgtgcacacacacagggattccgcacaaacgtggatgacgcaggttcagtatttacgtgtacacacatatgcatgcacaaagaagttcaatgtcatattatttattttacaaaaaagtggaatgagtaacatcccaattcttgcctacagggaatttttttgttttgttttgagacagagtcttgctctgtcgcccaggctggagtgcagtgacgtgatctcggctcactgcaatctccgccccctgggttcaagtcattctcctgtctcagcctcccgagtagctgggattacaggcaccggccgttacacccggctaatttttgtatttttttttttagtagatgcggagtttccccatgttggccaggctggtctcaaagtcctgacctcaggtgatccacctgcctcagcctcccaaagtgctgggattacaggcctgagccannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaaaaaaaaaccacacaaagaaaaacgacaatggaaacaacccaagtctttgtctataaggaatgtttagagaaaacgtggaagcggccctcaaaaagaggtgcagcttatccctgcataccgacagggctaaggccctggatatagtaactgaaaaattccaggcgtaacacaatgttgacagcacaatctcacttttgctttaatacatgtgcatgtgtgtgtgtgtgcgtgtgtgtgtgcgcacagggaagccccggagggccgcgtcctgctgttccctggcgcgcccttggaggagtgggattgaggttgggccgaggctgctgctgcagggacggatgtgggtctgcttcgtgcccgtggcaggttcagcgttatgtgcagtgagcacgttcttgctgagattacagaagagccgagggagccgctccgagggtggcgcgtcccttgcctccggtgtgggaggtgcttctttgactgtagccctcccagctttggaggtttggcctccccgctttggaaaacgaagtgttgctggtaggatggcttaaaaatcatgttcatgcgcatttctttatcaccgacgatcttgaatatgtctctgcgtgcttgttcacctggtgtcttcttttgtgaagtgtgtgccaaagaaggaaggggttaaacttgtcgggggcacccagagcttccctggcttcctcccttctctccggaaagctctgaggaggtattagaggattgctggaggtggaggcccgaggccttctcccagcagggcccgggcagatggagggtctaagaacatacccgccgctggtgaacagccattttgctctaagaattttctgtcggccagggccccagtcctggtttgcgtcaaatcctctgagccgggccaagcagtgcattggtgcggaagatgctggctcccctgaaactaggcccaggggatgggaaaagccgagtggagattaaggagggagcgaggaaacgatgcctaaacaagttctgtccttccgtcactgctgccacgaggggctagatacagaattcagctttgctgtgacaagtgtgtggatggaatttaaatgaatataaatgagtagccaaggtcttatcaaaggatgttggtgattggtatcatgactgtttgccctttggggttggggtgctggagagtacccaccagttccctcagggcctcccggggcccaggtcacgtcacaacccctagccatggtcccagcagctcccggtcagctctggctcaactcacaggctccccttccagcctgcaggaacagtaacggggaccagggcacagattcgggcagtcccaggtgtgccactgagtccgagaagatttttgggaagcaccagtcagtcctgcacgttacgtctctgctgttggggtgcgcggaggcggttcgagtgaaccctggggggctgaaaggcgggaccaagccatgtgggatgtcacaaagcccagcagctcagaatctagaaggttctggctttctgttccccgttcctgccacccactgtgtctcttcgccagtccctacactgtctgcaccacagtgtcctggttagggagaggaacagactgggcctggtgatcttcagggtcctccagggcctgcgggttctgtgtctttttctggacaaaccctggttacaccaccccacaacgtagcggcccagactcccactgcatgttcccctgggaacctcttcttagtgtcttgttcctccgggaaggaaggaaagctccggcttgttaggcggaatttgctgaccctacatggtggtcaagaagcccgtgccgtgaagccaagagagaaggggaatttgggctgcaagcctgaaaaagagttcatgaaatttaatcagatgcctaaggggaacacctaaatttagtcaaattattatcagtattcactccatttttaaattgcctaggggaacgtcacggaaaagttgggaagccaccagcctgggtggtgattattctgtttctgcagagcagtgggatgcgctgggaggctcggaggcccagatgaacctcgcggccaccctccacggcacggtgagctgctcctccaggtgcaaggatgggctgcccagagggtctggggaggcaccggtgcccacagccgtgttgggcaggcctgagggcttcttgtgtttggccataatggatgtgtctgggacctggaccttggcctcctgcgccccaagctctggcccgcagagcccaccacctggaagccagagcccacccatagcaaggcctctgtctgtgaagacccctcccctccttgctacttggttattctctggcctcagtctctgcttggttctctagtcagggtgagcttttggtggatgtgaagggagaccagggtcctttcctgctcctagtgagaaccgtgggatttgcggcctgacaggttacattcctttccgggctgatgtcccagctgtgtttgcaggaaacagtgaaggtcgacgtgtgcctttttatggcaccgaataacctggacctgcgacaggaaccgtgagcgtctttctgtcccctaaaagtatttagatactaattgactgtttggtcctgcagagatgacacagggacgtcttcacgcccagatgcatttgcagctatgcggtcctcccgcctcccgcttcaggcctctcccatctcccctgggtttccacacagtgtcgcagcttcacctcgagagggccacgtgattggcggcactggggatgcctgagcccttgatccctctgctggggtccagggcgtgggtgtgcatccctggagcgtgtgtgctctgggcgtgggtgtgcgtccccggagcgcgtgtgctctgggcgtgggtgtgcatccccggagcgtgtgtgctctaggcgtgggtgtgcgtccccggagcgtgtgtgctctggccttccctgcccagctcctatggctcctcctttccctaggttgggcagaatctcccaggtgtgctgctgatggacaggctgagagcgtggagcccacgagggcgctttggtttagaatcatctcattggtttgcccacgttaagctcctataaaatctaggggaaaaaaaataaacattctttttgggttcagaaaaatctcttggctgttttcttcccagtaatgtgtatttcaaggacgaagtcgagagggaatgaaaacagaacgattggctctcaaaagcctggttcaggagcaactgggagtggtctctagactgcttgagctattaattattttgctttatttattagatgtacccagcgtccctttgcctccaagcatatttgcaaatgccttaagggaaaaagaaaaacaaatgattcctgccatcagagtctccagcccttaatgaataacaccgtgtaatcacgctgaatggaaaaagcccagtacggcatcacgtgcacgtcctgagtctaagtcgtcacagtcgtaaatgcacgggacccacggaagctcagaaactcgtaacagctgtgagatctgttcagtggaatttttcttaatttccctgggaaatccacaaggtcactccatatgactaagaaaaaattaaaacagaaacagcactcaaaggcctggtacattctctcctcctacctgccgcggattgttgcccgcccgccacggcccccaccccgccccgacggctggcaaaggaacagaagaaaggccgggcctggttatcttttcctaaaccgtgctggtaatcaacctgaaggatgtgcctgcccgcttcctcccagtgatttacaccttccctaattagccgtgatgttgcagatcggcagagttaatcgccggagcggagaccctgccttcccagttcccagcagctctggctctgggagtgtgccgcccatgccgcgaggagctgcgattcatccccgccccgcttggccctgtattttccggccttgctgctcccagtccctctggctggaaaagccaggctgtctcggtgcatgcgggatgtcggcgctcccgagctcgaccgtgaccatggggcaggttctaggcctgggatggcagaatccggccggctgtgcgcccatcacttaacattgccacttatgtcagaaatggcagcttgagcctaatagagccagcttcccgtgggcccccctcagcatccaggcctctgaaaagcttaggggtcccaccccggcagcagaaggcaccgcagtcgccgaggctttattgctctgcctcttcgaactggcagccgcatcaatcgccctcccgtgcacagccggctgggctctgcgagcagactccagagctgggtctggctgcctctgtggtcagcgggaagctggcagagtccagcctctcggctggatgagtccagtaccgccgtgtgcacatgtgtgtgtgatgctaattatgccagacgtgcttcagttttgctgggaacagttagcttactgtgcattttagaaactgccaggattttagagcctaatggggttcctagagatcgtagcgtccagccaactcatcgccgtctcacaggtgggggaaggaaggtgcggagagctctctctcctccgtcacccccatcctgctgcgtgccaggccctgtggggcaagggttgcagagatggctgagacatcacccttgcctgggggaccaagacacaccagtgggttgcagatgctgggaaggggccaggtggagggatgaggcgtcagggaaaggtggtctctgcctcgttggagtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnccagtggggcttcaggaaagctttggacgttgggctggggttcgcctcgttggggaaggcgtgaaatgacccaggcaaagtaggatattctggtggacggatcactgaaaaggatgaattcatgggcaacagagatgcttgggttgaatgctggattttattcctcccttcctcctgccagaggctcctgacacttttgttttaagtcaccagagcagctcagcaggcaggtagaaactgccccatcccgtgttccctgtagccttctgcagggcaggcctcacctgggctgcgtgaagcaggagaggatgggatgagaggggctgggatggagcagcagcctccacctctggggaccgattccatagagaggagtccttcagagtttgtttcagatgaatggaaaggcactgtcaacggaagaggcttcagaaaaatctcaagcttgctgttccctttggctcctgcctcgggggacttaaaccctccaggataatgacgtggagaagaccccagggcccagtgtatcagggccagtttgcatccagcatccctgctgagtcaggagcggcgggggtcttgctgtttggatctctggacattcaccagaatcccctaagctggtctttgcacggtgtgtttccctcacgcttttgagctcatctttgttgggaaggatgtgggcacaccgcacatgtgaccgacgcagtcattcgtttcaggcgtgtaaacacacacacgtgcacacacaataccgtgactctagccttcctccatcctcttctctctaaaactcctcttcccaaatgtccagtgggcttcttgtctgtgggccaacattggaaagccctgcgtgagaaaatgccttatggttaaaacataacagaggctaaagagccattttcccttgctgcaagagagacagcctgggacagtgcaggggccggtgtgagcaatgaccagacctctctgagcctcagtctcggcatcgacatgtagggtaccaacagaggagcagggctcttgcataagcttttagagtaatcactgcccagtataggttggttcttatttgattccatctcgctcccaggtttgcctagacaagggttagtaaggccgaggtcacaggttgacctggatgtgcacctgttctgcctggcggggacaagagagaacttggcaatggccaagtctgacactgctgcctggcgtccccatgccctgactggctccgttgcctggggagccgcagaagctgtgagggtgcaggaaggtctgtgcccatctcgtggcctggagagccgcctgccggagctgctgctgccatcctgaagcccagagctctgcccggtctctgcacagaccccgtcattccaaagtggggctcatgctctgcaggtgtgggcagacgcaggcattgcctgaatttgtattgtactaagggctgctgggagcgttagtgggcagccagcgacaggtttgggctggctgggggtcccgaagctgtgcacagttggttgcaaactggaggaaaaatgatatttgtcttttcacttcagggtggacctgttgtgggcggtggctgtcttcatgcacgacccccccagtccccaaccctctgtcactcgttgatcctttgaaatcaggagctgggtctccagagggcattgcggttgctcccggtcccattcttttgagcaagctttttgtgtaactgatcaaggaatcttcacaggggcttaaagaacacctggctggctctcagcagccttttaagtaggccatgtaggaggcaagggttcccaggaaacctcacagccagctggggccaagggtgtgaataggacctggcagaaattccagtcggccagagctcaggctgtacaaagctgggcgttccaatccaggtagattacaggagatcgggtttgttttgttcttccttgaatcccaaagactagctttcctgacacggagttcaccaaatgcaaagggaaaaacaaaacaaaatgaaacagaactcgctgtccaaaaatccaaagccctgctggagggtgaggagtgacgcggcctggcggattgttccgggtgtttgtggccttgcaagtaacgttgcgcccactggcagtggggacggcatggcgaggaggtgacggagcagagggcttcttccttgggccttcttacctatagagggcgcagtggctgcgggggtggccccaaccccaggtcaaaggcaaaaaccgaggccaaatcaggaatcggacagggaggtagccacaaagtcactctgaaagcaaggcgcccaggcttctccctctttcaacgtttttgaacctattccacaaactcctcagcatcataagataaacctgagcgtgaacccagcctcctaccagccccacctgtgagttggtgcagcctttgctgggtccccagggttagctagccctactgtgtgggtgccacgcctgagaagagcctgggagagccagggaagataagggaatgtgctttagggtggaggaagccaagaaactctatggttcacctgttttttggtttttagttgcaataaaatacatatagtcccccctcaatgcagctttgctttttgcagtttcagttaccctcggccaaccataatccaaaagtattaaatggggctgggcacagtggctcacacctgtaattccagcacttggggaggccaaggcaggtggatcacctgaggtcaggagttcgagaccagcctgggcagcatggggaaaccctgtctctctaaaaatacaaaaattagccaggcgtggtggtgtatgtctgtaatcccagctacttgggaggctgaggcaggagaatcgcttgaacccgggaggcggaagttgcagtgaaccgagattgcaccactgcactccagcctgggcaacagatgagacttcgtctcaaaaaagagaaaaaaaaattaaatggaaaattccagaaataaacaattcatgagctttaaattgcatgccattctggtagagtaatgaagtctcctaccctccccctccatcccgccagctgtctgggtgatcagatcggctgccctaggatctcagtgcttgtgttcaagtcacctttatttgactgaataatggccccacagcaccagagcagtgatgctgacaatttggatatgccaaagagaagccataaagcgcttccttttagcgagaaggcggaagttctcaactgaataaggaaagaacagaattctgtgctgaggttgctacgacctctggtaagaatgaacttttattacagtatattgttttgggggagggttttggttttgtttttgtttgagacagggtcttgctctgttgcccagggtggagtgcagtagtgtgatcatggctcactgcagcctcccaagtagctgggatgatggcatgcaccaccatgcctggataattttttgttgtaatttttttttcttttttttttttgagacagagtctcgctctgtcgcctgggctggagtgcagtggcgtgatcttggctcactgcaagctccgcctctggggttcatgccattcttctgcctcagcctcctgagtagctgggactacaggcgcccgccgccacacctggctattttttttgtatttttagtagaaacggggtttcaccatgttagacaggatggtcttgatctcctgaccttgtgatccgcccgccttggccttccaaagtgctgggattacaggcgtaagccactgcgcccagactttgttttaattttttttataaagacggggtctcactgtgttacccaggctggttttgaactcctgggctcaagtgacctacccgtctcagcctcccaaagtgctgggattacaggcatgagccaccgcgcccagccacttctattttattattattgttgttcatctcttactgtgcctaatttgtagattaaactttatcataggtgtgtatgtataggaaaaacatagtatttataggttttggcactatccaaggtttcaggcaccaacgggggtattgggttgtattccccttggataaggaggtaccactataacataaaatttaccatttttgtgttttgagacgaagtctcgctctgttgcccaggctggaatgtagcaggacgatctcggctcactgcaacctctgcctcccaggttcaagtgattctcccgcttcagcctcctgagcagctgggattacaggtaggcaccaccatgcctggctaattttttgtattttagtagagacggggtttcatcatgttacccaggctggtcccgaactcctaagctcaggcgatccactcctgcctcggccttccaaagtgctagaattacaggtgtgagccaccgcacccagccttaatcatttgtaagtgcacagttgagtggcagtgggtatattcacattgttatgcagccatcaccatactctccacctccagaactttttcatcttcccaaccgaaactctgttcccgttaaacaactccccatctcctctcccccaagcccctggcagcctctattctactttctgcctctgagattgactgctctggggacctgataggagtggaatcatgcagggtttgaccttctgtgtctggcgtctttcacttagcgtaacgtcaggtgtcattcatgctgtagcctgtgtcagaatctccttcctttttagcagggcgcagtggctcacacctgcaatcccagcactttttttttgggaggccaaggcgggtggaccacgaggtcaggagttcgagaccagcgtggccaacatggtgaaaccctgtctctactaaaaatacaaaaattagccaggtgtggtagtacacgcctgtgatcccagctactcaggaggctgaagcaggagaatcgcttgaatccgggaggcggaggttgcagtgagccaagattgagccactgcactccagcctgggtgacaaagcaagactccctctcagggggaagaaaaaaaaagaatttccttcctttttatagctaaataacctgccattgcatgcagggacaacactttctttctccattcacccatcgatggacactgggctgcttcggcctctggccatcatgaatgatgctgctgtgaacacggggtacacatacctgttcgagtccctgctttcagttcttttgagcgaccctttttaaaaatcaacgccagggccgttttcagagcactccgacctgtcctccgcggaccttccttgtccctgcacccactcaggctctttcttccccacaaagacccccacagccagcccccatgccacctgctccgagaggaagccttccagagcccccatccctaccccgtgggatgctcctgtctgacacctcccagcagctcacagtccaagtggtgtccaaattatccacatcctcagctcacctcctgtgaggtccatgtctcctggtgggtcgggcaccagcttcctcaggtcttccttgagagaagttgactgttgtagagaagagtgattgactctacttttatgagtcaagttgaagaatacgttaaagactcttcttttctaattgcccctgagccattattccaaaatggtgtctaccagcaacatgggaagataccttcaagtgtgtgtaaacctgcagaacgaactttggaagaagagtcactcaactgctgaccaggatgacctgggggacagggcttccagaccaggatgacctgggggacaggcttccaatgccgattctgcacacttcagtctttttaaaatttttaaccacaacgtgaatttatttaccacttgcaaatgttaagcaacttaaaaaatactgggagtgtgggccgggtgcggtgcctcacacctgtaatgccagcactttgggaggccgaagtgggtggatcacctgaggccaggagtttgagaccagcctggccaacatggtgaaaccccatctctactaaaaatacacaaattagccgggcttggtggtgcacgcctgtaatcccagctactcaggaggctgaggcaggagaatgccttgaacccgagaggtggaggttgcagtgagccgagatagcgccactgcactccagcctgggcaatggagacagactccatctcaaaaaaaaaaaaaaataaaaatacagggagtgtatattaatgtaaaattatttacaatatgagatcacttccattcccacactgggaggaacgtaaaactcaacaatgcaagagcaaactgcatctctgtttccagagggtggcgctgtttttgcaccgggctgactctccgtttccagggtggcgctgtttttgcactgggactcgtacaaggactggtgctttctctgatgtgcttagcttatttcaggcatgcatttcccctgggctctctgctagctcttcacctttctgcaggcttcactgaggacccccaggtccacctctctagagtggccgtgcccagcccctccacctcccaccctgtgctcattcccttagagcaccccatgacccgtttaccgtttgctgcctgacttcccaccacaatgaagctctacacaggtggcaaccttgtctcgttgtctgcaggttgagagggtgggggacacccagaactttttattgcagaacaaatattttctgaggccatgctttgtacaagaccctttggtgggagatgtacaagataaatcagacgggagagagcgggtgcatagtgaccttttattcacatagcataaaagtcacccttttaaagtgtacaatgcagtggcagttagtacattcatgaagctgtgtaatcacaacctgattccagaacattttcatccccccaaaaagaaacctcatactctagcagtcacagcccagcccttccttccccagccctggcagccactaacctgctgtctgtctctatggatttacctattctggatatttcatataaatgaaatcatagaacacgtggccttttgtgactggcttctttcgcttagcatcgtgttttcaggattcatccgtgttgtaacaggccggtacttcattcctatttatagctgaacagtattccattgtatggatgccacgatttccttatctggtcatcagttgatgggcatttttctctttttggatatgatgaataatgctactatgaacatgtgtgtacatgtttttatatagacatctattttcttttcttttcttttctttgagatggagtcccgttctgttgcctaggctgcagtgcaatggcgtgatctcggctcactgcaacctccgcctcccgggttcaagcgattctcctgcctcggcctcccaagtagctgggattacaggcatgcaccaccacacctggctaatttttgtatttttagtagagatggggtttcaccatattgggcaggctggtctcgaactcctgacctcaagtgatccacctgccttggcctcccaaagtgctgggattacaggcatgagccaccgtgcccggccctattttctattatctaggatatctacctacgagtggaattacttggtcaaatgttaacactgtgtttaatttttgaggacctaccaaactgttttccacaattggctgctccattttatattcccatcaccatggaatgagggttccgatttctctaggacctcctcaccaacacttattatttcccatttttttattatagccatcccagtgggtgtggagtggtatctcaacgttgtttttgacttgtatttctttttgtttgtttgttttgagatggagtctcactctgttgcccaggcagtagtgcagtggtgcagtgttggctcactgcaacctccacttcctaggttcaagcgattctcctgcctcagcctcccgagtagctgggattataggtgtgcaccaccacacccggctaatttttgtatttttagagagatggggtttcaccatgttggccaggctggtctcgaactcctgacctcaggtgacctgcccaccttggcctcccaaagtactgggattacaggcgtgagccaccacgctcggccttgatttgcatttctccagggaataatgatgtggagaatttttcatgtgcttattggccatttatatcttcattggagatatgtctatttaaattatttgcccatttttaaattgagtcatttgtctttttattcttacatcttaagtgtttttaaaaaatatttgggtactagtcccttgtcagatatatgatttgcaactattttcctcccattctatgagttgtattttcactcttttttttttttttttttttttttttgagacggcatctggctctgtggagtgcagtggtgcgatctcagctcactgcaagctccacctcccaggttcctgccattctcctgcctcagcctcccgattagctgggactacaggcgcccgccacaatgcccggctaattttttgtatttttagtagagacaagatttcactatgttagccaggatggtcttaatctcctgacctcgtgatccacctgcctcggcctcccaaagtgctgggattacaggcgtgagccaccgtgcccggcctcactctcttgatagtgttgagttttaaatttttatgaaatcagatttatctatttttttctttggttgattgtctttttggtgtcatatcaaagtatctatgttttcttctaagagatttatagttctagctcttacacttaagtctttgatccattttaagttaattgttgtagacagtgtgaggttatggtctgacttcattctttgtatgtggctatccagttgtctctgtgccatttgctgaaaagactattctttcacccggttgggtgcagcggctcatgcctcgaatcccagcatgcctataatccctttgggaggctgaagcaggcagatcacttgagctcaggagtttgagaccagcctggccaacatggtgaaatcctgtctctaccaaaaaatacaaaaattaactgggtatggtggcgcacgcctgtaatcccagctactcaggtggctgaggcatgaggatcccttgaactcaggaggcggaggttgcagtgagccgagatctcgccactgcactgtagcctgagtgacagagtgagaccctgtctcaaaaaaattttttaaagattattcttttatcaattgaattgttttaccaagcttgttggaaacaattgaccataaacttgtggatttatttctggactctcaattctattccattgatcaatatgtctatccttatgccattatcacaccatattgattaccgtagctttgtagttaagttttgaaattaggaagtgtgagtcctaatttttcaatgttgttttggctattctgggtcctctgtatttccgtatgaattttagggtcaacctgtcaatatctgcaaaaacggtagctgggattttgataggaactgtgttgaatctgtgtatcaatttggagagtattgccatcataacaatattaagtcttccaatccatgaacgtgggatgcctttctgattatttaggtctttaatttgtttcaacttttatagtcttaagtacacaagtcttgtacttgtgtgtgtacgtgtattgtgaagagaattgttttattaattttatttttgtgtcgttcattgccagtgtatagaaatacaattaatttttagacattgatcttatataatgcaaacttactgacttcatttattggtttcagtgggttttctgtgtgtgtatgtgtgtagattcctaatgatattctatatgctagatcatgtcatctgttaatagagatagttttactcctttttttccaatcttcttccttttcctttttaaaattttatttcttttaaagattttatttttaaaatctttttgcattttatttctttatcttgcctaatttcccaggtagaccttccagcacaaggttgactagaagtggtgagagtgaatatctttgtcttgtcccagttatatgggggaaaacttttagtctttcacacttaaatttgtggggttttttttatagttgttggtttttcatagataacatttattagattgaggaagttcctttccgtttttagtttagtgaatgtttttattttgaaatgctgttggatttgtcaaatgtttttctgcatctgttgagatgatcttgtgtttcctgtcttttcttttactaatctagtgtcttacatccatctattttcatatgttgaaccagtcatgcattcctgagataaaccgcacttggtcatggtgtacaactcttcttatatgttgttgggttcagcttgctagtattttgttgaagatttttgggtctattcaaatggatctaaagttttatattcttgtaatgtcttcgtctggtttttgtatcaacaaatgacttttatacaaagtcaaaagcaaaacacatgaaaaaaaagactgataagtttctaaggattttccaagggataaagggaaattagcatatgttggacctgctgtatgtttcagacactttgcttagtggcttccctggggattgaagggaagcaacctggaggaagtagtgtttgagcggggccttggagagtgggaagaattagaagagagagagaggcagagcaggccgaccagagagagggacccacataagcaaatcctggggagaggaggtcctggggtatggaaaggaagtgagctgtcatgtttgcctgtgatctagtgggggcatggtaaggggtatactggattgaagagtgttccctcaaattcatgtccacctggaacctcagattgcaatcttacttggaaatagggtctttgcaattagttaagatgaggccattctggattagggtggtctctaatccagtgagtggtgtccttctaagtagagaaaacagagacacagtagacccatatacagagggaagaaggccacgtgatgatggagcagagactggagtgatacagctgcaagccacggaaggccacagattgccaggaactgcccgaagctggggagactcaaaggaggagtctcctagactttcagagggagtgtggcctgctggcaccttggcttcaggcttctgtcatccagaagtgtgagagagcacattcgtgttgctttaagccatgcagctgtggtgtttcctgcagcagccctaggaaactcatgccagggaaaacaaggaaagaggcgaccaggccaatgtgtggggcgggctcagtgcccatctatggatgggagcttgactggcagacaaagctgactgttgatagtttctgagccaggagcaggggtgaaggggagaagtggacacagtttcagaggcattctttcatagatgttgtttttagagtgttgtcttcttttccagttgatgtgactgctgtctctggaaggcatatgccaaaagagtcaggaatgtgagcttcccataggtcacgcctagctgtccatcctgccctgctgtgggccattctgaaacccggggacatgattcctggcctcggtctccttagctataaaatggagtgctgtctcacccacaaggtttatgtaaggaagtcttcaaagcaattaggagagctcctggcacacaggaagctccaataaatggtagccatgacgataattggttattttgcctcacctttttcttttctaaattattatttttttgttttataatattaaaagaaacacaggcttctttttttaaaaattagtacaggccaggcgcggtggctcacacctgtaatcccagcactttgggaggccgaggcaggcggatcatttgaggtcaggagttaaagaccagcctggccaacatggtgaaaccctgtctctactaaaaattcaaaaaaattagccgggcgtggtggcacatgtctgtaatcccagctacttgggaggctgaggcaggagaatcgcttgaacctgggaggcggaggctgcagtgagccaccaagatcacgccactgtactctagcctgggcgacagagcaagactccgcctcaaaaaaaaattaatacagaaaattagcttattatttctgattatcagaatgatacattatgccttttagaaaattcttttaatgcggtgaaagtatattatagacatgccatctagatatgatcacattatagttttagtattattttctacttctacacttgcataggtataaaatacctgtcaatatatattatatataaaacagtattgatagtatatttttatatagttttgcaacctactttcctcattcagcataacagtgtgaggatttctctggtcatcacatacttttattaaatattttataagtgcttaatggcgttgtatcatatgaatgtgccacaatatattcaaatattctcctatggttgaaaatttagcaatagtactgagagttgaatattggtggtattttttacaagtttattgaagtataactgtacaatcaactgcacgtgtttaaagtgcacaatttgatcagtttggacataatatacactcatggagccgtcatcacaatcaagataatgaacagatccatcacccccagaagtttcttcgtgtccccccaatgtcttatctgcaatttggcaatgatttcttggctatgacaccaatagcacaggcaataaaaaaaataaactggacctcatgaaaaatttaaaaatgtgcgcatcaaaatatactatcagcagagtataaagatcactcacagaatgcgggaaaatatttgcagatcatgtatgtttaataaggaataattgtccaggatttatagagaactcctaaaactcaacaacaacaaaaaacaactggccggatatggtggctcacgcctgtaacccagcactttgggaggctgaggcaggcgaaatcacctgaggtcaggagttcgagatcagcctggccaacatggtgaaaccccgtctctaccaaaaatacaaaaattagctgggcgtggtggtgcatgtctgtaatcccagctacttgggaggctgaggcaggagaatagcttgaacctggaaaacagaggttgctgtcagccaagatcatgccactgtactccagcctggacgacagagcaagactctgtctccaaaacaaacaaacagacacacacaaaaaacaaccaaacaaccaaacaaacaaaaacaaaccccaaacaacccaattcaaaaatggtcaaaggatttgaaaagacgtgtctccaaagaagagacacgaatgcccgataagcacatgaaggtactcaatatcattaatcatcggggaaatgcaaaatcaaaactccaatgaaatacgacctcccacccataaggatggctactatcaaaaaataaaaactaacaagtgtcggtgaggatgtggagggattgaaatccctatgcattgctggcgggaatgtaaggtggtacagctgctgtggaaaacagtatggcagttcctcaaaaaattaaaaatagaatgaccatatcatccagcaattccatttctgggtatatacccaaaagaattgaaagcagagacacagagatatctggacaccatggcttcacagcattattcacataagaacatagagcaacccgtcaattggtggatgaaaagataaacaaaacgcggtccatccgtacaatggaatattattcagccataaaagggaaggaaattctgacccacgctacggcatggatgaacctggaggacattgtgctaagtgacataagccagtcacaaaaagacaatactgtataatttcactgagattaggtgctaggagtagtcagattcattgagacagacagttgatgttgcttggagtgtgaggggggaatgggaagttatcgggcttttttttttgctttttttttttgagatggagtcccactctgtcacccaggcggcagtgcagtggcacaatctcggctgacagcaacctccaactcctgggttcaagcacttctcctgcctcagtctcccccaagtagctgggattataggcgcccaccaccacacctggctaatttttttttttttttgagatggagttttgctcttgttgcccaggctggagtgcaatggcgcgatctcggctcactgcaacctctgcctcctggattcaagcgattctcctgtctcagctgggattacaggctcatgccaccacacctggctaatttctgtatttttagtagagatggggtttcatcatattggtcaggctggtctcgaactcctgacctcaggtgatccgcccacctcggcctcccaaagtgctggggttacaggcatgagccaccattaatttttgtatttttggtagatacagtgtttcaccatgttggtcacactggtctcaaactcctgacctcaggtgatccaccagcctcggcctcccaaagtgctgggattataggcgtgagccactgtgcctggccagttcttagctattttagataaagctgttacacacatttatgtgcaagtctttgcacgtggacatatgtttttatttctcttggtaaatacttgggaatggaataactggaaacaggcatgtgtttaatttttaagaaattactgaactgctttcctaaagtggtttgccgtgttgcattcccaccagcagtccgtgagagttccagttcctccatgtcctcagcaacacttgctatgatcagtcttgtccactgtagccattctaataggtgannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngttgagatggtaaatttgatgataagtattttttaacacaataaaataattggaaaaaggaaaaaagttgcatctgctttgcatcactctagatttgtttgccttttctagaattttatgtaaatgggatcatgcagtatgtgcttgttttttgtcctgcttctttcaatcagcataataattttgtcatgcgtccatgctactgcgtgttacagctgagtagtatgccatggtatgtacagaccacgattcattactgcattggctgttgataaaccctgggttgttttcagttcttatctattttattttattatttttatttttatttttttgagatggagttttgctcttcttgcctaggctggagcgcagtctcgtgatcttggctcactgcaacctctgcctccagggttcaagcaagtctcctgcctgagcctcccgagtagctgggattataggcgcccgccaccacgtctggctgattttttgtatttttggtagatacagtgtttcaccatgttggtcacactggtctcaaactcctgacctcaggtgatccaccagcctcggcctcccaaagtgctgggattataggcgtgagccactgtgcctggccagttcttagctattttagataaagctgttacacacatttatgtgcaagtctttgcacgtggacatatgtttttatttctcttggtaaatacttgggaatggaataactggaaacaggcatgtgtttaatttttaagaaattactgaactgctttcctaaagtggtttgccgtgttgcattcccaccagcagtccgtgagagttccagttcctccatgtcctcagcaacacttgctatgatcagtcttgtccactgtagccattctaataggtgagtaggagtatctcattgtggttttaatttgcattttcctgactacagaggatgctgagtatcttctcatgtagccttttgtgtctggcttctttcacttaacataatacaactgagatgcttccatatcgtcatgcatatcagcagtttgctcctttttattgctgaggcgtatgtattcccttgttaagatgtaccattgtttgtttagccattcaccagctgaaagacgtttgtgtcatttcctgttttctgcaatgatgaataaaactgctataaacattcacacacagatttcgtgtgaacattttccatgtattttgggtaaatacctagggggcattgctgagtcatatggtaggggtgtgtgtgactttataagacactgccaaacagttctccagagtggttctgtcatttgacttcccgtcacattgtaggagagttctgttgctcgcctcctggccagcactcacagtgtcagtttcattccttcgttttttttttttttttttttttttttttttggttttttgttttttgggtttttttgagacagagtctcactctgtcgctcgggctgaagtgcagtggcatgatgttggctcactgcaacctcgcctccagggttcaagtgattctcctgcctcagcctctggagtagctgggataacagaggtgcactgcgatgcctactaattttttgtatttttagcagaaacgggatttcgccatgttgcccaggctagtcttgaactcctgagctcaggtgacccacccgcctcagcttcccaaaatgctgggattacaagcttgaactgccttgctcgtggcctcattcatttgttttttagtcattccaatagatgtgtagtggatcacatcatgttcctttagattgcattgaggtttctttctatttgcatttctctaataatgaatgctgtcgagcaccttttcataggcttcttggccatctgaatatcctctttggtgaaatgtcttttcaaatcttttgcccatgtttggattgtgttttcttattactgttttgaggaccttttctatattctgtatagaatgatgatttaaagcatattactgacttatatgataagccctttatcatataagcatttggcaaatatctttttcccagtctgtggcttatctttttattttcttaacaatatctcttaaagagtagaaggttttcattttaatgaagattaattttttttttcacttatggtcatatgttggtgtctggtctaagaaacctttgtgtaacaatagtatttcattttaacagtttcttatacatactctggatacaagttttttgttgactatatgttttgtgaatattttctcccagtctgtgacttgcatttttgtttcctttaatggagtattttgatgaaaaaaaaaagtctttaattttccaatttattatttcttttacagtttgtattttttgtgttctatctaagaaacctgggcctattctaaggttacacaggttttctcttacggattcttctggaagtttcctagttaaggtttcacatctaggtccgtgatccgttttgagttaatttgggggagtgatgggagaaaagagttgatgttaatttttttcatgcagatatcctgttgatccagtatcgtttattgaaaagccatcctttctccactgaattgtccttgcacttttgtaaataatcaattgatatttttggactctgttatgttccattgattatttgcctatttcaccatagttatcttttcaccaataccaaactttcttgatgatagctatgtaggtctcaaagtcagatgcatcctccaactttgttcttcttttttatagtcgctctggttatactagctccaaattttagggtcaacttatccattttcactaaaaattcctgttggaattttgattgggcttgtgttgaatctgtagatcagtttggcaagattgtcatcttaaccaagttgacggttttattctatggacatggtgcatttctgcatttcttaagatcctatttgacttatctcagcaatttttgtgtttttcagtatgacgttcttgaatgtcttttgtcaggcttattccgaagtattttatgtggggatttttttgctactataaatttaatgttttatttatttcatgttccaattgtgcattgttactgtttaagaatacaattaatttttctctattaaccttttatcctgcagttttatgaaatccagttattagttctaaagattgttttataaattccatgaggtttttcagatgaacagttgtatcaactgaaaataggggcagttctgttccttcttttccagtctttatgccttttatttccttttcttgcctgatgcagaggccagggcctctgtgagagcatggactagaagtggtgggagcagaggcattcttaccttgttcctgctcttgggggaaaacaattccatcttttaccattcagtatgacgctaacggtggaatatctgtgggtgcctttatcagcttgaggagcttctcttccattcctagtttgtagacaggtttgtcataaatgagcattggatttttgtcgaatgcttttctgcatctgtgcatgtatgcctttattgtgggcacctctggctatgtccttaggattcattcctaggaatggaagtgaaaagtcaaaatgtataaacatttttaagcctttggcatcttgtttccaaattgccattcagaaatatttggtcagggctgggcacggtggctcacgcctgtgatcccagcactttgggagactgaggcaggcggatcacgaggtcaggagttccagacgagactggccaacatggggaaaccccatctctactaaaaatacaaaaattagccaggcatggtggcaggcgcctgtaatcccagctactcgggaggctgaggcaggagaatcgcttgaacccgggaggtggaggttgcagtgagccgagatcttgccattgcatttcagcctgggcaacaagagcaaaaaactccatctcaaaaaaaaaaaaaaaaaattggtcagtttatattctttctccccctgagctgaatgagaatgtctgtttccccaaatcctttaccacactagattttataatttgttaattgatgccaatttcataaaccatccccccaccatgttatcccgtttctatttccatttatttcattaccctgggcctggaaattttattcattatttgtatttattctctactaaatttttttattttccttttgccagttttctgttgggcatttatatttttctttttaatttacatacttttttacatactaaagatgttaatctttatcatatatgtgtcccagtttctttggctattcatttgttttgttggttttttttttttaatagatgttattttttgaagctgttttagtttcacagcaaaactgagtgaagggtacagagaattctcatccaccccctcccccaccacacgcacagcctcccccaccagagtgggacacatgttacgactcatgagcccacacgtcattgtcacccagagtctatagtttgtcggcattcacactcggtcttgtacatcctatgggtctggacaaatgtataaagacacctgtcaccgtgaccactctggtgtcatgccggtgtgtcactgccctaaaagttctccgtgcttcaccttcctacctccccgccagctcctggcaaccactggtcttgtcactgtctccatggttttgccttttccagagtgtcctagaattggaatcccacagggtgcagccttgtcacagtgggtcccttcacttagtaaaccccttcgtaagacgcactgaagttccctccgtgttgttccacagctcgacagctcatttctttttaatgatgagtaatatattcccttgtctggctgcaccacagttatttaaacttatttatccattcactaccaaaggacatcttggtggcttccaggttttggcaattatgggggaccaccaaagggtgtcattctttccagcctcctctcccatcacagcctcctctcccaacccagcacaccgaacacgccctgctcactcctccaatacctacacatccctcccagcatactgtgtcccacccaccctacagggcagggcaaggtttccagaaaccagacagaacacagagactcgctttggcagtcacgggtggagggccccctccctgctgctgtggccacagaagactggtcccctggagggccagtgccagtttctatctaggcaagagtcctggacccaggagccaccgcacacctcccccagcaacgtgcctccaggcagaagttggcttaaaccctctcacaaccccttaggggcaaattatttgcattaattaatggattgattcattaattcaggacactgtgcttgggacctacagctgggttctcatcgacttttttcagcaaacttaaaaggctcaggatgaagaaaagcaagaggaaatttagcagtttaggtattttaaataatgctaaaatctggccctggtaaccttgagaaccacagctcaatatgtttgaaggtttcttcctccccttcaagctttttctgagagctggcttgtcctgcgtgtgtcagtgatccgttgctgtgaaacaaaccgccctcaaactcagcaacttaaagcgaccaccgggcccagcgtggtggctcacgcctgtagtcccagcactttgggaggccaaggcagacagatcgcttgagctcaggagtttgagaccagcctgggcaacatggcaaaaccccatctctataaaaaatacaaaaattagccaaatgtggtggtgagtgcctgtagtcccagctacttgggagactgaggctggaggatcgcttgagccccggaggctgaggctgcggtgagttgtgtttgcaccaccgcacttcagccagggggatagagggagaccttgtctttaaaaaacaaacaaacaaacaaaaaaccgcttctttgctcacagacctttggtttgggctgggctgggacaggctgttgcgctgggctccctggagttcactcaggtcgctgcagccaccaggaggcttgggtgggcggagggtctggaacggcctccattgacaggtgtcggggctctggtgctgactgccagttgcgtgtctctctcatgagctctcgtctgtctgtcttgcctgcactgtgccaagaggaagagtgaggggctgcctaggccccagaactcacctaacaccatgtttgccacattctattggtcaaaaaaggcccacctagattcaggggtggagagacaggtgctatccttgataagatgagctgtgaagaatttgaggcccttttaaatctctatctctgtatctgacatggcatagtttactgtggtggagggagaacccagtgtttgtgtttgttttccagtgatagtgctgactttttttcattactgcttttacatttgggtgatcttcagaaaatgatagaaatgaagaactgctacatttcttaaagtttagcgtcttctagttttatgtgtgagatctttctaatgtaatagcatcttgggagttatcgcctgcaaaacccatccttttagttccaatgcatcacataattttatgaacaagctaaattatttgcagcatatatgaatattcttaaaactaaattgctttacgtgtgtagaaagataagcaaaaataaaacactgtacatatttcgttttccctgtagtttattttctttaaacatttttttctgtgacttcaaaattcccagacactttacattttcacttcaggcatgagtattaaatgtctgtgtgttctgcgccaagccagggctgggagctgaagatgaagagacacgatgcaacccccaccccacagcagccggcctcgaggggcaccagacctcgtcctccatgaccacacagggcctggggtacctgccagacgtaccccaatgaaagcgaactgaggtctccatcaccttcgctctagtttgagcttatggaaccccagctgtaggtcccaagcacagtatcttgaattaatgaatcaatccattaattaatgcaaataatttgcccctaaggggttgcgagagggtttaagccaactcctgcctggaggcacgttgctgggggaggtgtgtggtggcccctgtgtcctggactcttgcctggtttgaaatcggctccggccctccaggggaccagtcttctgtggccacggcagcagggagggggccctccatccgtgactgccaaagcgagtctctgtgttctgtctggtttctggaaaccttggcctgccctgtagggtgagtgggccacagtgtgctgggaggaacaagcaggtttgggggattctgctgttgggtgtggtaagaaggctgggggaggaggcgggaaaggataccaccctctgatggccccactgggtgggccgggccagcaggcagcacacggggcagcagctctcacagtcacagcagccccgcggttcaatgagcagatgacagaagggggcacccatgggtgcggtggggcctcagactcgagacctgccctgtgttgtgagcaacgattctgaagcgcagctcccgcagggtccacttgggaagatgtcaggagccctcggtcttctgggcccgtccgcggcgcagccacggcagttcaggtgatggccccacatgcccatctctgatctagttttacctgactcagtttccttgagagcccaggggccccagcagtgggaggacctgttcggctgacttccttaggcaggtggggaagaaaggccacctgccactcaccaggcccagggctgtgcctgacgcagtagagggctctagaaaggccagtcaggtttctctgtgtgaagttcccagtggggagggattgtgctggaaccctccaaaggagctttatttacttagacctggtgcttcttggaggaggaagtgcctctggattgattgcctctaatagtttatgttctgagctcaaacgggaaggcaggtgcggtgaatgcggctgagtctctgtggggtgctgcagttggggtccagagctgagtcttgcctgtactccggttttattttagcagacatttgctagacattaaatctcaagagagtgtcaggcgcgatggctcacgcctgtaatcccaacacttttggaggctgaggcgggtggatcacctgaggtcaggaggtcaagactagcctggtcaacatggtgaaacctcgtctctactaaatatatagaattagctggtcatggtggtggacgtctgtaatctcagctactcaggaggctgaggcaggagaatcgcttgaacccggaaggcagaagtggcagtgagccgagatcgcacactgcactccagcctgggtgacagagcgagactccgtctcaaaaaaagaaaaaaaaaagaaaaaagaaaaaaagaaaaaatctcaagagacaagatttaacctgtgaggtggctgaatccatataataagatattttgcaatttggaatgtaacaaactcataaaaaataacagaataaatggggttgtactgctgaactgcagacagctgcacagtatgctggtgagaacatgggccacaaagcttgggttctaatctcagctctaccacttgccagctgtgtgaccttgggcaaattacttaacctctctgggccccagttgcctcttctttacaatggggtaataccactattcatttcagaggatttttgtgaagattaattgcaataaaagcacctgagaagcattagctcagggccaggcccatagtcagtgttttaataaatgctgatgatgttattaatagtactgagaacccaaatgtttcctaaccaaaagcataaactgaaccagtacttttcaggaatacagtgagctggtttaaaccacgcggaagccccatgctatctaaaatcatcccaaaacaaccagttttagtaaagcccagccccacgctgtagggaaacccagccttgttattctcctgccttctttatccatgggaaaacgaaggctgagagaggcttggtggcttggccaaggtcacacagcgaggaaccccagtcagtgtgaccttggctgtcaggacgatgatgacttactgcctctattgaagtggaatggaatttgatcatgaaaatgctttcccatccaagtggaagtagaactgtgcagtggggttcatacattcatttattcacaggtgtttacagggcatattcagccgtgcctgtatgtgtgtttaagcttggtgcgtaggtttaaatgactcccccatgacccccgtccccctctgggtagtgtgggcagggagaagtgtggcgatcatcacataacctgttccaccagccccccgtccagctccgacgccggcctgcggttcccggacagcaacggcctcctgcagaccccacgctgggacgagccgcagcgggtgtgcgccctggagcagatttgcggcgtgttccgcgtggacctgggccacatgcgctccctccgccttttcttcaggtaggaagcatctctgggcgcctcctgggagttggcctgtgtgtgttttccctggcagcctgggctttgcagccggtgcagtgcacggcttggggacacagggccctggatggagtcttcccaagcgtctgctttcctccctcgctgatcttgtgggcagtggttccccactgcagctccctgacagttctcaggctgggtgagctaccgaactcactcccctaccttcagcgtgatggtagccagcggttgcttgcaactctggcttgggagaagaaaccaaaccagggcagagggtagcagctgccggcggctctgatcgccgggggatgctctggagctcggccacctgtgcgggacgggccgcagctttccggatggaggctcccttcctttcgtgatgggtgggcgatgcctagtttcctgcagtcattccccacaccagatcctcctccttatagtcagggctgcccagccgcagacatcaccaatgagaggcccgggcttagaagaagccggcgtgtccagaagctgggggggttcccagacccagagccacattccagcctttcatctaagggcagccggggctgggctgacagcactgacggatgtttactgagtttccctggagggttctcccagagttccacccacacgcaacgaaggaggtctgttcccaggaggttctcttagcacatggcctgccagggctcagaactggattccagggcactcagcgttgggacccaggtctcccggactgcagggaccgtgttgccgggcagggggtggtggggagaaggccactctggcaggtctccagagaggagctccagggccccccaggaaggagcagttttgccatcttcggcaaagggggtggtggtttttgttcggtgtagttctgtcccctcccgctagcagccaactccactgggactcactgtttcctgcttctgaggttggcgacagtggcctctgattatacttggaaataaaacccccgtgtttacatattcatcgggcttccctctcccccttccaatggcccttcagcgacgaggcctgcaccagcggccagctggtcgttgccagccgagagagccagtacaaggttttccacttccaccacggcggcctggacaagctgtctgacgtgttccagcagtggaaatactgcaccgagatgcagctcaaagaccaggtagcccagcagacggccccagaatgcccagcggttgacactccccaccccccacgggccccatctccctcctgggtcctgtgtctggggtccccgggccccgggggcttacggggtgtgacccacggtagtttttggccgtcagagcagcaacttagggtttgaaacctttgcccagggctttcggtaaagtcagtgccctgcacttgaaaaatcatgttttgacaagacttcctgccatattttgctcaatctacgtacaaatgtaataagagctctttaattatctgtttaaggtactgtatgtgcttattagaaatggggccgattttaaaattcccttccttcccgcagagcctcctgctggcttcccttattacagtagcatggctttttttccccctacattgaacaacctttgatttttgaattaaatgtcagctgcagttttgccctggattcgtgactgctcgcggaggcaatctgacaggctggctccctgctcgcagaacagcgatccctttgtatgtggccaatcacatgtaattcattgcaggccctcccggcagagggaagttaggccgaacgaggcattcattccgtttttgcggctggggttggagagagtggggggcggcggcacagtgggccggggaggagagagccgcagagggaaaccgattttaagatgaaggtattttcattttaattgcgcctaattacactcgccatttaggggtttgtatgcaggggacggcccttgccctcctttcagaagagagagaggcttttattcctgggaaaagcactgctggcctctgaagccgcgcggctgagatcctgacctttgcccagttttcctcccgtccagcaggtcgcccccgataagacatgcatgcagttctccatccgccgccccaagctgccgtcctccgagacgcaccccgaggagagcatgtacaagaggctcggcgtctccgcctggctcaaccacctgaatgagctgggccaggtggaggaggagtacaagctgcggaaggtgaggtccgggtccgcccagctggccccgcggagagccggccgggaaccgggaacgagcgagagggaaggagggccggggcctggccgcccgcccgcacccacgggccacctcctcgtgagggccccgttttcttgtgtgaggctctctgtgaacacaccgataaagcaatcaaagctgctgcgttgaaaaaaaaaaacaaaacacaacacctccctcgagggtttggggggataccgtgtcagcctgcatagaagggtttgcagtgaaatgcagcatttccaaaaccagggattaggccatgacgtgagaacgacacgttaatctgagcgccaccccagggggggcattgacattgaaatgagccgggtttgtgtcctgtatgggaattgaaggccactgctttccccttgtaaatatgtgcaaattgcagagatctgaatcaaggcgcaccaaaaaccaccaaaacacacatctctggggatttgggggttctttgagctgccccattttatcccctccccaacttttgccgcttcctccaggccattttctttggcggtattgatgtgtcaatccgcggggaggtctggcccttcctgctgcgctattacagccacgagtccacgtcggaggagcgggaggcgctgcggctgcagaagcgaaaggagtactctgagatccagcagaaaaggtaaccgccggggccagcccggcccaccccgccgagccgcggaggaaaatgtcatttgaaaaggcaatttgaggtgcaattcagcattgataatatgtttcgtgacccatagtttctttcaaaaatgggtctcccaggaacgtgagtgatagggtgggataagtgcagtcattaaaccaagcactcgggcctcggagctgcggggctcgttagctcacatgtcaaggttttagaattctcgttcaacagacttaactaggcgctgacgtcccacagctgaaggctggggctgggagcagggcctggaggggtgaaggcatccggagactgtgtcccacttgggatctgctaacccgggactgggctcagctctctctccaggaggctgggactgggtgaagcccctgggctgtgctcagctcccctccagaacgctgggccagggccaaggcctcattacccactgggctgcaacttgctctccttcctgggacgctggagactgtgaggctgagttaatatcaaggagagccttggatacacgccacccatccgccgcatccggggagggtctgcagccggcagcagccgcccagctcccgtccagggaacgggggttgggaggaagggtggcttcctgcagtgtgtgcgccacacgatgcctctgggtgccacccgctgaccccggctgggtgctcggctccacacaggctctccatgactcccgaggagcacagagcgttctggcgtaatgtgcagttcactgtggacaaagacgtggtccggacagatcggaacaaccagttcttccggggggaagacaatcccaatgtggagagcatgaggtactccctccccagccagctcctttcccatctgcaagtctgcaagcctcacctgaccgctctgggaagtggatgagcccccagcgagtttctgcaggggctctcttccaggttcatacatcaaagccccagaagtgaaggatacgctactcatgagctacgtcagttggcatctcagagccatggcatcccagggaagccacccaggtccctgcccacagagcccctctatcccctgggcaccaccaagcctgtccttgcttggctcacactaaccatggaccagcttccccatgcaccccctccatctccccgtgggtggtcccgtagtcatacagccacacagagccagaggctggcatctgtgacattctgctacagcctagcaaataattgcacaaaattagcagcccacagaaatgtccctgccagcccaccccttgtcacaggcagtccacccttcagaaaatcagagccatgttcccccttaacccctgctctcaagattctgggcctagacagcagctaatagcaggccattactttttttttttttttttgagacggagtctcgctctgtcatccagactggagtgcagtggtgtgatctcggctcactgcaacttccgctttccgggttcaagcgattctccagtctcagcctcccaagtagctgagattacaggcgtgcaccccaccatgcccggctaagttttgtatttttagtagagacagggtttcaccatgttggccaggctagtgtcgaactcctgacctcaggtgatctgcccacctcagcctcccaaagtgctgggattgtaggcgtgggccaccgcgcccggccaggccattaccttttgcaaagcaagggtctgtgtgtctggaagctaagcttgggctctgagatggtggcacagctgccttccactgaggtgaaggcaagcgagggaaggcagggtccacggcccagggttctgcaggctgggcagtgtgccgcggtgagggtcatccccacccactgctgtctccaccgcctcccaggaggatcctgctgaactacgccgtgtacaaccctgccgtcggctattcccaagggatgtcggacctggtggcgcccatcttggccgaggtcctggatgagtcagacaccttctggtgctttgtgggtttgatgcagaacacgatcttcgtcagctcaccccgggacgaggacatggagaaacaactggtgaggctcagggggatgggtgcgtccaagggcatgtgagggcccgtgttgcctctcccgttgtagccggggttgccgtggtgatgcgtggcttggctgctgtaggtcagtgggcagtgggaacgccaggataggacttgcccgtgggatatgggcggcttagcctatctcggcctccggggatggccctctgactccctgcaggtccagaggccgcgttgtgtgggccgctctggtggccttccacccctgcacgtgacaacctggcccaagctccctggctggcaaggaagaggtggcaccatcacacccagccccctctgagccttagaaaatgggtcctcaggtgtgtctaagctgctccctgcaggagtcaacacagccagggcttctgagtgcagacaggaagaggaggggctcctgaaaccccctgaggtctctggggcagtcctcacaccccacccctcccctggggtgccctgctgacacctctcccgtcaaggcctcctcaaaaggaccagccctatgtagaccaggaagcactgaatgtcggtggtggggctgagcccagctgggtaaggcagcgccggagggccagcgtgtgggaccgaaccagggctgagccagggcacctgctcactgttctcagcacacatcacccatgtcaaccaagtgcctgccgggtgcagtcaccagacattcaccctcctggctgggccaggaagctggcattgtgagcagaggacgctgggtgtcggggagcactgtgggaggtgcccgtgataaggacaagagggctcctgcaccggggacagctccagggtgtgtggggtctggccctgagtgtcgctaaggctgggctgagcagagcagtcccagtggtgggactgagtgacctggtcttcctggaccagacccgtcacaagtagtgagggtggagctgatggagggccttgaaggccagggccacagagtgtgtctcatagaacgggggtccccacccccaggacacagagcgtgtctcagaatggggtccccaccccaggacacagagtgtgacttgtagaatggggtccccaccccaggacacagagtgtgacttgtagaacggggttccccagccccaggccacggagtgtgtctcatagaatgggatccccactcccaggcccaggactggtactggtccatggcctgttaggaactggccgcaccgcaggaggtgagcggtggacgggccagcgagcattcccgcctgagctccacctgccgtcagatcagcggctgcattagattctcacagaagctcgaacgcgagaaccctactgtgaactgagcatgtgaggggtctaggttgtgtactgcttatgagaatctaatgcctgatgatgtgagggggaacagtttcaacctgaaaccattcgcactaccttgtccgtggaaaaattgtcttccaggaaacgggtccctagtgccaaaaaggttggggaccgctgctatagactgactgttagtgggtcgctgatgacaggctgggagagctgatgccaacagagaggatttgaaggcaaaggagcccaagcagggaggtgcaggcacctgcacagggggcgggagtggagcatctgcaagggggtcagccacacgagtgggcttgacctggccgtaggccacagggcggagggctggccgcacagcttcagcgcagtctcccgtgggaacaatgggccacctgtgtgggaagggggcatgtggccccgagctctgccccaggatccccccagctgtgatctaactccacctgggccggggggctgaacccagccaagcctgctcactctgcatcaacgggtgtgtgtgacgtcgggtgtccacattgcttggggaggcagttacagtgtccaacgccattcgcctctgacggctcatggcagcgcatggctgggtgactcactgaatgctggagattgattttccagcggcattgatgaagtcagcggcctgggcccgagtgctgccagaaatagccccgatcttgtcccacatcattgggaggtgaccttaatggcaggaatcgagcatcctggggctcagatacgtccccttcctgccctaaaacagctctggaagatgatagatctgggtgagcgtagccgaagaggggtgggggggctccctggatgatccactcacctcaccaggaggagtggacgtgggaaacagcccccaagtgtgcactgagggtggggagccttcctggccatggagcggctgccagcgtcctgccacgcccgggcacaacactctgcctcaccctggaccacaccacagcctccggaacagtcagatctgggaggaactggcagaggcaggtgtgagccgattccagcggcggaatggagcgttgggggggcaggcacatgcagcaggtagaggcccctgggtgtgcttttccaggctggggtggcccagggaagggccccagtgggagtgggcttcctgggcagcaggccgcatgggaccggagctaactaacgcgtgacggcctcacccccagctgtacctgcgcgagctgctgcggctgacgcacgtgcgcttctaccagcacctggtctcgctgggcgaggacggcctgcagatgctcttctgccaccgctggctccttctgtgcttcaagcgggagttccccgaggccgaagcgctgcggatctgggaggcctgctgggcccactaccaggtgaccagggcaggggccagggctggggaggttgggaccatggcccctgaaccaccgtggccaccctgcctgctgcccctgtccgcctcgccgccccccacccacagccacacattagccccccatacggcgactgccttcccgtcccacgtggctggcttcagaccttacagctcgcctccccagtcactgaaatcgatgcaaattgcccgctgactgcactcattaccactttctggggctgagctccctcctgtcacaaccaatcagtgtgagtgacactgtggggggcctacactaggccacagcagcccaggacgctggtgcccacgagcgtgagccagcaccgctccaccccctcgggaccgccctgccacgagggccgactcacccgttaccctgctgtgcagagaaagggcctgagatcccacttccctgtcggcccctccagagggccccaatcagtgataccgacttccactctccgtccaccgtcaccagcatcttctcagcaaattccccttggagcacagcactggctctgtcacatggccttaacgcccaaactagggacaagctggagatgtcaaaagataagcaagtctctttgagtccatcagccttttaaaaaaaaaactcacatcgacgcatccaggagggctggacccttttgcaggagctggctctatccaccacggcagctccagcagcctccgtcagagaaccctgaagatggaggcaaacacccatctgctggaagacatttgcgtcagcgtctcctgtcctcactcacaccgcagggggctgatgtctgatgaaagcgagtctgaagccaccgagtgccggtaccacacgccgcctttgcatgcggtcatcggctcgcccctggcccgggtctaggtttccctcctggctcagcctgctggacgtggacgtgcagggtggacgatctgcattaacgaagggaagcacggcatggacggtctgagaggcttcattcccaccactcccgaattaaaaaaaatcgtgcctcattgcacgttttcccagtggcagatttgccgccctcattcctttacgttcaggctgatgttacccgtgaactcagcgcgtggcccggcagatgggtccctttcccatggacacctactgtgtcccaagtgtaatgagatctagtcagaattccagcgggaggcccacgtgacgtgggatctctgttggctgccattgtgttggaagtccacaaagcaagtttctgttgttttcagactgtgggctcgatttagccacggtcggtcccatccctcgatcaatttggtagtattacggggtgggggtgggggtgggctgctgatgagctgagagtgagctctgtggaatgggaaggttgctgccaggtgaggcctttaactgttcagtgacccctgagcgagaaaggcttttgatgctatccgtccgctgtcagcatgtggtggggctggacggccctacgccctgcctgtcctgggaactgaaatctgcctatgctgtgcaggctgtggagatcgtgccctccctctccctccccacattcctctcccagagaagctgggcgtccaccttcctgcaacccctccgctgtgtctcgcaccagccacagttcaaatcactgcaaaaggatccgtcagagccaaaacaagaccgtcccagattagttcagaggaagcagccgggcagcctggtgcatggtctctccaggagcaggctggggcgtgggagtcacctgtagcctctgccctcatggtgtgctccgctcagcctgggccggggacaccgttccgtctggtttgtgtggtcgacgtcaggagactaaacatggacttcccagtgcccccgtccttcctgtgcctccggaagcgcgtgtgcatcaaaggtggcgtgtcttgaggcggccaggccggagagcacacaggatgcagccgtcaggacctggcgtgggcttcctgctgcacacagcgcgttgctggcaggccccgtgaggcggtctttaaagggagggctgcggagtcctcaaagtatgcccgaaaagaggctcaaggacagggcgatcatttcagccaccctgtgggtgagctgctgtgcccgctctgttaggatcttcccacttttctagccacaaaccctagagtcatctctggggcatgattggggggtgtggcctggagccaggaggacaggctgacccgtgggtggctgccagaggcgcattccatgacccgctggagtgagttctgacccagacttccgcacacaccgttgctcaggaccattacaaatgagtcctccccatgagcacaggccaggccttctgaggaagggtgctctttgtacccccccacccccaccctgtcatggagaccacccacatcaccacccaggagagcagcagcagcccgtgggggctgagctcagcatcgtcccctctggatgtcacagcagcctgggcatgcgggtactgggacagaccccatgtgcaggtggggaaacttagggccgaagaggcggtgcagcttgcccagggccacacggcccccgagctgggctgtgagcccagacccctcgccctggagccctcactcgcaccctggcactcagtttccccctgagtgcagggcctggggctcggtcagagcccgtgtctgaactctacccgcctccacagacggactacttccaccttttcatctgcgtggccatcgtggccatctacggggatgacgtcatcgagcagcagctggccacggaccagatgctcctgcacttcggaaacctggccatgcacatgaacggggagctcgttctccggaaggtgaggctgccccagatgtgggccccaccccgccccgcccccaaagccccaccccaccagctcgttctcagaaaggtgaggctgccccagatgtgggccccgcccccagagccccatccccaccatggccccccagcacgtgccctcccccacccatagcactgggggctccccactaaggcctcgtggtcagcacctgtctcggcctggctgtgtcacctcactttcctggggtgccagccctgacacaggagcctccctcgctggctgaggagggaacgaattcaccggggctgacggacaggacaggttccctaccctggggtacctcgcttacaacccagaactgggaacactgagaaggaggctggacctggggacagggtggccagaatactggggaccttgggctttggccccctcccccacttcccagacgcctcctggagatgctgcccgttagctctctggtggtcctcagggcactgagcgggggtcccgaggtcggtggtgtcctctggcacaggacacagatcctgcaggagctgagaggctgctgggggtggggggtggagcaaggtgcgggggaagaagagaggggtgctgccaaagggacaggtgggcttggctggacgccacccggccctgtgctggtgttggtcctgttcaccctcctgaatgaagcccattcaagggccttgttcacctcgagccacctgtgagcacagcccgagtgccttgtgggtcccatcactgcagccacctaagacccagggccccgtggtgccggtgatggtgggagatgcaggcagagccctcagtccaggactcggtgagcccccgaggtgcaggccgttgttgctgctgttgctgtctttggccactcccatggggaccctaggctgccaggctgtcccccggcccctcctcaccccccgtcctctgtctgcaggcgaggagtttgctgtaccagttccgcctcctgccccggatcccctgcagcctgcacgatctgtgtaagctgtgcgggtcaggcatgtgggacagcggctccatgcccgcggtggagtgcaccggccaccatcccggctcggagagctgtccctacgggggcacggtggagatgccttcccccaagtccctgagggaaggcaagaagggcccaaagacgccgcaggacggcttcggcttccgcagataggtcgggcccccgacaccggacaggggttgaggggacctcctcagaggccctgggcacgggagggggtggggctgggcgtgaaggggacaggggacggtagaaacctaaggaaaatgcttttgggcaacatgagaggaaccttttcatattaatgacaaaattagagtctggaagtgacagaagtcagatctacagccacccagaggaaagtcagctcctgaaacgctgcagtggaacgcgcagccaccgcacctgagacgcaggctggctgggctctcctgctggctgccctggaggatttcaacatgtcccaggatttgctccaccctcgagggcagccagacagcgtcgccaggcaatgaggaaagcagagacaggagaggaaggcctcactcacccactgcgtcgagggctgcagaacacagcggggtcctgtccaggcccagggacatctttgcaagccagacacacttcctcttgagacctcgttctctcggagtgagccaaacacacttcccaaaacgtccccagccacagctgggatgccgatggaaaggcatctgccataaaagaaaagcaaaagataaaaagcccaaccgatgtggggatagagaggcggaagagcagtcaggcttgaggagctggcgcttgtaatgtttatccgtttaaacatttcgtcctcctggtacacgaagggaactgtctgcccaggagcctgagcctcaggctgttggagaagcatctgatgcctttttctttgctgggggtcttctacgtgaggttccttggcgttgtttaaggtcaactccaccaaatacagcaaccagctggggcttgaatgggtcgatgtgtgcgtgtgtccctgcgtgcatgcatgcatgcacacgtgcgtgcgtgtttgtgtttgcaagatcctctgacaatgatctgctttgtcccagggacgtggtagtgtattagctgaccaaccaagacaaggacacctggaaatagttagactcttccacttcccttcaggacctgtgaactcagatatgtaagtcagcttctcaggtggtcggacgtgagagcgaccacagtgaaggagccagcactcagggctctctgccttctatgtgggaatgaggtcttcccaacagactctccctcttccaaaagattgtgtatcagttgctccttctgggatttagagatggacagaaaagggtgtgcgatctatgctgtgagaactcccagccagcttagaagtgtcgagccatttgcacagaaagccactccttgagcgaggagaccaaatccctcctgaaatcctccatcgcgtccttctggggagaaaaacccttgatgtgctgagaaccatcatggggaccaggatagaaggcttcttcccactcaaagcttttctccctggagggtgggcactgctgggccatgccacttcaaagcagtgttcctcagcaggaaagcggaggtcaccacttaccggcctcctccaccttctcggcttctcttttctccatgaacccaggtcgtccagcaggtacttccaagttcccaggtctgtctgcctaagagccttttgaggagaccgtcctggagccccatcagtgcccagatcctggggtaccgaccattgctgtctagcagtgggggatcctgtggtgggaatggggtgggcttctcatccatgttgcttctgggaagagagggttgcctttctgggctagggaggtggctggagcttctgccctgaccctccgctagaaaccagttatatccattgccacagcaatactgtgtaacaaatccgccaacactcggtggcctgcaacagtcagcactgatctagggcaggagtcagcagtctgggcagggtgattcttctggtctaggctgtgcttgtttgtttagggccagtgggttgttaagtcccaggggatgctcatggtgcagaggtcggacctggccctgctctgtggtctcttgcatccctcctgcaggccagccatggcacagccaaaggcacggagggagagacagcaagtgcctttccaagccttggtggacaccacacctgcagctctccccttggccacagcaagtcacgtggctgggctcagcattaaggggtgggggacaggcctgccactttattgtccgctctgcacagtcgggtggcagtaggctgagaatttggagggctaaacaactgggactctggagagtctgtgtcctaataatgcctgctttggagcactccttccccacccgcctgctccaggggaatagcgtccctggtcctagcatttcactagatacctcgtgcctttgaaccgctgtgtttgggagggaggaagaggatagacaggtccagggctcccctcacttgggaaggtcctagtagaaggcattccttctgagtctcctggccctacagcttctcacccctgctgctccccaagacctgacccggaccaatcagctgcatctctgcaccaagtgccacccccaccgtgcactgctcgcacctcacgctccccatgggctggcccggaccccagtgaggtctgcacctctcggaccagccaggacctcggaagccatgacctgggtgttcagggcttggcggaggagacgctgctccgcgggggatggagaagccccgcccctccacaactcccttaatctggatgcaattagaggaaaccagccaaaaaccccgcggcagctgttgccccgggattattcccagccagcgagaggcattagggcgataattcagtcattagacttctagccttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcagcgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcgcacacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaatagtgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttggtttggtttttaaatgtaatcacccattggtcaggcccaggactggtcaccatgagctctgctagccacggccccaacgatgcttccggctctcatggattccacagcaaataaaactgtactgacaacagatgcacgctgtacagtgcctctggaaggtgcggtgggacttgctgggtcaaagcacggcaggctctgtgctgggcaaacagggccccgcggcagcccaagggcagcctgcagacgccagtgtgcccggcttctcccatgttctgagatgggggaggggaaggtgtaaaagagagctggatgggggctgtggggactgagggtcctgggaggctggccaggggctcagcaagcgcccactttgggaggccttgccctctgggctgtggttggacagcactaggcctgcaggctgggctgccaggaggaagagcagctccggacctcaggcccccccagcaggcggcgatggagggtgatgggagaattgacgagtgctcgcggggtctcactcgggaaagggccggttaactctgagcaactgggagcctcgctcccaccccagtgcctggaaacacaaacagtattttattgagccttggctgccggggctctggtttcaggaaaagcctcagtcctgcatttgtgaatttttaaggaggcaaacaaggtgaatttgaccttcctaggagtgggagttagggaaaattcaggctgccctaccaagcccttggaaccgtgcagcaggggtcaggggagggatgggcaaaggcggtttggcccatggagcaggtctcctggtcctcccggagcacggggggcggggagctccagctcttcatcaagcgccctttggggtttccaactgttttctgttgttctctgtgtgtcttttccccttttgcctgggggcgggggctggaggggaacatacctcttatctacatcactcgggtctcatgtctgaagggcctgtctcacctgccacctacctggccttggcctcgacatctgagcgcctcatcacctcctctccacatgcccaggggtgcccctcccaaggctggctgggcaggtcccacggactaggccccaggaggagcagtgggcttcccccaggaaagagcagagccagcactgcctgcctggggagggcacccactaccaggcatggctggtggctccgtttaaagaaatctttgtccatgtgggagtgggaggtgcttccccatcctgcctggaagccacgtcctggctcttaccgtggactctgcaacagccgtggtggccacatgaagatggagaaacctggtggctcaggggcccctgatgtcaccgcctccaaggcaacgggactgggcagggcagctcctcaggaaggatgatcccacctgcacgggtcagccctgcagggggacaaggcccaccacaaccccacctcaggccaccaactggacctgtcctgccaagaaggtcccttccaatttgtccggcagctggttccctggatacagcccagacgcagcatcatcctcatgttcacctctgctgtgccctacttcccccgtaaatgacaactgtgtagtcacccacgccgggcaagagaacataggtgccacctggcgggccacacttttcaggggccgtgcctcgggcaggcccggctctctgttgtcccgcagccctcagggctggcggtggctgctcagtgcctagggagtgcccttgccacacagctgggcagcgagcatgactcagcgtttacactcaaccagccgcacaggctccagaggggaagttctctggggtccttctatgagagagcatcctgtctgcagccctgttctggctccttccacatcattcatgcattcatcccacgaggactatggtaccgtgggctcgctctagggaagcaaggcaggagcgcactggggctacttggattcccggggcagacacatatgtaccctgcacaccctcaaatgagcaaagccaccccactggcccctgggtgaggccatgtggacccccacacctttggggccggctgggcaaaccttgaacccccaatttgctgcgtggcctttggctgccctccttctccaaggcgtgactcttactccagagactcaggcgagcacgtgtcccttaccttattttctctcaatcaaactgaaacccattgtgatcccccatagtccagtgcggtctctgttattattacgggtgtctcccttcctccccgtgcccaggacaggccatgagccagagatacaaggggccccaggcaagatgcagggctctctgctcctggctctttatcgtcgtcgggacaccctttgtccaaactcaaggaatcccgggaggtctggctttgccgctttggctgggactcaggtacctgggcatacctgcatctgtgccccctcttcgtcccagtgagacggaccctcagtatcccccccaacatagaacaggaaggtctcaagccagccccctcctccagttcaatcaccctccctcacatccacccagagaagtccagacctgtggccacttccatgccctctccagaccaggagacacctgctgctgacctcgtggaaaacttagattttgacattctgatgcttcggaagtggtggctcctcctccttcacccctccgccacctgtgggcctcctctctgcatctcaagagaacaaccagatctttgggctcctggggtgtgtgccatgcaatttagacgaagtgctttgaaaatatgccattcagtctctgactaggaaaataagtctgacctgataggtccgatgtcatcagctcttcaacatgagacaaaagaggggattttatgttttgagtcattagaatgatataataattttctgaattgacatctggatgttgaaattaggatggtgcaaaaggggtccagggcctcaggctgggcgcagcagccagctcccaatgacgcagaagctgcttcaaaaccccctcaacaaagaggggcacatgcaagtcaccaaagtgggaagccttcaccaaggccacacccaaagtctactgattgtctgtccaaagttcgttgattcctggccatgaacaagcacaatagaaaaagacacagggtcctagtggctacaagtcaatgtgaattggcacatggtctagcagttttaaaatctgacagtagagtatggcaatgggcaagggccaagaagtcctgagatgggaggtcagcgctctaactgggctcagtggaggtctgtgaccagtgtctggacactagctacaggggaccgggcagaggattctgggcagaaggaaaatgtctaaaagtactttgggagggtaaaggacaggggccttatttaaaataaagactgaaggataataagtgtcacccaggtttgtggattaatggagggggcaccatctagccattctccacttttccagtgtggagaacctgggcaaaggcgccagtggtcacatgaggtgctgccacggggcgggctctgggagacccactctagaccgctgacctcttggtgccatccattctgcctcctagaactctggggttctgagtgcatgctcttggtgggggccttcctctttgttgggagagccgctgctgaaggggcctctccctctggcccaggatgtagaggacacgtgaggactacacaagtgcaggggtgggtgcgggggtgggtgcggctttccagccctcgccttcactgcactggaagcctgctttctggtgtgacctttgggttccctctctgcaagcaaacaaccagctcagacaaaaccaaccatgaccacatctcaggtgggtggcacctgggtcaccctcccaccacagcccctggagcagtttccaggtacctggcctccactgtctattccactcacctcctgctgatgtggacaactttagaaataaagtaccagggaccccagaccactaggcaagagcccaggtgccccctgggaaatgccaccacccaccccaagagcagggtggggtctagctcctgaaacagtctcctctgggcaagtgctgcctttcttcaaagtccaggcgccctcttggttgttggataaatccccaggttctgccccatgattcatgtagacgggagtttcccccggttctctgtctttctgcctggctgggccacagatgagtgccccaacccggcagacaaacagaattggacttttagggtcagaggcagccagcctgagatggagtagggtgggggctggggagggtgttgggaccccgggaaggggatgaggacattccaggggaggtgaactgtttgtttccctggagggttagacaaagaaccgagctcttgcagattttgccggaaatgcaaccagagctattgatagggttgaggatggggtctttcagggtgggtgagtccctggagctgactaaagattagtgttagtgcaggtcagatgaggagctgcccccacaggtgtcgctccaggtgcccacagcagggacaaacccccgccgaccccctgccccacgggagctggttgcagcttcccctccgcctcccccaccccacctctctctgtcccttcccccgtgcagtggcctcagggtggccacccacctgctcccaggggacgtgagagtgttagcaaaagcaccgtgcccttcccctccaccctctggagccttcagggcagccccaaagcggtcccagtgtctctgaaggggctggggacccggagtctgaaattcagctgatgggtcaccaaactggcctggcctctgagcctctgcaccgatcctctcaccccatcaggtacctgaagctgatccaggacaccaaggtctgtttgtgtgggggggctgccagctccccagaatctggcccacgatggttttgattagaggaaacaccccaccagaaagcatcccagagatacctagagaccccctgtggcttccccaaagtgtcccctcccctccccacgacctgagaggctgccatgcccacggcacgggccccctggggtgctgtcctttctagaaagcaggttccaaaggtggggttcgggcctacttggcacagggaggcttagacagaaagcgggactcccctctgccacggccccccagaccccggccggctcctcgcgaggctggacccgcctccccaccccctcctttttgcgggcctgatgaaaggcccccggttttccgaaacgcacaactgctgtggggtgtctgcagagcccgggcttctcaccgggaactgctctcctgggacggagggcggcggaggcctcccggagcccccggcccacctgaggccttgggggcggggtccgtgcgccgcgaaccccaccgagccgggcaggaggaggcgcatttgggcacaaagggacctcgcgtcctcaaaataatcctcgccgctaattcccattccagcaggaagaggccggcgccgctcacatccaccccattttccgcggaaggggctttgttgcttttcttttgatttcaccccagcgggcgcgcgatcccgcccggcacacgcctggcctccgagccgctgcgtgcggttctgcccaagtcggggaaggaggggcgcgcagaacgggagagggctggagacgggcacagaaggagaggagaggagaagagaggaggggagaggaggggaggggaggggaggggcggggtgcgagaaggggcagcagcccccgggcccagtcatccagccacgtcaggtgtgcgtcgggtaaaggtagtaacctggtggcggtgacgaggaggctggagaacgtgcaagaggaggccgagcctcagagtcccaaaagtcggaggaaactccccacctcctggagcctcccacttgctgtaattccctgcagtgacccaccccaccccaaccagggcagcgaaggacccaccgggccctggccccaggcccctctgagccttccacccaccctgcccaagccctcacccagcccagccctagagcccgcctgtagccgggacaccgcaccactccctccaccctcaccctcagccgccagcccctgtctgtccctgtccagcccaccctctctctataaaacctgagcaaaggcaggagaccctcccgcctcagaagagcagcagcaccccgggctccctgcagctctctacggggcgggggtgcaggaagccacagcggtgaccaccagggccagggcccagcaggctgggagctgctggcggagtgggacagagtcctcaccaaccgaaccgaagtgcagtctgtctgcctgatggatcccttgtcatggggacccacaggcttgcagggcctgtttttcttgaaaagaaggtttatttgggtcactcttaggagttcatgctgctctttggccttcggcagcttggctcggccaagctggagcaggaggagagagaccagaagacaggcagcctgcgggcaggctcagatcctgggctccgtgctcccacagtctgactccagcccctcgcccagaccctggccccagctcccagtggagggactgcccgtcagggtgggttactcggctcttccttcttgtgtggggtaaagggacctccctgtccagtgccacgcccctcccaggtggctgcaggagaaaccccccaggggcagatcatcagatggcccgcctgtgtgaataggcctccttggggaaactccggaagaattgttaaatatttcaaggtgggaaggggacgtcaaggtcatcaaggcccactccaggtggggcatgaccctccctgctttgggctgccttttctttctccagggcgtgaggagcaggccatgtggtctagactcactgtgtagccttggacgtcatgtctgccccctctgggcctcaagacgtgccacctccatccatggtgggggaggctggtgggggtccccagccagaccgttgggtttggcccttgccttgggaggtgagggtgggaggctaggggagtgctgagctctgggctgtgtcctgcttagctccctcctttcctggagaacggtaggagcacacattgagcacctgttgcatactaaataggaagaggatttttttttaagagggagcaggctggggaaggggatacttgttcttgtccctgtggatgggtaggagcggaagctgtcacagacagattagggccacaagggccaacttcccagcacctgccccttcctcccctcccactcccacttccccatttcacccccacttcacttctcccacatcttactccatcccctacctcattccccatcccacgccccctacttggctgcccccacacaggaccacctcccagggcctcccaccccacttttatgttcttgaaaccacagacatggaaccttcatgcacctgtaagcttagaacttggctgactttccaaagtgctgagccacaagaggcctcacacctttcctggaagaggagccagccccaggccaggcctggcagcctctgggccaggacagcctcttccacgaccccgcctaaccctgcctgccagacctgcccgccacaccatcgggaaagtgtctccctccccctcgtctcatggccactcctagatcgcagcacccctgggggtcaatgcacagggagctgtcaccacatggccaggccaggggtgtcccttcctcttgtcctcaatggtgtatgtgaagaatagtgcaaggagggtccctgcggggctggctctggccccaaggccttgcatgggctgctatggcaaaggcccatccccacataccgtgagatgttcctcactgggggctttggatcaagggcaccccatggtaccaggagaggcccgttcaatatgaggagaaaggcctgggcttgaaccctgaactcctggttccagcacgtcctgtgacctccctgaacttagtgtcagacgctaggatcctggttatccctgccagaaactttgagggctccagtgaaaggaagttggtctctcccccacattagtgcacccacagccctcagtttccgggccatgtgctcagagagacacccgctcctgcaccccagcatctctgtgcacacctagcacgtccctccccatcacgaccctccccacatccgccacgcagtgccccgtgatgcccgcccccacccgggagcccgcaccgagcccggccccagctggcagccgcctcgcggtgtttgctggatgataaatgaataaacgggggcctcctggatgctcagcaaatattgcctgaatgaaggaacgtcgcacgaatacagacacacgagagaacacagaccataaaagtggccgtgaccagtgctgatgggctgataagcgatctcggcgcatggaggcactccacaggtcaccatggtgggcccgggggggcgggagaagtttctgctcacagccggatttgagaaggccctggtcgctctatggcaacctctgcctgtgcaccatgggccctttagttctgttcgaggcccctcttttgctgtgtgaccttggacaagtcacttagcttctctaagcctcactttgctcacctgtgaaatgtggacagtaactgtgcccacctccagtgcccatttcaggaaccagaggcaaagcatgaagggccaagcacagaaagcacttcccgtgggcccgcctgttggagaccctcacgcgtcagcgcccggaaatgacactgggagctcaaggccagtggtggcccttccagcaaaccggacaccccaggggacgtctgggcagtggggagtggcctaagcagatgaaaaacctggggcccacagcttggagttcaggtcctagccatcggcccccatctctgtgccgccgtatccctgcccgggcaaggggaggacagtcatgccatctgtgcggggtggacaggcagcgtctgtgggagaaccagcatcactaaagcagacaatgtgggaggccctcacccgggagtccctcggggaagggcagctgcttcaggaaggaggccggagggtcccctcagtgcaggaagccagctcagccgccccaggcccagatggggagggggcgaggtgggggatatggagccgggcccccttgcaaggagccctgtgcagatgcatgcaaggacaggggctggccagccccaaagcccagctgtgtggcctggggctgctctggaggggctgctagcttagctatctcggggccttgaactttctattctgttttgcaatcagttcagaaggcggcattgctagattcccttcttatcacagagaaacttctagcacaacaatagctgattgtactgctctctggggtgcggctgcattcctggacaccccccacgtttttttttttttttcgtggtatctttggaactataatggatctcattgtgattggtctgttcaggggacagtgtggcccttgaatttagaagcgtgaaagggtagtgggggctggggagagggtggcaaaggagagtgggggtgggagggaacccagagacaacccgtgagacagccaagggacatctcagagcatctcggcggcgtcctgttgcataacgcacctggaaactgcatcccctggactggctgggtttgaaaatatgtagttatttgtcaaaccaccaatgtttattttcattcagttattaagaaataaaaaggggtagataattttcactccctgcctgtgcctgtccggcaggactcggcagcaggtcgatccggcgcagactcatctgagtgcgacgtagcggcagccagtcacatcgtgtcctccggaggccgcctgctgctgcgcggagccagcgtccaggacctggggccgggggaccagagctgggacaggcccagcccctgggcggcatagctatgtggccccgggaacactggctctccaaggcacaaggtctgtgagtgtgtcaggtggggagcccaacctgctgggggaacccccagccccacaagtaggtgccggccactggcaggaggccctacactaggcctcacagtcctgcctctggcccaacagcctgggccccaggagagtgctgctctgggtgccacctgccgccacggtcccctcagcccctggggacttcctgccccacccgggctcctgagaaaaccctgggagggatttcttagaatgttcagcagttgctgcccagcccaggacttggcaggagccccagtgtccggaagagggagcagatcaagttccgaggccgggaagccaggcgtgctggcagggaggctgcgggccagcgtggtgcctgctgggtgtggatgctgggactgctacttcatggggaacgtccggtgggcctcctgccaccctgccccttggtgcccctgtctgtaaagtggcacctcccaggcccaaccctttcttcactggctggccagggttcaatgggagcaggtttcgttggcatgtagcaccgtgcctgagacagagagatggctcacaaatggtcgtcactgttgttaaagaaataaatatgcttagagaaaatggcgtttactctcttccaggcgttttcaccggctgcgtcccattcagtcttcccagcatgatcccagctcggagaaggtaaggggcctggtcaagtgtcctggcaggggctgaacccagatgcatggctggctcgaggggccatgtgccacagaggctcacctgtctgaggctttatttctgctctgaaaccccttcttatcaggggcaggggcaccccaaggcccacaagacaaaacacagacatcagaagagaaccctgccccagtgtcatctttccaggtggcaggggcctccgagggcttgggctctgggtgggctcggacttggagagcaagaggggcagccagggaggggcccacattggggacattcagaggccactgagtagggggtctgggaaacaggggacaaggcttgctcttccacaggcagggcaggcaaccttgcactctgtggaggccctgctggactcgctctgagacagaactccctgtcactgtcccgtgcaagaaggcctggagggggcgctgcagagcaggtgcagggtccaccagacgcctttggaggccctgcagaaaggccaagggttctgagatctcaactcagaacgagagggctttccttttccaccagtcttgggtgccagagaggtggggagcccaggccaagggacggccaagggctgaggaagcacccaggatcccaagagaagctggcaatacatgcatgcacgtctcatcctgactcctgggagagataagagcacctgtcccccggtgttgtggacagagcccgtgagccaccgggcagagccatgcatgatgaggctgtggcctggccaagaacagcctgtgtcccagacaccaaagaagacatggtgtttgagaggtggagactttggagctggtggggacagccaggaatgtttcctgggagaggtgacggacgctcctgctgggcagaggatgtctcgacgtctctcctgctagcacacagaccgcattaggagaacagctgaagacggcctgtggggacacccagactcttgccaaacaggtggcagaaaaacctaagctggttttttttccaaataatttattttttattttttatttttgaggcggagtcttgctctgtcacctaggcaggagtacaatggcacgatctaggcccactgcaatctctgcctcccggattcaagcgattatcctgcctcagcctcctgagtagctgggattacaggcatgcgccaccacacccagctaatttttttgtatttttagtagagacggggtttcaccattttggtcaggctggtctcaaactcctgacctcagatgatccacccatctcggcctccaaaagtgttgggataacaggtgtgagccaccgtgcccagcctcaaataatgtatggaagggaagttcatataacataaaatcaaccagtttaaggtgtaccattcggcggcatttagtaccctcacaaggtggcacagccatcatctgcagtcgcagaacatgctggtcaccccaggaggaaacgcccgctcattcagcagttcctcttcaccccctagccactggcacacggatctgcattctgtgtctatggatttgcctattctggatatatcatatcctaaggtgttttaaaaagaggattaaagggccgggcacggtggctcatgcctgtaatcccagcactttgggaggtagaggtgggcagatcacctgaggtcaggagtccgagaccagcctgaccaacatggggaaaccccatctctactaaaaatacaaaaaattagccaggcgtggtgacacacaactgtaatcccagcttcttgggaggctgagacacaagaatgggttgaacccgagaggcagaggttacagtgagctgagatcgtgtcactgcactccagcctgtgcgacagagctacactccatctcataaaaaaattaaataaaaataaaaagaggattatagagccaaagcgggtaattgggttccagtccccagcccacgtttccagctgtgtggcttgtgcacaacactgcatccgcccgtctcagtttcgtcatctgtaaaatggacataagaatgtccacagtggggtcgtcatgggggtacagggctcatccaggcagagcactgagtgcggtgttccaaggccgtggtgcactgtagctgttggtgacacgggtgtcaagtatcaggtgtcagggtggtgtgggacatggacagccaggggcctgggagagcaaaggctggaacggtagacctggctctccacggagcacggctcatgcacggaacctcgaacaggccacagaatccttccaagtctacgtctgccccttcctacctccgtgacattgggcttcagtttccccatctgtggaatggcaatgtagacctcacagtgctggagggactgagcctggcatcgtggcgggcagagtgggggggggcgggcgacgcccagggaggggtagggctgtggtggggaccagtgaggccttgagggcaaattcctggaaggcataacggctggccgatgccaaggccacagtgatggggagttgaggggaagagaggggtgggcctgggagcaggcaggcagccccggctctgcttgtaagcaagtggctgaaggcctcctgtgctggctcccctggcaggcgatccatcagctcagctcttactgtccggagccggcgagggcccataaatgcgcccgaccccacccccgctgcaagtcacccaggttttatgttgtaagaacaccgtggggcgtctcaaacacaccactaatgacaggcatcatgaagcaataaaagtgatggggctggtgggaggggctggcgggaagggcggggggctgctgg

SEQ ID NO: 461 - DNA, 2438 bp, Homo sapiens
cttcccaccgccagaacgtgcaaataggggataatcagccctgcacggccatcctcagcaatgctgcttatttaacccattttttaaaatgacacttaatgttattggctggcgtacgtgtgtgcgcatacttaaaagttgatgcgtggtgcagctctgctgctaatgtctgctgacagcgtcgcccgatgttgctcagggcctctgggaagaggggacacctttgatgtgggcgtgctggcacccaagaggcagcgtggtcaggctcgatgcttgccagccctggaaggtcccgccagggttggggggtcgggtgagcactcagagatctggggaggaagcgaggagcctggtgtcctcaccaggtgcagaggggaaatgcgtactgctccagaaggttctgactcaagtctcggccctgaggactcagaactcacaagtcatggatcaagtacagagggagggagggccccagcccacccctgcgggggaggaggagggtctgaaggtgggagggcagctccatgagcagccactgttcctgaccagccgaagtgccaggcagggggaggtttccatgtccaggagggagaggacctccaccctctgacctttcagttttccatagcagcccagtgtgaagctcggcgggggtgggcagggcatcaggacaagatgaagatgctggctctggaatgaggactccccttgggctaaggggtagtggctggcagaggttgcccagctcttttggaggccacagggaatagaggtggggtggtgcttccgttcctgtgaggcccgcccccctgagccccctcgtctgcttcttgtttggcagaaatagatgtggggcacagcccctagatgatgggaatctgcccaagctgtgccctctggggaatgaaatcttgctcctcgtgcagcttcccctttcccttgcggggtgggggctgggggtgccaaggctccacccttggagggggttgctgggggtgccaaggctccaccctttgctcgctgggcagagggaaggaagcacctccctgtatgctctgcaggggcccctgcaggccactttgcctcagaggaaggaggagaggtcccctgggaaaatgcgcgcacacacacacacacacacacacacacacacacacacgcacatgcacacacgcacgcatgcacacacacacacacatatgtgcaggggtgcagcctaagtcagtggagccaggactggctgcgcagctgggcctgccccattcttggagtccccagggaatgagcctcaggatccacttcgtcccttgtttctaagccaggctgcacggccgttcctgggtgtgaaagcattctgtcctgtctccagtcagagggaaccgcccccaaactagaaagctaatttcccccgaaggttcatgaagccagaggcatgcccttgggggttggtcgggagaagggtgagaggcagtgctgtggaaggggcctggcccctgctgcctgcgattctccccgggtatgtggccttctgcctccttcagcctcagtttcctcacctgtaacatgagaatagtgatgcctgcctgcccaggccacctcctgggactgcagtggggactctaagtgtaaaactgtcatgaggatggtttatgaagtcccagggaccacacctgccactcagggaagagaccgctgacctcagccatcagccgtgtgcatcgtgaggggcagcgagctcaggacggagagctctcccttggttcggagtcagcacacctgcactcccacacgcccacccagctgtgtgtcctccgccgagggcgagcctctctgtgactcttctgtaaaatgcaccccattctgcccactcctgccacgagacccatcctctgcgatcccgccaggcatgtgtgtgtgaatgcatgtgcaaagctctccatcagaagggtggtgtgggccctgcaggtcctacccctcggccttgaagctccctcgggctgcggactctgcctcctgggtctgagcattagaaccaggagaggggtgtccctgggcagagccaggggtgcaaacagcctgcagccatctggccttttaagtatagtgtgtcgcatttccgggtaggaaggtagcatttcaagttcaaagagaggtcaagtcatgcaaccatctttcctccagcacttttggggtaaggaggacagtttttgttatggtttaggggaaattttcatgaaatttccaccattaccaatagattactgatgtccatggcaagtgatctgttcttggtattttgttttgttttggtttggtttttaaatgtaatcacccattggtcaggcccaggactggtcaccatgagctctgctagccacggccccaacgatgcttccggctctcatggattccacagcaaataaaactgtactgacaac

SEQ ID NO: 462 - protein, 149 aa, Homo sapiens
MMGICPSCALWGMKSCSSCSFPFPLRGGGWGCQGSTLGGGCWGCQGSTLCSLGRGKEAPPCMLCRGPCRPLCLRGRRRGPLGKCAHTHTHTHTHTHTRTCTHARMHTHTHICAGVQPKSVEPGLAAQLGLPHSWSPQGMSLRIHFVPCF

SEQ ID NO: 463 - DNA, 31124 bp, Mus musculus
  misc_feature (1)...(31124): n = A,T,C or G
tgactcaaagttaaacacacagaaggcagaaatgccagcttttacacagtattttgtaacttaatggtctcaagctgtttctcagtgcctgttcgggtgtggtggatattgctggtacccacctagactcactttactcttgcatgttgtaagtattgcccacacatgaatcttagctgctgtccttatcctgagaatggctcttgcaaggaatgcctgtgaggtcacgcttcctcccagtgaaagggggcggggcctttcggctagtgatggtactgattgggagcaggcaacagctgctccagaggaattagcaccactatctagctccctcccctgccagcctgttacatctttctccaaaagacattatggagaacccgccggtgcaggagttgttctctctgctcgggctctgctcctacaaattgcctccccctgagaccaggttctccttcttgtcagtgtgataaaccaaagggagttagttgcagtcctgtgcctagatgctcactggtgtagcctctggtttatttttcctgtcttttctacaaagacatggcaactgccaggttggtcccaaggcattgtggggcatgatgcttgtaaatgatccgccgaaggcatttggagtaacatcgacctacaaatcctagataataacagggaagccaggacggttacagccagcagcggcagaagctgtgggtcgccttggaggaagtcttccattgaaccacattccaacgacacaaatcaccttccttcgaccctccttctgtgaggaacttaattttaaattctatctcactgttaggatgcctcttgagcttgccttgcaatgggttcgagcttcatttgtctagctggttgggatagttagggatctgtagagatggttggaaagtctgtgaagaggtgtcctggaaacctggggaggagaggatgggtaggtcctacagccaccaacctggcctgtcagtacagcaacatggtgggagtattcttcttacacggtagaaatattcttcttacattcttctccagaggtgtaaaaataaggagaaaaggtgaggaggaggaggcaggtcagagaaaacagggtagcatagtcaacagggcagactttcatgaggatagaggagcagcccatttctggctgtacgcttggtaggattgcccaggaactggaaagactgtgaggccctggagaatccctacaactggggctgccagatgacttggtttccagtctgacaagtaaagatggttggaagaaaggtggaaaatttctcaaagatttactagtgacttgaacttccttgttgagaaaattctttatatgttaaggacattagccctttgtcattgtgttgtaaatatttgcattttgactttctagggacaattttttttttctaaacaaaagttgaaaacattaatagggtttggtggtggtggtggtggttgtgttttgttttgtcatttggtttaacacacacacagacatatacagacaccataaattcttttgtaattttattttttaatatttaaatttcaatgcatgtatgatctttgggtgatttaaaagatgacataaaaggtgatttgtttcccatctcctcatcttccctttccaaaagcagtcagccctctagtgattttttttttttttttttggctaatatgtcttttctctgctatttagtgatgctgctcacattctgtgtttccggatatatttgggtctaattctggattctattgtttcattgatctgcctatttaagcactagtatcaagtagatgttaataactacatggaaagctcctagtctctaattggtattcccagtaggtttaagaggatgtggtatcaaaagagaactgtctaaagagctgggtagattgctttcagatgaaaaacaaaattactaaattataggctatgatagaggcagtgaacaaagggagctttatagaaaatacactaagtttatttgagactagctaaataactctgaagaaaataggggatggagattgtgaatgaaaataatatgaggcttggaagatgcatggatgcatggatgaatggatggatggatgggaaatggatggatggatggatggatggatggaagggagatggatggatgggtggatgggtaggannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctttcctttcctttcctttcctttcctttcctttcctttcctttcctttcctttcctttccttccttccttccttccttccttccttccttgttgattttggtcatgtgctcattctgaagctcatcctggcctggaactgttggcaatcctcctgcctccacttcctgagtcctgacactatagataggagctatcacacctcttattgtactctgatttccttaaagtcattaagatgaaggcaataaaaatggtttgatgaattgcccacgtgtgtctcagttttaaagaaacagggtcttgctggggatctcccacatgctgctgagaaccttgtgctgttgacctttgaggtcatctgtgaggagctggaacttcccagcagagcgtgcctcagagctaggatttgctcactgctccctccctccctcgcatcctatggatccactctgggctcagcaccctcggttgtttcatggcaggaggaagacgagttcattgtggaggggttactgaacatctcctgggggctgcgcaggcccattcggctgcagatgcaggatgaccacgaacgcatccgtcctcctccatcctcctcctcctggcactccggctgtaacctgggcgcacaggggtgagtgaagggagatgaatttgagggtatctgggggctgctggtccagttcccagcaccccaactgctatctgccacaggtttgggatggggacaaagggacctctcacctgcctgactccacaggcacagagtgaagaggggtggttctgagtcagcaatggggagtacagggtaatgggcagcagagggccctccctccaggagccctagccaagcctgaggcttccgacagggtgccaacacacacatcctcccaacttgaatggtcctgctccagggacatctaggatttgaactcactgatcaaagctctctccctacttggtggaacctagtagaagagaaaggaatgttctgtctgagccagccgagtgaggtcagccagcgagcttctgtacacctggaacaggtcatggcaggaggcaggagtctaggaggtcctctattgaacctcattgcaaggtcagcgaacagcagcatgtctgctctcccaccttctgtgactgaatgagaagctggatgctggcacggggccgatcttcttgttctctctgggacttcagtcttgagatcaagtgactaactagccttgttcccctcgaaacttgctgaggtgggcggcattcgggccagagcctgggtggagtgtgctggccactcagccaaaaccacaatgacgtgctttcaagtttaaaggggaactgagccctccttccctgctggctgcctggaatgttgttacattccacggccaagtggatcagtgtcctaagttgagaaatatccacagaagagccaaatcctggaaccaaccttgggactaaggagggaagttgttgccctgcccactgggcacggggaagcctggtcagggctcttgggcttgctctcagcacattcacagttccggtgggccagatcctgtccgtgcccagctttgacctctagattgttacattctgttctccaagtgagatgattttaaagatcccattttcctgtgatgcctaggggtccttccgtctgcactccaggtttttctgcgttctccagtgacaacctggtccctgaagcctgtaaatattttaagggctttcagaagcatgtcccaaatgccagccaaacttaaatgttgcccgcaggagtgtgtttgagatgctcagaccagtttccgcgttggacagtggcgatggggtgccacctggacccagtgcctgcatttctcggaagggcacagactgaggcttagacagttatgagggaaaattcttccagtttgtcaattttacttttctttccttaaagccattattctaagaatgtatgccttagggagcccctcnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnattcccagttaccacagcaaacccaggtcgcgtagttcaggtgagcttttgtggtcccttctcctgatggcaaccctgagagcatcatcactcctgagccgaagaagccagggccagtttctgagacgttcctccaacagaaagaaacccagcttggaatcgtgtccctagaaaatgggccctaggccaccacatgtgctttgagactcagtgcatggacttggctctgggttcttccttctggatctaatgaactgggttcttgcagaggaaggaacagaacatgtttctcctgagcttcctgcccccctcagcacttagaatgggatctgggccagcctcctggatgctcggcacatcttgcctgcctcttgcttgcctgtcaaatacttgagtttccctacatggcatgtataaaagttcccattgcaggaagggggccgtgaaattgggacctgtcctctcaaggtctaaacaagcctgctgtttgtttgcaccccctcagcaccacactgaagcccctcaccatgcccactgttcagatctcagaagtggatatgccagttgaaggcctcgagacacacagcccaacaggtgagcaatagaaagagcctcctgctagaggcccacggggtgacagctgtgtttgaacctgtgacttcttgtctacatctgtaaaatccacacgcatcaatagctttttaaaaagttaaaaggaaagactttaaattctcccacctcctctcccttcagtttccttccttcaaagcaacctgcaaaatgtcctttgagatgaaacaagcaaatccatgcaaatccaaatgacgccaaggagaaggcctgctgccaccacccggagtgggtgcggctccttctgggcctctccccagacaagtggcagcttttgcagtagctctagtcccccagtcccctcaccagtggcagccaccacttgacttcctgtctctgtgactttgctgtgagcacctcttgggagttgactcacaaagtacttattttatgactagtttcaactcagggtaaggcctcaaggttggtcatgaggcagcttgtttgcagcgtcctgcaagccccgtaggtcatgctgagcctaagccaggcacttttctccgccctgttatgtgcgttaacttacttacagcctcgctctgatcccacaaggcagaggcttttgtaacccctccagaaaacagaggcaagagaagccaggggttagagctggaatctgaacttgggagccagctgtgaggcccgtgtttggaacctgtgcactgttactctcagtaaatcacacattgtgtctcccccagcagaaaattatttttataaaatatgttactggggagacagtaagtgccaaagagttggcctcaaagataactgggctcaggtaaacagcccatgttcctctttcctccaagattccagaggcctgaagcctgtgcaggaggacaccccacagttgatgcgcacacgcagcgatgttggggtgcgtcgccgtggcaacgtgaggacatccagtgaccagcgacggatcagacgccatcgcttctccatcaatggccatttctataaccacaaggtagagggctcgtggaggacaaaccttggggacatcaccacttcctggggtttgcagcttcagtgccacgtggtccctggggatgcatctgggaaggcaggcattttcagttcagtttgagggttgtaagtgtcatggaggcttcagtgttttcttgagagatatggaactttgggtgaggaatggctgcacgaagtgttggagctttcagtgcctatataaagcagatttagccttccaagttccacgagctccctcccacccccgccttggcacatcatctgtgtagtcaattcctggtcccacccctggcctcccccagcacccagcaccttttgcttccccccctggagtgagaagatcctcacttcataataagagccctgggctcagtagtaaaatcgatatattttatgaatttgcaaagtcaatagcatcctcaagaaaaggcaagaaggctggcatgccatttggtacaaacagcattttttatattcctaatctcatttaactgacccttaaattcctagttggctgagttctttagggaggtacaatcagtctcccttgggtctagcattgctcactccccagatttcctatccaataggcccaagatgcaaacttttctgatttctgtcctgggcttgaatttccctccttttctgatccctgggctcagtcatgtagcagagtggctgcagatggacaaactgagagtgttcagtcgagggagcactggcatggggctggactctcccgcttctccatgttctctgacaaactgcaaatgcacccgctgaaagtggaccataatggtttattcctttttcagctgctgtctgacccctgagctaatgactgtttttgagcaaggctactggtctcaactcagcacactgccaccttggggatcccaaactagctaactcctcctttctttctgttgcttaaatctcaccagaagcaagtacatggtgggagggtgaccagagactacctaatgcacaagggtatggtgggatgctggtctctcaagggaagcgtgtttgtgaatgttttgcttgtctaatctcatcgtctttctaatcctgatcttttggagctcagacccaaacttctcaggggagcagagggtgagctggctaaaccctaaggaccacttcatctacattgaaggctgatgctggccagactgccaggggctctctttgagcacgttttgagtactgttgctgttccccttactcccttgggttttgatactcagtccttgtccctactcccctcttaacccagacccctctgttgacagacatcagtgttcacaccagcctatggctctgtcaccaacgtccgcatcaacagcaccatgaccactccgcaggtcctgaagttgctgctcaacaagtttaaggcaagttctctccatgggcagtgagcctcggtgctctcaggctgacctcttctggtatgtctgaagagcacgacagtgtgctctcacatacagtaaataaataaatatttttaagaacccaccaaacattatttattcacatttttattttaaagtgagacctcactatgttgcctagattggtgtcaaactcctgggctcaaatgccttcagcctcctgactgattggaactatagtattattttctcccccaaatggttttatttttatctatatgtttaggttttttgtttttttgtggtactagaactcaaacccaagtcctcacaccgagcaacaacgccctcagttcttgtattcctgtgttcataattttttttatttactatttgtatatgtgtatgttcatgtgtacgtgccacggggcatatgcagaaggcaggggaactttgtagagttgattccctccctctacctttgtctgggttccagagatcaagcgatcaggctcaggtcggcaggctcacacccttgccccgttagctgtctcactggcttgagcattcttattttttatggaagccagtgcaacctagggcactaggctctaagtttgagtcctcacactagatggttgagggggacaagttgccttcaccactctgggctccagctttcttatgtgtggaaggagggcggtgcccatgtgctatgggataaataaacagacgttaagtatgtgggctctacgttccggaatgtgttaactactccagtccaaaagcgtgaaatctgaattgcaccaacctcaggaacttgagcaatggtgtgatccagccaccatctcaggtctcaggtttgtgtagaagagaagattagctggaaaagcttttgccaaaattcccaaacctgaaaaactctgaaacctgaaatatgccttctcccgaacattgcagatgaaggatgcttggctgctgttatctggcgtgattgatagctcccctgcctgctgcctgaccttctcggtcgtaactaaatggcccttcactttgcagaagcctagagtctggctttgcactgtggaggcagagggatggctccagcctggggtgttttactgagtttcttttgctcctgattcagattgagaactcggcagaggagtttgcgctgtacgtggtccacaccagcggtggtaagtctgaagagcacacggtacactttcaaatccctcaattaattcaaaatagcaagttttaaaaacaacaccaacaaacaacaccaacaacaccctctattttgttgttgagatttcctaaaattccaaatgttatttgtccccaagcttggtgggctttcatgacaagttccccaggggaatgccatgcgggcaacaacactaagtccccaaacttaactgcctattagaaactattgtggatgccaagaagtgcatgctgacaggagcctgatatggctgtatcctgagaagccctgccagagccttacaaatacagaggtggatgcttacagccaaccattagactgagcgtggggtctctaatagaggagtcagagaagggaccaaaggagttgaaggggattgcaaccccacaggaagaacaacaatgtcaaccaaccagacccccccagaactcccagggactaagccatcaacaaagtagtgcacatggctccagctgcatatatagcagaggatggccttgttatgcatcagtggcaggagagatccttggcccggtgaaggctcgatagatgccccagtgtaggggaactgagggcagagaggtgggagtgggtgggtggaggaacaccctcacagaagcaaggggagggaagatgggatagagggtttgtgtgggggaatgggggtactgggaaaggggataacatttgaaatgtaaataaagaaaatatccaataaaaagttaaaaattaaataaaaaagaaagagagagagagagagatgaaggaaggaaggaaggaaggaaggaaggaaggaaggaaggaaggaaggaaggaaggagtgaactggacttcctctagaggtagatgccatatttttcccaagaggcatcttctagaaggtctgagctgtgttagtatgtgtgtgtgggggggtgggaggtactcgtgtgtgtgtgtgggggggggtacttttttacaacagatgttgaatagtttattctaacacagtctaactgtgcagctgcgtctcctgaggtacctggcccattttgacccctgaattggccatcactcctggggagaaaggtttatggctgagctcaggctaccctggttgtgtttcagaaaagcagaggctgaagagctccgactaccctctgatcgcccgcatcctccagggcccttgtgaacagatctccaaagttttcctgatggagaaggaccaggtggaggaggtcacctatgacgtgagcccctttgcttggtagtctttcctcagcagttggggtgggaagcgacagtgtgggaggagacctactaggttatagaacgacttgaccagagctttgtcccctatgaccaccattcttcaataccaggttcttttgataccagttgagggtgggcctggtggggattgttagaagaataactttcttgagcctccggagaatgctgggtctctgaggacttcggatgcatgctctccacaccaagaactcaacagcgagtttcttttctcgggtgttagttcatacagtaacatgcatccccaaatccaaataacttctaacagtcatggtttttctcatgattctgttatctggtagcagcagccccatgtcagactctgaacaaatttgtatcatattcagatccaggctggagagcagtggtttcctgggcaggtggttggcgcatagaaaaaactagtataggcgctgggagatggctcagtgtgtaaagagttacacctgtgtgaggacctgagttcaaatccctgggacctatatagtatatatgagatatagtagcgtgcatctgtaatttcagagctctagtgtgatgggaggtagaggcaggagactcctagggagtctcctctcttgggccacctagcctgtcacatgcagtggcaaacagcaaagagactgtctcaaacaagttgaaagataaggttttcttctgacctgcacaccaaggtccatgcaagtacttgagtgcctgtgttaacacacatgtacacattcacatgtaaatgtacacacattattacatgcacacacatgattaatctgtaaacagtttttaaaagaagaaaccagtcctaaccatggaaatgcatttgaaacctccactcagatttagagtgtgaagtctgcagaagttccactggcctcgcaagccacctagtgacactcagcactggtagggtagaaaacccacccttaacaagtggagagagtaagtctaggatctgattggggagggatagagaaagagtttcttcaactcgccagagacagtcacttcactgaagcaagtgccaatttgaatgcccaaagactggggacttgaagctgggctatgatgactcacattccctctgggtagaacaaagtctttttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttcttctcctcctccttcttctccttcttcttcttcttcttcttcttcttcttcttcttcttcttcttcttcttcttcttcttcttcttcttcttcttcttcttcttcttcttcttcttcttcttcttcttcttgtttttctttttccttttccttttctttgtctttgtctttttccttttggtctttgttttgttgcagctctggggatggaacttagagcccacctccatcctcccaaccccaggagggaacctagagcctccccccaccagccccgggcgggggggggggacctagagcccaccagctacactcccagccccagggggaaacctagagcccaccagctacactcccagccccagggggaaacctagagcccaccagctacactcccagccccaggagctcttcctcggttctgaatccctgtgtgaaaggaaacttcttctctgtttgaagtcactagagctgaggatcaccacagtgaaagggaaattgcgaactaagaaggtggagtcctgcaaatgccaacctcctcatgcagatgtgaccagcctgggacagacagaggcctggcccttgtctaaggaaatcctgggttaatgggaaaatagatttctgatggctttgtggacttgaggagagctatagcaaagacattttgtaacaaggggatttgctctccctccccaggtggcccagtatataaagttcgagatgccagtccttaaaagcttcattcagaaactccaggaggaggaagaccgggaggtggagaagctgatgcgcaagtgagtgagcatggtgtctgggtgcaggctgatttcagggacccagcgagaagtgagcgagcaccactattgagctggctggtggggactggtgtccgggtggagcggggctgggggtgtgtccactgacagacccagatctcagacagggcatgaacaccggttttcttttcccctgcttcttgtgttagctgcttatttggatatgagatatcaaaatatcttttatgaaagaactctgggaaagaatgtgttggcttaagacctctttggaatctggatttagagacagggagttcactttctcctacatacgaatctattgtctgttctgtaaccaaacacttggggctgggtaattgaaaaagaaaagaggtttatttagcacataatgaaactcgtgctcacagttcaagagcacgcacagcccacgtctgcttggctctggtgagggccttaaggcagatggcaagactgtgataaccacttatgaagcaggaagctctccaagagagggacttggactgagcttttgagaacaacttgttattttaagaactaactggagtcttgtgagcctatattaatttaactattaccaggcacccccacatggacaccaggctccacacacacacacacacacacgaacctttggaagaatgcacacattgttcacaggatggcatggtgccatttcagccatgtgacaatcaatgtgacgaggcccccagcaggaagctgcctttccctcagacgacgttcagagtctgatgttatttgaagacaaagtctggaggtcatttgagggttaacacaggtcctaggacacctgacaaaggagttcaggcaaagaatgctcagacacggaggttctgagaatcatagggaggtgttctgcatcgtggtgactgcctgagctgtctactctaaaaaaaatttcccatcctcccttcctttagatgtgtctcttctggaaatttcctttgagttcaagaatttagcaaaacttctttctggggagggattgatatttcatttccattacagaataggccttcttttgtggagataatgggaagctgttaatctggtgctggagactaaatccagatctgtacttgctcccatcagtatttagtacggcagtagctatcattgaacacagcgtttgctgtgtagtgaactccaagcatggggagtctgccacctgggcctgtaccatgatgcccactccagcatctgcagtgccacagctcacaaactctgggcagaaaatgaattcacccattagataggaagctgtgtgttctgtggttgttagagcctcttctgcaaaagcaggcactggtgtaggcagacccataagaggatgccattttaataggctcccccaaaagatgaaatactggtaattgtgtgttccagccttgatgaaggtccatgagattccctgcatgtggagtactgtgcacagtacctccatagagtactgtgctcagtatctccagcatagtaagcactcactgaacctggctctgctgttgctggtgacctcatgtgtctagtccctgtttgccacgctttgtaaccagtgtataagaatctcatttggaattgacctctttagttcctgccgtcctagcatggaaggatgtgtgaagtgggtgggagtggctaaggatgacagctaagggggaggatggttggtcccagtgatgcgtgggtggcagcagaggcacaggagttattttgcagactgccatctacttcaggatgctttgtccccaggtacactgtgctccggctaatgattcggcaaaggctcgaggagatagcagagacccccgagactatctgagccacaggaatgaagacagtccagacactccaggggccgaggctgacctgagaagacccactggaagctaggcatcctacagaaacgttttcacacgaaccttgcagccttccaaaagccagcactgctccctacagtaggacacagaagcagcagacagctccccacctttggacccctgatcttctttgtctcattctcaaggacttttgtcctaaggaggacccacaatgtgtatgcttgcatacctgagtgtgtgtatgtgtatgtgcacgcatacgcaagtgtgcatatgtgtacttaccatgtccacgtgcctctctgatgttcttacatttggttaaattcccagcagccagcaggtgtcacaaggcaggagggcgcacgtgctgctcctgtgtgggaagaacagggaagtgactgaggcttttggcttcctccagtgccaacggcagccgcacggatctgccacgcttgacagggaagaggaggcagcaggctcaccgtttggaatgtctgaaggtttacagcagagattcttctcatttgccaaggggtggccccatgcccttggggcaagtccaacgaaatggaaaaagcaagatcacctcagggcggatgcaatgaatctatgagtttttgcactggaaaggttatcaatgtagaaagcacaattaatgtccccgtcctggatggaaacctagaaagaatggattctgccttcgttcttggctttgtggaggcttctgggtgtttctgctctccagctgccacttcaattcaccctgacctgctcatgtgcctgggccaggtgtgtgctgggataaacggcactcgaaagtttttaagccaccagctgagatgagaggtacctttaagcctagcccaccatcacatcggtgagagtatctcccacgtggaggtggagcagtgtgtttgaagtcgcatgtctttctttctggtctctgcacacttgcaagctccttcacctgatacacggagatggattccaagaatggagacctgtcctgttgctcagtcaacacagggagtcaggaagctctttggggtgttccatgagggtgggcagagaggacggtgcttgcttagcctttgagaagccatgctcccgattttcagaaccagcctcattggcagaaagggcagggatgatcctgtaacccctccattcgggatgctgtcatgtagctggtcacctgtgtggcttgtaccatttgagtttggacggatggatgggcttgctgctggtctatgaaactcagccaagcaaggggagcagcccataactcaagcatctctgagttttgctacaacagggtgttcttgtctacctgctctcaagaaagctctagaagcacagcagcggagagactgaggggccccgaccagtgcgccttgtaaggaaggtggacctctgcagcagatctgttctagtgtaggaatgttactgtcctttgcccttctcagaggctcacagctgtgatatcattgtgggctttcaaacagatggctcatggccagccattttgctgggtatcacttagcaaccttgctcttcttctaggacagcacaatccatcccatgagcagtgggatggaaacctgtgggtctgagtctttatcttagactcaaaagacagcaaagcacagaactgagcacagatactgagtgtatctttatgagtacacacttcagtaaactctgagctcagtgggcagctggggtgggggttcctttatgacagacaaagaacagctttgtgaatgcaaatacttgagaaaatttggtttggataacttctcttcccgttatctttatcttgaatgttcagagcctatgttggtccacaattctcccttgggagcctgggggctttccatggagcacacgaactgggaagttatttctgatttatgaaagctcattgtgtaagtgtcaatatgtgactgttgctgggcatcgggttgccaggctttccaagatggtggtgccaagatagacagcttttaaagactggggttcagaaagggagttggggtacatgttcactaatccatcttggcacattccctagagatcatgccttatgtccaaagaactgggcaggagttttaggaaattggctgggaatgagactcagtggtggaacattttcttagtgtgtgtgaaaagccgacttcaatctctagaaacacacacacacacacacacacacacatgcacgcatgcacgcacgcacgcagcagtggtgtagctcagtgatagagggattgcttagagtgtcagaggctggttcccgacgcctgcaccaagcaccacactaccccctgcactttggaagcctttgacatagccgcagcagaacagacctctacagtgacgactggattttctcactggtctcacttcacagctttgaactccaagactgattagtgtgggcttatgtaattgggtgcaatggacctgaaatcctgagaaataaaagactaacgcataaggcggcggtgggggtgctaatccagcatgtgaaaagtggttcggctgcctctggactcttcccctcccccacccccacccccacaaaggcttattttacaaggtgatcaagtgccgagaacaccagcctccgcctgagcgaggtggtgaggccaagcacaggttgactttctcggtgaccatgttagcggggagctgatgcctcacagtgggtgggggtgttagttggaaaggggcccaaagcacaaacacccgtcatgcctgtgctactggtgaagggcacacagctaacaccatggacaaacgcagctttgtaacgtggaaagtttggggttagggatacatttccaagaaagaaatatgtccagtgaccaaaggagttttaatgtcccacaggagtcagctttgccctggtgagggaggaggtaggaggctgccctagctcacccccacagcactgcctatcttaaagcatatcacctaggttgttttctggaaagcctggcttccgccggatgagagagcatctatgaacctgatgtgacatcccttccttcagacataattgacagtggttgccattccttggggtacaccttcctcccttcctcctgctcccattaaactgagcacagaggtgcttgaactgtgaactttggagaagcctcagtctccaggttgctggattctggggttgctgggttctggggttactactagtgtttcttcgggttttttcttagttgagtggagtctttttttttttttttcttcatcataacttgcctgttaggaatggtacatgacttggctcaactgttggttatgaactgaaaatcggatgtgcttaggaatcttaacatgattggatgggaccttgatggggagccatggttttgtagccttttattttttaattattattttttttgtaatgtacccatcttagaccttatttaaataaagcacttttggaagcaagcccctgtggatctgctttgagcctttggaggggagctctgcttctgccatcagttggaaggtgaaggctgagaaacctcaagcctgtttccttcccccagggtttagggtttgaatgtgcccagagttagctgtaatgttttttttagtctatttagtgttacataacaaagtagcagagaacaggaaatgtacaaagagttgaaggcttatatctagctcaagcactggagactgtaaagtctaccagcatggagttagtgactggtggggcctttggggagccccatagtaaaaagcacagtggagagagcttggttttacatatttgttctgtctccttggcggcagggatgaacttggccctgtgcatgccaagtgcacacactgcccctgagcttgagagcttgtgttgacaattaagctgctcctacagtatcccatgatcccacgagcgggttattatactcaccacggcagacttctaatggcccagttccctccaggcccttctgccactggggaccaaggttctaacatgtgaatttgggggacacattcaaaccactaactgtttctgatggtagaaggagctgggacctggcagagtggcactagatgtcacctgaggtccactctggttcattcagatgctggatgaatccattctgttaagtccatgaatttatttctatgcttaattttctcaactgtaaactaggatgtgggaacctggccctacttcattggtggcactcacttagtggtctcccagagcttggctttcaatctaacatctgaattccactctgctgaaggtgtgagtgcagggtggctggcggcaactgtcaacttggttaggctgtggtccaagacgtttggaaaaatgctagatgttgttttgaggtgtttgtttgtttgttttagatgaaattaatacttaaatcagtagactttgagtagattgcccttcacagtgagggtgggcctcatcagtgtgtgtgtgtgtgtgcatgtgtgcgtgtgtaaatattagtcagacctctctatctacagattccacatcactggattcaaccaactgtgggaaatttgatcccacaaatttcccaaaggcaatcttgaatttgccacatgctctacagaggctgcacgaatgtagtggctgtagatgtggcctgtcaccaccctgcttcccagtttctctgtctgctccagcactcatttcaacattgtttgacttgtgtcttactcacctaatatcttgtgaattctctctctctctctctctctctctctctctctctctctctctctctcacacacacacacacacaatttggagatccctgactaacgcaaaggaggagaatggttggtttataaagcttgaacatgcaatcaacagttgtcttcctggaaacctggccacaaaggataaataattaccataatttatttcctagaacaagaaaacaaccaagacaagatttttaatgatgtttccccaaaatgcagcagacttttatactgtatgtcacaggggtgtgtgacatagacaagagacaaatggtttctttggggtccaggcaggcagtaggtctcagaaagtcagaatgtgtagattatccaacaaatattagcaagctgaaagggaactggcagctcatgctgtactttgtgggaatgggtttgatttagtgctgtctgtttttcctgctacagttctcactaggtggagtacaagactctatctgcaagtctgtgatgctcctgagcgagtcactgcggtgatccatgaggataagcaaacgctactcaaaaaatgaacttgagtaaaatcgccgctgctatttccctgtaaagtgatccaaaaccaaaacatgtaaccctgccccaaactgtcatcacttatgattcaataccacatgtaagttacatgtatatacactcactctccatcagctacacattactaatacatactttataaatgtgtaagtcaactctataagttttaaaactgaaagcacactggtaggaactttacagggaattagcagtcatgactagtatcccagtcatgggtgagtgaacatgacttctatcaattatatctcaataaaactgattttatatccagcatgaaatggttgccacagtaagatgaattaacacacccatcctgtgcagttagcatgccgactgtctcggggctgggttgaaggcctcttcagctctaccttcctaaaaaatttcaagtaaacaatacaatactgacagccacacccaccacactgagttctagaattgatgcatttgttaacatatcaattaactttatgtgtatgggcattttatctgcatttatatatgtacatcatgtgcatacctggtaccttcagaggccagtaaagggtactggatctgttggaagcagagttacagatttctgtgagctgcggtgttagggtcttgagagtccaactcagaccctttggaagagcagccaatgctcttaaccacggagccatcactctcccattttggttgatcctctaaatgatagttcttttggaagtgacactaataggtgtgcacaacaaaagcaaatacctggaattatgtgtgactacatgggctgaaaagcttcttctccacagcgaaagaaaaggatctcccacgggatgagtggagacttggcaaacacgtatcacataagaggttagtgtcattctgcaactcatgactctgaatgtcccctgccagtcaccaagcccctcttgagttgtcatggtctccctacccatacctacataacaccctggggttagcagcaccaaggcagagcaccccagggctctaggaggataactgatgccaaaattggggcagaatgagcaggaccgcgtgggtgtgcccaactaatggaagataattatgtcttggagatgtctggggtataattttgggaagaaacttttgagaactcccacacataccaaataaatgtttggtacattctttaatccaaaatgatcctaggtaaagatcctaaagataaggactatatatgaaaaatataattttggtttttggttaaagttcttaaaccaaattttggcaataacacaagttgccacaaaaatgaagtagtttggtccaaagctcttgaacaaagaagactagaaacgccaacaacatctctgacccattgaaaagaagagcagaaaggaaaggctgaacttaaaatgctcatgaataggctagcgatgactcagagtcaacattagatgattcttcaaagttgttaaaacaatgagagtgtataaaatattatatttctaagtataaacgttaataaaagattagaaaattaaattgaaaaaatgggaatctatactttatccatacattatctatactttatccatagattagaaatgttgcaggcttcctacatctatctgtagactcaggtaatctcaatacaccaagtaggtttttcatgacttttatgataatggttcatctaacattaaactataaagctattcaaccatattttaaaaattgatgttagaatattgtgctggtgaactttaactgtcaacctaatacatcttaagagttatctgagaggacagcatcaactgaggaattgcctggatcagatgatctgtagttgtgtctgttcaggatttctctgattgttaattgatgtaggagggcccagcccactgtgggcggtaccatccctaggcaagtggtcctgagctgtataaaaaggtacctgaatagaaggcggtttccgagccagctaataagcagctttctccttctttcctgctgcatcctttggtcagaaatgatgctctataggatggcaagcaggtctgccttcaagatccaacactgggctcctgtcttgacaatgaagggctgtggcccggaattgtatggtgaagtaacccttttctcccctaagttgcttttcacttgggtctctgtcacaggaacagaaatgaaaccaggacacttattatataaagtgatgagatcatgcttgctatcaatgtaggcagatatgtaaaagcccatgaaaacaattacctaatgctggggttatgttttatgctttgattacacaggctttaacataaaaatttctgtttactaagtccaaaggtgcagatctctttcttcccctcgccccccaatctattaaaaatcaaaagagaactaggcacacaggtaatgccactgactaagccctcttgtgggcaattctcactaatatggaccttgcacataggccatgcccccatcctgcatgagcacctgagtcatgagttcaagaactgggagagagctgagagatagaggctgtggtatcacttctggtctggctcacatagttatcagatagaatcaatagctgactcggatgccttctgatgcttactctggatgggcgcactaaaccaacagcaaatagccagagggtcacccagctgatcttagaatttgccaccctcaaaacctcaaggactctggggggaaaataaaactccacacagatcctcatgtctgttttttgagctttagtgagtaacaaaacaacagaaacttggcccctaccctgctgggctgtggtggctcctcattgcagagggtggtggagatttctctcagacttctgtctagatgctgatgtttaggtcagcacagtcccgtgcttctctccatgaacctgaggcacacattgccatcagattcagggctttttgaatgtaactcctaaagctggctttcatttttttttctttgattaaaattaatgtgtgagtgtgagagtgtgtgtgtgtgtgtgcgtgtgtatgcctgtgtgtgttctgtatgtatgtagagtataagtgtggtgtccgtgtatatggcataggctcatgtgtgtgtgcaggtgtatgcctatgcccatgtcaaaggaggatggtcagggtctttgcagcaggcttcctaatacagttcctgtcaagctttgtccttgcctgtgtacctttctgtatgcactaaacttgagaaccacatcaccacacaatcctctcagacaaatccagattcagacagtcctaagcaaagacacacaattcatgcagaacaccgagacattgtgtaccgaagaacactgagctgcctgaatgctattatcccaccctacatgacccaaaagaaccctaagagactctaaatgacccctagtggccaaagttcttttaaggaaaacgttcaaaagcccacaacaattgaaaaatatcctaaatagccttagagaagtaaaatacagtgtgaagctctacctggcacagcctgtggttcctgactactgctgaggtgggaggtttgcttgagtccatgactttgaggctatcctgggcaacacagaagactctatctctctaatgagtagtttgggttagagatgtagttcaatgtagagtgcttgcatgaggctctgagttcagcacctcaatactctaaaacagaacagaatccagctagtcacttgggaggcagaggcaggcgaatttctgagtttgaggccagcctggtctacagagtgagttcgaggacagccagggctacacagagaaactctgtctcgaaaaaacaaaacaaaacaaaacaaaaacaaaaacaaaagaaaaaaaaagacaatataggtcctggagagctcctaactgtaaaacttaaacatttaaaaccttaagtccttaacactgatagcccgaaataatctcagatgaattccagaatcctctgctgtagcaaccttctaaatgacaccaaacatcccaaaaagtcttagtggcacccaaaccttaaacaaaccaattctaaatattaagaacctagtgacattcagtatcctaaatggtctcaaaagaaagtaagagagaaagagagagagagagagagagagagagagagagagagagaggaaagaaggaaggaaggaaggaaggaaggaaggaaaggaaggaaggaaggaaaccaagtttcctagtcaattctatctaaatcgttaaacaccagcttctctcatgtccctattccttctcacctcctagacggccgttgtggtgtcatctctctgggcttgctgtccctcaaatactcccaacaccccctgcttccaggattcaaacttgtcactccttctttctgggacaatctttcccagctcatcacaagctctcctttctgatggggctcaacccttgctcgtgatgtttctagattgagcacagccatcagttccagctatctttgtgaatgacagaaaatgcactttctgctaaacacctagactcatgagggtgtcctaaataccttgagcagtacctggccttggataggaactgtgatatttgcataaggaatgaatgaatatccagatgtatatttgttgcagtaaatctccaacccaaaccagcccag

SEQ ID NO: 464 - DNA, 816 bp, Mus musculus
gaggaagacgagttcattgtggaggggttactgaacatctcctgggggctgcgcaggcccattcggctgcagatgcaggatgaccacgaacgcatccgtcctcctccatcctcctcctcctggcactccggctgtaacctgggcgcacagggcaccacactgaagcccctcaccatgcccactgttcagatctcagaagtggatatgccagttgaaggcctcgagacacacagcccaacagattccagaggcctgaagcctgtgcaggaggacaccccacagttgatgcgcacacgcagcgatgttggggtgcgtcgccgtggcaacgtgaggacatccagtgaccagcgacggatcagacgccatcgcttctccatcaatggccatttctataaccacaagacatcagtgttcacaccagcctatggctctgtcaccaacgtccgcatcaacagcaccatgaccactccgcagattgagaactcggcagaggagtttgcgctgtacgtggtccacaccagcggtgaaaagcagaggctgaagagctccgactaccctctgatcgcccgcatcctccagggcccttgtgaacagatctccaaagttttcctgatggagaaggaccaggtggaggaggtcacctatgacgtggcccagtatataaagttcgagatgccagtccttaaaagcttcattcagaaactccaggaggaggaagaccgggaggtggagaagctgatgcgcaagtacactgtgctccggctaatgattcggcaaaggctcgaggagatagcagagacccccgagactatctga

SEQ ID NO: 465 - protein, 271 aa, Mus musculus
EEDEFIVEGLLNISWGLRRPIRLQMQDDHERIRPPPSSSSWHSGCNLGAQGTTLKPLTMPTVQISEVDMPVEGLETHSPTDSRGLKPVQEDTPQLMRTRSDVGVRRRGNVRTSSDQRRIRRHRFSINGHFYNHKTSVFTPAYGSVTNVRINSTMTTPQIENSAEEFALYVVHTSGEKQRLKSSDYPLIARILQGPCEQISKVFLMEKDQVEEVTYDVAQYIKFEMPVLKSFIQKLQEEEDREVEKLMRKYTVLRLMIRQRLEEIAETPETI

SEQ ID NO: 466 - DNA, 63686 bp, Homo sapiens
actgttccgtagggacactgtgagtgtttgtatgagaaaaatcgtctttgtccaagacagtcaagcattttacagtttgctcattatctttggtccccacacaccaaatgacatcaacactctcaagctccaagaccaccaaagaagcagatgctacctctggccaacagcctctctctagagggttcttgtataacttcacacttatttgtatccctaatagctgggctacagactttaaacgtatcttttcttggccttcaactacaaaaaaatgagaaaatcaagatacttaacgcattcttaccttcattgggttttacagtttctgctttataatggtttatagcatttgttttgtttcgcaaccataattccaatagttgttttaattgtaatcccgaaacataaatgtattcagtgctcattattggtgtttttgcttctgtttctcatttgtttactaaacttggtctttctgtattttcttcaaggtagctgaatttttgtagttttgaaaatatatgcatgttctttatttggactacagtttgggttgatatgaagttcctgaatcatgttttctttctctgaggacaccatagtagcatatgtggcacaagattgtttcattgtattctagctttgaatcttgctgtgctgatgtttgtagtcaatctgatttttttagctttaagttcacgggtagatgtgtaggtttgttatatgggtaaattgtgtgtcacaggggtttggtatacagattatttcattacccagataataagcattgtatctgataggaagtttttacgatcctcacctccctcccaccctccaccctcaggtaggccccagtactcaatgtttagctcccacttaagtgagaacatgcagtatatgattttctgttactatgttagttcacttaggataatggcctacagctccatccatgttgctgcaaaggacatgatcttgttcttttttatggctgcatagtattccatggtgtacatgtccatcacagcattattttctaaaacttctacattttttttgtagattcagggtctcactgtgttgctcaggctggtttcgaactcctgggctcaagtgatcctccagtcttggcctcccagagttctgagattacaggtgtgagctaccacacttggcccttgtaggactattcacaatagcaaagacatgctgttattttttaatggatgatctgatctttctactgaataaccagaaactctttatctttgaagcatggcactattaataggatatgttggtattggttaatctgttcctttagcaattcatttactgaatgttcattgggggcattattttaagcactgggaacacagcaataaacaaaaaaggacaaaaacccccatcctcatatctcaaggaacatacatttggctgtaaacatacattgggcatagtttagaaaaaactatatccattttcccagaacatagtatggtctttcaatctataaattcacattttcagtttaggaaagttttttttagtgtatatatttgaatgccaattatacatatgttgactttcttctgcatttgttctatatctattatttcttctcgtcttaaaattcactgttattctccatgttactgcattcatttttctgaaatgtaccttccaggcttctagctgaattttcatagcgttttgctcctccattcggtcttttgtttctgtgatagttttattcttctctttcacttcttttcctgagtcctggtagcttatatttctcttctttcccttgtcttgtaattcttttctggtgcacttgtaatttctcttttttttcttttcgttgtcttctttctttctttcttttgtgcttgcttgattttttttttctttttttttttttttggacaggctgtcactctgttgcccaggctggagtgcagtggcatcatctggctcactgcagccttgaccacctgggctcaagtgatcctcccacctcagcctcccaagtagtacaggcacgtgccaccatgcccagataattttttaattttttttgcagagatgggtttttgccatgttgcccaggctggtctcaaacttctggactcaaatgatctgcgtgctttggcctcccaaggtgctgggatgacaggtgcgagccactgcacctggcctgtaacttttcttggagtaattgtttatagataattttttttcattaagtttctgaattcatgagaaaattcttggtcccaattatcatctatccaggacaaagtcttccttaaatgttagcaagaagtctctttctggctcattggaaagctctgaacaacagagttgtgtgtgtgcatgtgtgtgtgcatggtgggtgtggtggtagattggcctttcctatgccaaacacagactgtgtagtttcaccatggtaatatatatatatatatacacacacacacacatatatatacatatatatacatatatataatcaatatctataattttgaacgtgtattcaatttgtattgatagggtaacatttttcccaccaagtaattggtatttccttccaaaaatggaaggggagctttggtggaatgtaaccctggggttaaaaaaaccggaatggattcctaggaaaattttatgacatatcccacgtaatctgaaacatggttcagttaccaaattgtttataagcactttgtttagcaggaaggtggccaagagagagtttagccttgaggctgtctatcaaatactttttgtgaaaagagacaaaaggtggaaatgagtaagtttaggttatgtactttaggtccttttcttttcttttcttttcttttttttcctcttaccagcacctgtttgtgttttaactgaggagggaaagcctagtaagataggtctcctgtctggggcccaagacatgtggacatgagcctacttagatatcagctgagcgagagcttcaatccactctcccatctgcaaggatggatccagacactgtgtcatataaatattttaaatgctatggaaattgcttagtggtggataaaatgaactctttaattaagatagtcctgccccatgaaagataaacttgtagagttcagtgacaaaatctttgttactcaaatttccctaggtctctcaagtttatgagaacaaatggagtcacattaacagccataaatctaaatgtcaccaactcactcagacttgagccatttgaaaatacctcttctgctgctttggtggtgggggcaagggcgggggcacagggctggcagtggggacaaattcctagaggtacctcgcacaagctcataagcaaatacaggggacttcagacttgtgtctgctcaataccctggtcgcgtcagccttgattgcagtatcctgttaagttctttaacagttcactattgctataaaacaaactatgccaaaccgtagtggcttaaagtgacaaccatctattttgtttatgctttttatcagctggctatttgggctagactcagctgggctccctcatgcattggtggtcagctctggatttgggtatgggacttgacagatcttggttgggctctttcacatgcctggggctttggctgggacagctgggcccacttggctctgggtcatgtggtctctcatcctccagccagctagctcaggtgtgttcagtggtagaggcaatgttccaatagagagagtgggagaatgcaaggcttcttgaggcccaggctctgaaaaggcacaacatgacttctgcctccttctattggccaaagcaagccacactgtcagcccagattcaaggtggagaagtagactccacttccttattggaggaactgcagcatcacattgcaaacagcaagtgtgctgggagccagtagtcgtgaccgttttggcaatcaagctgtctcattctaggtagtgttgtcaacataacaagctcttgaaatagagaagctgaacagtggagggttggccccttaagtattactcagcaggagggttcccaaaacatggttgcttgggtctgagaatacccggaggtttacaaaacagccccttcagttgtaacctagagccccttcttcttcccaggagccccctcctgtgtgtccaggggaccagattgggagcagagttgagtgacaatctcattagccttctgtcaactcaagccgcgttaccacttgttttcttctttctttagaatgcagattctctcccaagagggtcttttttcacccgtcaagcagatgtccagctggcctgccacgctggtgcaccagacgtgtgaagaggtggcggcagcccaggggtagacctcacttaggcttccttatttctctatatctcattggatcttcctctgtaaattcttacctcctggatagcagaggggaaaaatatctgaatattagtctggtaaatgaagtcttatgcaatactaaatggtccctctggtcttcttacgcaaaccctctctcagagttcttccttcctgcccagctctttttaagacgcatctttgggagagattgaaccttactctggtggtggcaagtgaggctcgtgctcaggatcacggggaggcctctgggtcctccctgggccccgctgcagatggcctgctctggaccctcccttgaaagcagaatgctggacgggctggtcccattcctgagtactgggctggcatctactgctgacgcctgcagcgtgtgcagttcaaggtctgggtgctccaggctccttcggatctctgcactctgatcttcactcggccttcgctgatgcaccctctgggtctccattatgtcctcctgccagcccctgatttagccagggtctacctgcccctcttcatcctggggcttagagcagatgatttgtttgttctgtgtcgcatcccctcagcccatttctcatcccagcagggcagtggtggacagctccacgaacaggaactcattccaccttaagggacaatggctcctgtttttcttttttcttctttttttttttctggatttttgttctgtcacccaggctggagtgcagtggcgcgatctcggctcactgccactgcaaccccccacctcccaggttcaagcaattctcctgcctcagcctcccacgtagctgggattacaggtgtgcgccaccatgcccaactaatttttgtatttttagtagagacggtgtttcactatgttggccaggctggtctcgaacgcctgacctcaggtgatccgcctgcctcggcctcccaaagtgctgggattacaggcacgagccaccacgcccggccggctcctgtttttctgcctcagatgtttcttttagaacaaatatgtccacacaaaccaggaagtaagaggaggtaagctcaactagaggagaatgagaggagtcagcagaagaatgccccaaaccccccacctttaatgagatatttctgaggcgtgttctacacagttccttatacggtccccagagaagtcaagccccagttgcccccagcagtaacctgtccaataatgcaccttccccactctccacttcctccctccctcactcctgcgttctgggtcctcagtaaatgatctgcacccaaatccttgtctcaggctctgctcttgagggagctcaaaccaagacaggccctgttaaaaaagcctgtggctcacacaactcagcttccctctgaagctcctggtccttgggagcaggtgggaactttggcattacatctatgccacacggggattgtgggtgaccccaggaagctgaacccaggccctccctctgtgtagctatggtgctgcgctgagctgacttgtgtgaggctgtctaggttggaggagaagcgagtgggcagaccgtgtttttttttttgttcttgtttgtttgtttgtttgtttgtttttgacagttttgctcctgttgcccaggctagagtgcaacagcgccatctctgctcactgcaacctccgcctcgcaggttcaagcaattctcctgcctcagcctcctgagtagctgggattacaggcgcccaccaccacgcccggctaatttttgtaattgtattagaaatggggtttcaccatgttggccaggctggtctcgaactcctgacctcaggtgattctcctgcctcggccttccaaagtgctgggattacagacgtgagccaccgcacctggcctgtaatccttgattctatccccagaactccacttaacccaccaacatacctctgctctaaggtcaaaggtcacaaataggggagacgcagcatccaggactttctgtcttcctcccttttcccagaatccactgggaactgaggagtgggctttgggcctcccagttctctgcatagcctccttttcccaagccacacaggagaactctgatctgcctctccagctgttatacggggagacaaagaaatgtagaagctccttttctttctctggccatgcttgtcattcccactactgttttgctaaggaaaaaaggaacttagctttgagactccaaactcatcagtggcctccttgttctgtaaacctgtgctgtcccaatctggtagcctgtggctattgaacacttgcaacatggcaaatgcccctgaggaactgaatttttttttttttttttttttttgagacggagtctcgctctgtcacccaggctagagtgtagtggcgcgatctcggctaactgccagctccgcttcctgggttcacgccattctcctgcctcagactcccgagtagctgggactacaggtgcccgccaccacgcccggctaattttttgtatttttagtagagacggggtttcaccgtgttagccaggatggtctctatctcctgaccttgtgatccaccaacctcggcctaccaaagtgctgggattacaggcgtgagccaccacgcccggccggaactgaattttaagtttatttattcataattaattaaaatgaaaatgtatatgccgatcctcgattcagttattgggcaacatttaagtatgtttgaaacaacttgggcatgtgaatctactttttcaactagaagttttacaaaatctgaattcagatcaagtagttttgttgaaattttaatgtccaaattgagatgtcctcaagcaaaaaacacgctagatttcagccctagtatgaaactagaatgtgaaatgtctcatggataatttctttatattaattacacgttgaaatgatagtatttgtaacatattgagttaaatagaaatctattactaaaattaatctcacctgtttctttttaccatttttaatgtgggtgctagaaagtttaaaattgcacctgtggcttgagttgtatttcttttgtatttttagtggaggtggggtttcaccacgttggccaggctggcctcaaactcctgacctcaggtggtctgcccgcctcggcctcccaaagtgctgggattacaggcatgagccactgtgcccagccacaagttgtgtttctattggagaattttagacaattctagacaatgctcacctgttgcttcctgggccatgagcctcttggtctggcctctggtggtagaagcctataagaaaacacggtctggccaggtgcagtggctcacgcctgtaatcccaacactttaggaggccgaggtgggtggatcacaaagtcaggagttcggggccagcctggctaacatggtgaaaccctatctctaaaaaaaatacaaaaaattagcagggcatggtggcacatgcctgtaatcccagctactcaggaggctgaggcaggagaatcttgaacctgggaggtggaggttgcggtgagccaagattgcaccattgcaccccagcctgggcaacaaaagcaaaactccatcttaaaaaaaaaaagaaaatatgatttaagggtagactttaattattagtttaatatatgcaaaatattatccctgttcagatgtgttgctatattctgccttgaaggatgaaggatgaagggctattcctttctcacctgtggctttggtatggggaaattgatgaatggaaaaatgttttctggtgacttgcgtgaatgaatgaatgaatgaatcaatcaatttattcaccaagatggagaatctaagtagagagaaatgtgttcagggcttggcaagatggcttgtgcttgtaatcccagcactttggaaggctgagggggaggattgcttgaggccaggagtttaagactagcctggacagcatagtgagaccccatctctacaaaagatacaaaaattagctggccgtagtggcacatggctgtagtcccagctactcgggaggctgaggcaggaggatctcttgagcccaggagattgaggctgcagtgagctatgatcatgccactgcactccagcctgggtgacagagtgagaccccatctcaaaattacaaaacaaaacaaaaacaaaaacaaaagtaatgggtttagttttaaatagggcctaggttcagggtttctggtagcccagtttgtacaacctgagctcaaccctagccccactgtcacaggaggatgagctgctcttttgggagattagattagagaataagggattctagcagcatctggctgctttcctgagcagcagagctccaagccccggagatagaagtcatggccacctttcaccaagtgtctggggtgcagggagggccagtctgtgatgaaggagaagaaagaacccctcagggaagactttctgggttacgggaagccctttaggctctggatttgcctcttatactgagctctccatgcagttctgacactgagattagatgagattatcgagaaaccactgcgtctgcaaatgcattcccccaaggttatttctattacctgcaaaggaaagaagcttaacacatagagtagtgggtccatatggggaaacttaatgggagaactttaacttatttaatttatagtgtttatagcccaagaagaaagaaccagaagatatatacatattttttctacaaataaagctgatcagtggcctcctttttcagggtagctgacacagttctcagcaccaccctacagctgcattttgggttcaacagacttttgtggctggcctgggaagcagatcaccatttataacattgtttctaagggagacacattccaagatccaaacaatgaatttagtaaagaatgcttggcttccaggctggatgagctggtctggctgtaccttgggggttggcctgaggctcccttcccctttggtccgcagacactgcagggttggggataggcacgtgagggggagaactctgagtagatagggaacctgcagccgggctgctcaagggcctctgtgtactgggggcgccaggaggtccagggatggaaaagggggaggtgagaaatggacaaagaaacttggcctccttggcattgctgtcacgtctggccggcccgccaagtcgaaggggcctgtttagcccctgtccggctcaaacccttttgggaataagctgggatgttagaaaaaacaaaatcccacaacctctgcctggggaatccaggccgctggaggtgggcttggtagggcagcgtgactgttccctgggagtggctgtcacagctccgggtgaaccgaggagcttgggccaagtctccatccctcttggagagggcagcagcaaggaggtgaggggagccagcttcatcctccccaaccctgcactccccccccacctccccacccccagcccggaagaatcgctggcggcgggagcctggacgagctggcggggaaggggacgcagccacagcattgtctgggagggaggggagaagctccgcccctagaggggaggggagaagaggagggggcaggagacaaggggaggaagaaaggcgaaggcaaggcgaaggggtggagagtgatatgaagagcgagagaaaagagaggacagcggacgagcagatccggtaggggctgaaaaaggccaaggggctggagggagggagaggaaggaggaggggagcgaggagggcggggcgcccggtccccagtcgcgcggccaccgcctgcccagcctggctggatttgagcccggcccgccgatcgctggccgaggcgcagctgaagcagccccccagccgcggcgcccccactttccaactccacggttcctgcggcgcgggcgcgatgcagctggcccggggtgaaggcaaggcgcggggcgcggggcgcggggcactgggagcgaggcactggcgcgggatgcccggcgcaaggtgcagggcgcgggccgctctctttccgcgtccccccacctcgccaaagtttttccacgatggtccctaccccggctgggtcagccccgtaatcctcgcctgtctcttgtctcctctttcctccccgagccgcggggctcccggggcgcgcggacccccgccaggggccgtgtaggcgcggagccccagccggcctgccttgggtccgaagaaagttgtggcttggagctagtcctccttctacgacccctgggggcgtccttccttctttttgagcccgcgatgagaaggcgctcccaccacatccccggggtctctgagacttcctggcgaggtggggcggcgcggcaggtgcagggctggggagggcctgacagccctggagagtgcccgaccccaatccgccgccgtcttctaggcggattccccagaggcaggtcccagtccctggcgcggggaggcggcgcgcttcagaggggcgcagggtgcgcgggggccgttggccctccgggcacttcccctttgcggtctccccgccctccttcggagctggtgcctgaggtcgctgggacctcagcctggcgtcttctctcgccccgagcgaggcaggtgccgtgggcggccccggctacttctgcatttcgagcgcttactttgcattcagctctaagtcggagagctctggggacagccgagagtgccagtggcctcatagggagactgagggttctgtttcacctcgggcgccgtgtgggtctgggctgtccacagcacctctgcgcctcagtgataggagaagccaagcgcgaggcctctcaacgctgcgtgcactctatttcccaggtatctggaatcccggcgcctagaacgtgtttttcgggagagcaaaggctgtgtctacggcaggctggggatatagtaagtaccttgtaaatgatgaatgaatgtatgaaccaatcagctgacaaacaacaatttgtcctggagggggacccagttcctgccacagttgatcttagtacaatgggaggaaagaattagaaacaatgattcttttaaacagccgggaagacagagccaggggccttctttcaggaacatctggatgaggaatctgcagctaggcttattttactaataaatccacatttacttaccaggcactttttctgcaggtggtctgaaggattaaagaagcctcgcatggcgaagatatatcgggttgtttgaggagagttaattttcaaaaaaaccaaaacacttgtgttcaaatatagtgtcccagggacacagtgtgacatctacctgggtggtggccatttgggatcagagacccttgcgtgggggctttgagggtgggcagtagctgtgttttctcctctggacaggtcagcctgatgcctaggggctgtggcagtccagcaggcctcacaggggtggaagagggcctcaaatgatggctgagcttggagagggcagtagttttggaaagagcgggtgttcttgccctgggagaagatggaggcatagcgtgcagcctgcctgggcacgtggagtgtggactggtacagcttgggttccctgtgctggggaggctggaaggtgagttccgctcctccttcagcagatggaggagcagaggtggaatatcagggagacatatggtaagtgttggggtgcagcctagacatatcccaagtgctccactcccctcatttttattctgttgaaattgggttggaatggtgatggcccctttgaggagcctggctgagaggagaccagggatctgaggtcccttttcgtgccttcctccaggggaaggggactgtgtgccctccatatctggccaactggggctgcgcccacatctgctgtatctgcagccccatcatccccacttccgtgagcgtggcctcactctgtccctagtgctctgcggcccacctctctccatctccacatggcttctgtttggaggttcaggtcttctcgccagtttgtgccatcttaggagcccagttggtgtggcggacaaccctacaccttgttttcaatcctttggatgctctgacccacctgagacatcccagttgctattggttttgctttgacttcttggtctatttcctggtgccccggagccaggcttcgtgtctgcgttccatacgtgagctgcttaggaatggctgagcgagtcagctggagaagtgcccagggtgtgcatctgctgcctcagagggctggacgacgctgcttgccagagaggagacctgtcatcaaagcacaaaagaacatgggcctgattattactttcagtcctctttaggatattttggcaggaagtgtccttactgagtgggaggtgggggcagaaaggcagggtcaggttgccagagagtctcacggagaggctgggagatggactgagtgaccccaagagtagtcccaggactcatctcctcctctcttccagagcgagaaacagggcaggtctcagcagtgtgcttggaatggaacaagatgtttagcctctatcttcaatctgtagtagctgagaactgccacagctgggtttataaagcaaggggtagaaattccctcctgctacctccctaatactcttcacaacatggtccagttgtttactgtaatgacacactgtcctatttaaacacttccctgtctccaagaagaagttttattttttatttatatttattattattattattttttgacatagggtctctctctgtcgcccaggctggagtgcagtggtgcaatcatggctcatgcagcctcaacctcctgggcccaagcgatcctcccacctcagcctcttgaggagctgagaccccaggcatatgccaccacacccagctaaatttttatttttatttttttatagagatgaagtctcgctatgttatccaggctggtctcaaacacctggcctcaagccatcctcctgcctcagcctcccaaagtgctaggattataggtatgagccactgtgcctggcccagaagaatgtataaatgtcctcaaggtggagtgagctcccacaggtctcacggctggtttcatttatttggcctgcttgttggttactgtggaccacatggccgtgtgaggcgggggttggtgaatggggcaggaggcaccagggaaggagggtggcacatcctctgacttgggctatgcagccagtgggtcattttttatcacttctgggatggcagactctaaagtctgtcatcacaggttgatgctgctgtttgcggtgacagcttggggctggggaactgctgctgctcaaggcagctgtggcagaaccagagagggaccctctcatccattcctgtggaacaggcaaaatgacttccaaggccctttcctgttccttcaattggtgaaaattggcagagaaatacctgtgctttctttgaacatgtcgacccaaagtgatttggcaaagtagatttccttcatcagcacggtgctttaaccgtagttggcattcagtgaagtgtgattaactgctcatttttataaatgtcatgaaagagtattggatttggagtttgaattgcatcttaccatttcctagctgtgggatactgaataatgtaatagatgctgtcagtctcctgcccatgttccactggtctcaaccaatgactgatgggagaaggtgtgcaaatactccagcttcctcgcctctcttttgagataagtttggggcatgttctgtgctgtctctaagaattcccttgcaggaccgaatctcaattgctcatagtgttagcttgctcacttcctcatctcaagtacatttcaagtacaaagggagtgtactttgtactttgtacactccctttgtacttgaacttgaattcttgtttcacgatctacttttgggtgaaaccaacctaagacaggctttaacttatagttaaaagtcattaaaagtctcagtttcaggctgggcgcagtggctcatgcctgtaatcccagcactttgggaggccgaggtgggtggatcacctgaggtcaggagttcaagaccagcctgaccaacatggtaaaaccccgtctctactgaaaatacgaaaattatccgggcatggtggcgggcgcctgtaatcccacctactcaggagcctgaggcaggagaatcgcttgaacctggaaggcggaggttgcagtgagctgagatctcgccattgtgctccagccttggcaacaagaacaaaacttcctctcaaaaaaaagaaagaaaaaagaaaagaaaagactcagtttccacaactgtaagatgggaattataataagtatctcacagcaatattgtgagggtcaaatgggctatcatgtgcttagcctggcacatagcaagcatgtagaaaaccatttgctggctagaagcaggctatgatggatttcagagtgtgtattatggtggaacatagagagttacagtgctttggagagaggctgctcttaggttaggtgaggaaactgaggtcacctgcacatggtttgtattcctaggttgtgaccagcgacgtgctggtgaatatttaacacccggctcttggtaggggctttgggggaagccctgctttgtggtgttttccagtttatatgatataaataaatattcccactatggctgacttcactctaccaacctggtatcagtgaacactcagttgggaagagttgtgcgccattggcacttgggagccagtaggatctggccccagcacacatcgggccatgactaagtcagcatgtgaccccagtgattttaatttccaattctgtacatgcggaggggaggataagatttgtattaggcatccaagtcatgggatatgttcaagcgctgccccaaaccggttgaacctcacctgcatgcgagacacttctggggtgcatttagtgattatgattattattgtgtttttttttttgagttggagtctcactctgttgcctaggctggaatgcagtggcacgatcttggctcactacaacctctacctcccaagttcaagcgattctcctgcctcagcctcccaagtagctgggactacaggtgcatgccaccatgcccagctaatttttgtatttttagtagatatggggtttcaccatgttggccaggctggtcttgaactcctgacctcaagtgatccacctgtctcagcctcccaaaatgctgggattacaggcatgagccactgcgtctggctaacgattattgaaatgtttatgctgtgagactctggttctcagtttccccatctccaaggcaagggattaaatgattccatatgtcccttctaacccttgatctctttcagaagagtcattgccttgtccttctgtctatacaagaacaaaacctttaatgacaaaaaacctttcctgcggactacatgtgtgccacccaccatgagacacccagcactggcccctcctagagtccttcctcctgggaattcagtggacattaacccagtataatcctgcctgtcttgtatatcagtgtcacctcaggactccggcatggtgtgtctccagaggaggcctggagaggtggggagggagggactggttttttttggaacggatggtcccttcctttctgaatcactatgcaaagttatagacacccaagtagagtctgctcatggtttgcattcctaggttgtgaccagtgacgtcctggtaaatgtttaacacctggctgtttttggaaggaggtttggagaaaagtctgtgtggagaaagagaactttctatgacagaattcatcatcttggtgtaattttactcttaatgctctgttgacaaccctcccaaacaagtccctgactcagcagttccacccctaggaattctgcccctagggatgtaattggataaatgcagaaaagtatgtgtatggggatgtccctcgcagcattatttataataatgataacactccatagtgacaaatggagaccaacagtcatacattagttaaccatggcatgtctatactttggaataccaagtggctacaaaaacataggctgcaggtgtgtagctattaacgtggaagaatatgatatatatgtatttttgagatgtagtttcactcttgttgcccaggctggagtgcaatgccatgatctcaactcactgcaatctccgcctcccgggtgcaagcaattctcctgcctcagcctcccgagtagctgggattacaggcatgcaccaccacgccaggctaattttttgtatttttagtagagacagggtttcactatgttggccaggctgcttttgaactcctgacctcaggtgatccacccgcctcggcctcccaaagtgctgggattacaggtgtgagccaccagaatatgatatatttttaagaagcagcttaccaaactatgtgctatttttacaaactgtatcacccacctatattagcatctggaaggatgtatggtaaaatgtcaatagtgattatctctgggtggtggaggtttgcgagatttcgatcttcatcttttttcatatgtaataatttatttttatgttttattgtggcaaagtacgcataccataaaatttacccttttaaccgtttctaagtgtacaaattagtggcattaactccattcacaacgttgtacaacccatcaccattatccatgtccagaactttttcgtcgttccaaacagaagctctgtacccattaaacaataaccccctcactcctttctccttccagctcctggtagcttctagtctacttaccgtctttatgaatttgcctgttctagctacctcatatcaatggaatcaaacaatatttgtccttttgtggatactaatcttttcatttatctatatatatttttcgtttttgtttttgagacagggtctcactctgttgccctggctagagtacagaggtgtggtcatggctgactgcagcttccgtctcctgggctcaagtcatcctcccacctcacctcagcctcccaagtagctgggactacaggtgcacgccaccacactcagctaattttttattttttatagagacaaggttttgccatgttgcccaagctggtcttgaactcctgcatgcaagccatcctcccgtctcggcctcccaaattgctgggattacaggtgtgaaccatggaacctgacctatatttaaaaaataaaacaaaaaatgtttattttacttctgcaattgaaaggaaagccccgggagacagctgtggtatttggcccctggaggttccatctcaggctgggtcatgtggtcctgactatccttcctggcctgggcagtatcagggtgctgcctccatctcagcctcacaggacaaaagtggccagggtgcagacgtgcagcaccactggcttgggagctgaccacagcatggcttgctggctgctggcagctggcccttggggcccagacccactgctgcttaatctcagggttttctgtgtggtgatgagtttggaaatgtgggctcacgattcgccatgactttgagggagcaggtgccgtgcagagagagagattcaaaccaggtagaagtggagttgtgtggacactagcttccctgaagctcgagaaggagggtctctgcctttctatttcaagcatcctttgtgtgtgcccaacgcttgccctgctaaatacccatcccagtggctgtagggctggttgttgaatgttttgtccatagtgtggcatggggtgcaggggggactttaactggtggagtccacgaggcctcaggtactctggggagatgggtggtggtagcctcagataatcagtgccccttcctaaagtgccgtgtagggtcttacagctcatcacacagacatttagggcaaggatggctcttttgtgtacagtcggggccatggtgccacgtagttggggggctgctgaggcagagtttgcccgcaggtcagctcaggaagctgcgggacccagaacagggaaaccaggtcacgtgactctattcaggtgtcacgggagtgggtcaggtggcttttctctgggacatttgctctgaggcaaatgctgtgagttccttgttaggtgagttccccgaagcgcccaccgctcctccagtgagttggtaagagcgtgagtctgggagggcgctcagggtctcttcacctggccctgcccagtgggtggctaccttattaatcttaggtagtcgtccgggtgtacagaggtttgatagagccgcctctgcgggccacgtggaggagcagttctgcttttcatggggctgactttcctttagggttggtcagctgtgcccagggcagacagaggaggttgtgaatgtgctactgtggcaaacttcccctggaaacggtctggaaaccccccgatgtgccatttctcctggcactaggaggggtctgagatctgcagtgagcggggaatttccctgcacacgttgttggatgcgttaactcaaggttaaaggagggtggagggtggatgtcagatatgccgcaatgactgccgccccgaccaccctggagggctctggacacacccggcacttcctttgctcttcccactcactgcttttcaagtccaaggaacctgccggggtctgggggtggaggaggccagcgatcctagcttttgggttttcagtcctgtccccaggtggtgagtagaggaaacctcaagatctctgcacacagagctcagagtctcagcctatagcaccaaaaaaggaagaatgctggggttcccttgaggaaggggatgtgaagtcagagatgagtctgagtggcctgtgacttggaaaccactcagtaaacaggaagtgttgataccaaagaaatctgagcttgtaggaaacaggggacccggaggcagcccctccttacctgcctggatctgtctgtctctgtctctgcagagctgggagacgaaccctcagatgggccatcgggagcacttggggacacaggcctcaggccctccctgcagggtggcctcccttaaatcctgtagttattggacaggaggaaagcttaccttgctcttccccaggtaggacattaaaactaccctataaactggctcagctttgagaaatgcaggtcagggagtgtcttgtcttatttgctttattggggccagtgttgtctccaccaactttccactctccccttgggtcctacagtcacatggaatgtctcacttggttgaactggagcccacgagggactatgtcttggctggttagcattctaggtctttagtttctctgagccagagtctaattctacacataccaagcacacacaccatacatgtggatacacacacatacacagccatacacaccacccccaaccataccctccacacacacacacacacgccacacactggactctcactcacacaccgggagctatgctcacacccacgcacacacagctgcttttttctggagtctgtgcttcctttatgcttcctttttcgtcccgctccagcgccctgcctctctgattagtggctaagcgctctgaatttccttctgcaacatccatcctaaaggtcagacacttgtggatgccggtggggcttccctgtaaacatgtggctgctcctccggtctgcgaggccattgtctgggtgggcccagcggtggccttctgggtcactcacctggccaccctcccactggggtggagctggaggcaggcctttccggcaggagtcccaggaccgcttcctcccatcttccacagtcgcgtctgggaacccaggcctgtgcagacagcttgggcagggagggctgggccgggctgggccacagttggtggcagaagagtggcggcttcgtaggctgacatgcttgaagaaaccccagcatggcccttgctgtgtttcagttcctcctgtgtcggtgggccaggcaggggcagctccggggatgggagtgcggtagcttgccaggaaggggctgtgcctgtcagttaccaagcatcggggtttttctgggaatggggtggggatggtctgcggggcctgtgaatgggaggggtagttcattgtcccctcagtgtcccacccagtgtgtgataagggactgagagtcagtggctctgtgactgcaagtgcccatgtcctggacctgcggctctgggcctctctccctggcccctgcagggtctgcttttcccacagcttgtcctctgggctggtcactcactcgcctcccatcccccagacctcccagcctgctgtgggctggtagctggagccagcctgcacctgctactcgcatagtgaccctctcagatccagcgctcagccagagagccacaggagcactgggctgcatgtcggctgtgccacctgggacaagccacctaacctctgagaccttctgtttcctcatttgtaaagtgaagtcttccccctgaggttcttggagggactaagataaagcatctagagcctgctaccaccagcagcatcagcagcagccctgggcgcttattagaactgcaccttctcagaccccaccccagaattactgaatcagaaactggggcaaagggacctgcaatctgtattttaacgagccctcggagagattccaatacacactcaagtgggagaacctctcctccagaatacagttgggttggctgatttttggctgaaagcactttcttccttatcacctcaagagaagctgtagtctacaggggttccgcttggcacctgcaccgccctggatttgagcctcagctccgccccttctagctgtgtgtctttgggcaagtggcatagcttctttgtgcctcaactgttcaactgcaaaatgaggataataaagtttctttcgtaatgaggttggtgtaggggttaaaggagtccaggcagtgatggggcttctgttccataaagcaggaaggcagaaggcagagtatgccatttccttccgaggcagcccacattttgcccatgcccaggacaggcttgggtttgggaagcatgatctggcatctcttgccatctctaggtcttggcagggccccagcccgcagctcaagtctccttcctcgtgtggtgcaatggggctggggtttcctgtttgccatccacaccgcttcctgccccactacaaggggtccgaagcgcagagggatcactatctcctctgccattgcttggttacaaagcagattccctcaggagacctggccagttggtctttaacactgtagtggaaagaactgtgtccagcaactttcttctccaacccaggagatccaggttgtcctcagagggaggggcagggctcagagaagaggtgtgcacaggccccaaaagaggaagctacaggcctccagtgagcgtttcctttgcatcagacttggggcctggggctggggttctggcttctgtgacatggtgccctggcttgcaagaaggagccctttgcgtcagctcagtgcctgcacacatagaccctgcgggacactctacactgtcccctttctccttggaaatattagtagtagggagagggtgctaaatacccaactcagtttgcttttagaaaattccaccccttcctttcttgaagggctgctttgaaatacttatggtggtgtcctcaatctacacagctctttccctaccaggttccacagtggcgctcagccctggatgtacactggcatgacctggggaggctttgaaagtgcttctgcctgggcccctcccctagagtctgatgtaattgatctgggctgcaatctggatgtcaggatttgatttgatttgattttctaaagaaggggattcactccatctcccagactggagtgcagtggtaccatcatagtgcactgcaacctcgaacttctgtgctcaagcgatcctcctatctcagcctcctgagtagctaagactacaggggtgcacctcctgagtagctaagactacaggggtgcacctcctgagtagctaagactacaggcattaactgtgcctggctaattttttatttttttattttttgtagagatggggtctcacaatgttgcccaggttgatcttgaactcctggccccaagctgtccttgtgctgtgctgcaattacaggcatgagccaccatgcctcgctgacatcaggatgtttaaagcaacccctctctctacccactccctgctgctgctctgggagtctcatgagcacctggagtcagaatcgctgtgacgtcgggtgtctctaagccacctcttcccactgccccccatccttggtttcagtccaggctttggcaagtgctcagccctcccactggtcaggtggtggctctgtggggtctgccaccctgggaattctccatggaaagccctctcctccccaagcctgtctcagagactggggctgcctggatcctatagaacaactgttgctctcccttcctcacccccactgggagctgaggtgggggtggttggggcctggcccctgctctacaactaggaagacaattcaggaaacaaaaaacaaaagtgaccaccaaagggagctcttcccctctcttaccctggactttcctgccagggctgcccctcccttggaggacttcccaattcataaatgagacgagaggtgctgggtctccaggctggaactgaaaccacgtagggtgagccagggtcctggggatgctctgagaccaaggaaaggtggcacgttctccaggctccctgaccatggagcgtttggaggaagcaagacctaagagcagaggggattctgctgtctttggtgggagctccagacgcctttccctcctcctagagcgtcttgagaacttggtgtgtgctctcctctcaggaagctgaggctgtgatttttgggcttggccagccctgcatttgttcttggagaggcctcctgtgggaggctggaaacacctgcaagtggcatctgtgggaaggaagggaaaggatccttcatgcaactgctgcagggcttcagctggtccagagcttgggtgacgctgaccccgttccggcagcctaggctccagcgccaggctggtcctgagtgggcagctgtttcctcccaacttgagagtgggtgggggacagtgacagacccagtagttgcttcaatctcagatatggagcaggtgtaatggatgctgctgtaccacccaggtccccttaatctattgcatgctgtgagtgttgacagtgctgggtcttagcggcacacgtttcctgagaattgctcttgcagggaaatgcctacgggctgtccctctgccaatgattgacatgcagcggtccagaagcgccacctgcccacctccacgtaggacaactctgggggcccttcacaccacagagctccccaggggatcagctgtggctgggctccagctgaacccacctcattcctagctcctcccactgcccccgtcctgcctcccccactcccttacaggtttctcctgaaaacacctgcacaataaatcacatgctttctttcaggctctgcttctaggaatcccctggcctaaggtagcaggttagtgtccctggacagactgctgatcccatccccttcctggaagcagtaatcatgataacccgggtgcaggagaggcacaggctgggagctgggggctgggggccagagaggaagctccaggcccaggaggggagagaaacaccagcaggtgacttctgtgtggggtacgtgctgtgctgaagggcaggccgaagtgggagtgcctgtccctgcattgtccaggggtcatttatagggggaggtaagttttgatgagggtcgaggctagaacatgtgaatctgggtctgagggggagcatgggcacactcacagagcataaaaagtaggctccgaaagttctctgtggctgggatgtcatcatattaaacggccagaggaccttccctttgaaaagacgtcctcctgggtcttagggaaggtcttacccccaagctgtctttcaggcagtcaggaagtcatgaatgggtctccaagtaaccagctgaattccactgacaagcagaatgcattgcccaggcatttaatggagctgaggagaatttggaacattctgccaaagcatgaagccagtgtcagagggaaaacttgactggttggtggccccaacagggttccagcatgacaggaacctgggagactcatgtctcaactaggcaagcccagctgtattcacatctccagctattttggcagacatgctttgtggttagtagacattcaatatatgctttattttctaaagtgttttttctaaaaagaagtactgatttagaattctagagggagtaagtaactatgttcatagaggaagttcagtagatttaaatatgttttagacttccaaagagcagctccatattaaaaatgatttttgagagatagctcacacctgtaatcacagcattgtggaagccaaaacaggaggattgcttgaggccaggagtttgaaaccagcctgggcaacatagtgagactccatctttacaaaaaataaaaaattagccaggtatggtggcgtgtacctgtggtcccagctactcagaaggctgaggtgagagaatcacttgagcccaagaggtcaaggctgcagtgacctgtgatcgtgccactccattccagcctgggtgacagaatgagaccctgtctcaaaaaaaaaaaaaaaaaaaaagatttgtgtaaaatttgccctttctttcttgtcccctttctgcccctcttctcctttctctgtgtggtagactatgaggtgttttagttctgtgcctagatgctggctgatgtgggaagcccctctttcctccttgcctcagtttccctcctacaagacataacaaccattagtctgtattcccaaggccccgtgggaagtcatgatcgtaaatggttcttaaaggcattttggagcccaggagagcaccataaattctggataataacaggggaggcagaagcattgcaaccagccagctgaacgaatgaatccctgtctccaaggccacagataatggcaggcacccctggaggaagtgtccagttgaatccaattgaatccacattcctgttccacaaaccgtcttcctctgacattccttgtgtgaggaacaatgctctgtttaaggaatatcagagttaactgtgaatttccggccctctgttagtgctgctgctgtttgccttaaggtggatgtgaatgtagcttagtatctttagctggctgcagggagacagtgctttgtgaaggtggttggaaagtttgtgaagaaaggtgcagatgcccagagtggggcaaaagagggattgggtcctagaatcacctacctgtaatttcagttcaactttgggttaggctatgcaaatattttcttaacacttttttcccaagaaatgtcaaagtaagaaaaaaggtggggagaagtcaggccatagacaaagatggggcaacatgaccccataggtcggagttatagctatggccttggtgagatcacccaacaggtagagagtggctgagccctagaaaattcccacagtcggggccatcagactatctgatgtgtatcaatctggtaagtaaaaagtagggtcatgagggaagttgaacaccttttcatggatttattaattacttgcattgagttttccatgaactactgtgcgtgtcctttgcccactttatgaatgagcatagaacctttttcttactgatttattaaagccctttatgtattaaggacattagccctttaccatatgttttgtaaatatttttccccagttttcaatttgcctttttgactttgtatagtttccttttttttttttttctgaacagaagtttaaaattttcacaggttggtatcaatttcttcagcattttatttttcaatgtttaaatttttggttcagttatttcttttggtggaaggagtaagctagcgatttcacttccctgtcttcccccttccaaacgccagcgaattctctagtgatattttaaaaaattaagctacctttcccctgctatttagaactgctgcttacattccatgttcccagatatatttgggtctatttctatatgtttattgtttcattgctctggctgtttttttctgtagaaccaaatagttttaagaatcaaattctctaactggtattctcagtagatttaagaagacatggtattaaaaagaattgtcttaagagcaggacagatgcagaactaaattaccaaatgataggttatgttggaggcaaagaacgaaagagagagtcctggagaaaattcaattggtgagttagaagattagctggagaattctgagaaaaataaggaaatggagggtagctgccggggtggatggatgcatagtgctagagagagaagagattgcagaagaaccaagaatggaccggctgcagtggctcactgtaatcccagcactttgggaggctgaggtgagagaatcacttgaggccaggagtaaaagaccagcttggttaacataacaagaccctgtctctataaaagaaaaattaagaaaaaaattagctaggtgtggcagcccatgcctttaatcccttcgggaggctgaggcgggaggatcgcttgaggccaggagtttgaggctgcagtgagctatgatggctccactgtaccccagcctgggtgacagaaccagacaccgtctcaaaaaaaagaaccaagaatgggaggaagaggggaaataatcaaagaaagatagaataacatttccctggctgaggaaagactccagtgttggagagtgagaagggctgccgacagcaggcaccgttcacctgatttccactccaaccaggctgcgcgatcagctctggctgagttcccccatgacctttgtgtggtttaacagaggctgctctgggttccccttccttgggctctgaccaccggctcctggctctgctggccttggcctccttctcaaggccccttgtttcctgggcttccttggtaccatgtctcctgtttttcctctttctccagggactccttcctctgcccatgctgaccaactgggttaatgggaaccctgctctaggccctgcccccttcaccccttctgttctttcccgatgacctcatcctctcccctcacttcacgtgccaggaattgctgtcctgggccccaggcctgctgtacttctggttatctgcactggaagtttccatgggtctgcctgaaactcagtcctggtcctcacttcagcaactgtgaaggtggcacctctgcctacgttgcggtcctcgccagcagcctgtgcatcaccaggactctgcctgtcaccccacgtttcatccggcagcacaccctttccccaaagggtgtgctttccacatcacgactttcctcttcttcttcgaactctctagagtctgtctctccaactcgggctccggcctctcaactggtccccgggatgctcttctcccggattatttctccacaaagcaaggcattgggtgggtgacctttccaaaatgtacatcagatcacatccctgccctcggaattccccttgttttcctcttgctgccgagaaaaatgactatagtcttggtggtttaaaacaacagaaatttaatacttatattctggagtccagaagtcttgaagtcagtttctctgggccaaaactaaggtggtggtagggctctgctcgcaccaggggctctggggcaaatctgtgtccttgcctttcccagcttgtgagctgccttcaaggttcatggccccttcctccatcttcgtccacagtgcagcgttttcagatttctccctctgctgcagttgtcacgtcgccttctctctgctgtggcagagcctccctcttataaggacactggtggttacatttagggccccccagataatccaggatagtctcttcgtttcaagatccttcatttaatcacatctgcagagtccctgttaccatataaggtaattttcacaggctccaggtcggggcccaggtgtctctggggccattcttcatcctccacactcacatggcccagcattgcccaccagatgaagtccagactcctcaccaggtcggggttctgctcgtgccaccccatctcgcacagctccgagttgcctgctctttctgcctggacctactcgcccctcatctttgccaacactgaggtctcagtttagaggtctcttcctccagaaagccccccaggaccccaccctcatccgtaggtgtccttcctgtttgctaccatagcactcaccctcccttgacagagccctctgcccccacacatccccctcctcctgcaccatgtgccttgtttccttgactgctgagccaccatcgtgaagcacgatgcttggcacgttgtagacacaataaatgcttgttgaatgtgtaaatttatacatgtgtagaaggggcacctttttagaaaaagggacactgactagttacgggtaattgtcacttaagaaagaaaagttttggccaggcatggtggctcaggccataaacgcagcactctgggaggccgaggcgggcagatcacctgaggtcaggagttcaagaccagcctggccaacatggtgaaaccccgtctccactaaaaatacaaaaaattagctgagcgtggtggcacatacctgtaatcccagctactcaggaggctgaggcaggagaattgcttgaacctgggaggcagaggttgcagtgagctgagatcgcaccactgcattccagcctgggtgacaaaaaaaaaaaaaaaaaaaaagaaagctttctcactagctcgactttcctttttttctttttgcgcgttacatgtgtactccggttttcatgatcagattattcttccttttttggaaaagtaaaaaaaataataaaatttaaaatttagagagaccaattgtgttctcagggtcccacttttggggacactggtagggtctgagttttctgaatggaatcacccatggtaaccggcagtaacaagttaccaaaacttagtggcttaaagtacatttatttttattttattttattatttaatttaatgaatttattttgagatgggcttactctgtcgaccaggctagagtgcagtggcgtgattgtggctcactgcagccttggcctcccgggcccaatttatcctcctgcctcagcctgcctagtagctgggaccagaggtgcatgctagcacatctggctaattttttattttttgtagagatgggatctccccatgttgcccaggctggtcttgaactcctgggctcaagcgatcctccctcctcggcttcctgaagtgctgagattacaggtgtgagccactgcgcctggccttattttattatttttttaagagacaacgtcttactctgttgcccaggctagagtgcagtggtatgatcatagctcactgcagccctgagctcctgggctcaagcaatcctcctaccttagactcccaagtagctaggactacctgtgcgtgccaccacatccagctaatttttaaatttttttttgtagagatggggtctcctgctgttgcccaggctggtctcgaactcctggcctcgaatgatcctcctgcctcggcttcatgaagtattgcagtcacgggcatgaaccaccatgcctggccaacgctaattgattatctcacagttctgtagttcaaaggtctgacacgaatctcactgagctaacatcaaggtatcaacagggatgtgttcttttctggagactctaagacaagtccattttcttgcttttccagcttctagaggctgtctgtgtccctcgggtcgtggatccttcttccaggaggtcgaatccttctcacattgtctcactgtaatactggttcctatgcctccctcttccacttaaaaaatatattgtgggctgggtgcggtggctcatgcctgtaatcccagcactttgggaggccgaggcaagcaggttgcttgagtccaggagttcaagaccggcctgggcaacatggcaaaaccccatctctactaaaaatgcaaaaaactagctgggcatcatggcatatgcctttagtcgcagctacttgggaggctgaggtgggaggatcacttcagcctgggaaagtcgaggctgcagtgagctgagattatgccactgcactccagcctgggtaacagagtgagtctctgtctcaaaaaaaaaaaatatatatatatatgtatatatatatatacacacacacatacacgtgtatatgtatatagtggtaaaatacacataaaatttaccatcttaaccattttaaagtgtctagttcagtggcattaagtaacttcacatgttgtgtaaccatcactgccgtctatctccagaactctcttccttttgcacactctgtacccattaagaaactctccatttccccttcttcccagcctctggcaaccaccgttctactttttgaagaatcaccattctataaaatcagtctctgattttgactactctaggtacctcataaaagtggaatcatatggtatttttctttttgggtgtggcctgttataatgtcttcaaggttcacccatgttctagcatgtgccagcctttccttcctttttaaggctgaataatattccactggatgcgtatattccattttgtttatctgctcatccttcagtggacacttgggctgcttccacctttgggctgttgtgagtaatgtgattttgcccctggggacacttagtagtgtctgtcgacagttttggtcatcatcactggggtagtgctgctggcatctagtgagcagaatccagagatgctgctaaacacctgcaatgcacaagacagtcccacgacaaagaacagtccaaggccaggggcggtggggcacacctgtagttccagctactcgggaggctgaggcggggggatcgagggagcccagggatttgaggctgcagtgagctatggtcatgccactgcactcccagcccaggtgacaaagtgacatcgcttctctccaaatagaaattaaaaaagaatgggccagctccaatggtaatagtgctgctgggcgcggtggctcacgcctgtaatcccagcactttgggaggctgaggcgggcggatcacctgaggtcaggagtttgagaccagcctggccaacatggtgaaacccttcctctactaaaaatacaaaaaattagcctggcgtgatggcgggcacctgtagttccagctacttgggaagctgaggcaagagaatcacctgaacctgggagagggaggttgcagtgagctgaggtcataccactgcactccagcctgggcgaagagagtgagactctttctcaaaaaacaaaacaaaacaaaacaaatggtaatagtgccaaggttgagaaatcctgatatatatatgtatatatatacctatctgaataaatatttatacatgtaaatgtgtgtatgtatatgcatattttatacttacatagattttaaacaaaattagacccatagttttgttacctgtgtttttgtaatgtattgttataattaaattgtctttcacattgtaatattttagtggtgtctgtagacacatactgtgatttctcgcactcggctgtatttgggcattttcaggtggtttacccatcctcagtagacctcagtagaatcgggctgtccctgagataactctctattctgtgttgtgacggtctcttcagagaggaggactcatcagtcatccttggaaccaatgtgggtgtcagtgtgctctgtggctggggcatttgtgcttggattgtccaagggttgtcgtctttcctttggatgtttgttctcagaggctgtggcaagccgaggcagcagccagcagtgttgcccctcacagccttgggtcagtgttagctgtggatctgggtggggaggaacggagagccatggcgtccaattttgtgccccctccccaccccaagttctgctgagttcccaagcacacaacttgactttaacctctgtcttctccttccaaatgtaggcctctccttccgatgaaaagagaaaggaagaatggactacagccaccaaacgtccctagtcccatgtggacaagataaatacatttccaagtaagacgttttgctggagtgttttgtcctcagtgaccagtcccgtgctgggatgttgtgggtggacggcagccgctggcagagggccccccactgtatatcagactggtggggctcctgcatgggggaaggagccaagcagctgaacttggacttgtaagagcgtcagggctgctgctatagataaaaacatgtcccgagagcctggcctggaggtgaagtaaaggggaagtcaagacgcagaaactttgggggctcaaaagatgtggtatcctggaagacttccaggaggaggagttggctggtggctgttcgctatcttctgaatgtttgtgtctcccccaaattcctatgtggaaacttcaccccaaggtgctggtataagaggtggggcctctgggatgtgattagatctaagtacccttataaaaggccaagggagattgtttttcctccgcggtgtgaggacgcagtgagaaggcactgtctgtgaggatagggctgtcaccagacactgactctaccctgacgttggacttcctggccaccagagctgtgagaaatgaatttctgttctttagaagccacccagtctatggtccggcagccagaatggactcagacactgctccccgtcctgtccgttgtgttcccagggagtcctggctggagtagtgtgtccctcggctgctctgggtctggctaatgccctctgaatagaaggggacaatttaattgctttctgtgcactaaagtctcttgagctcaggctttttgctaatgtgactgggcttgagccaaaatagacccttgaattggaagttccagcataagatttctctatctctttttttttttttagaaggaatctccctctgtcacctaggctggagtgcagtggcgtgatctcagttcatggcaacctctgcctcctgggttcaagtgattctcctgcctcaacctcccaggtagctgggattacaggcatgcgccaccacacccagctaattttttaatttttagtagaggtgggctttcaccatgttggccgggctggtcttgaacacctgacctcaggtgatccacccgccttggcctcccaaagtgctgggattacaggcgtgagccaccacacccagctgggatttctctatcttaacgaaatatttaatttatctgggactaaattgttggaagtccttaggcacacttgacacatgttttgtgacatctgaccattcttatctctttgtggacagatttccccagggacttctaccaaccaatgattttctctcccggtttcagatctgtgtgttcaaaagtaccaaacggccttttgtcttaggtgatttcgaatcacattttccacaaatttatttcagcttgcatagaatcatgctgctttatctaggtttaacttgtcaggattttcttggcatttccagtgggtcttgactcctggcgtggtccaaaatctctccactgaatggctgggttcagagaggctgaactctgccacctcttacttgagactagacaaaagcgcacagtggccccctccacctctcgcccctctcatcccacctggagtgcaaaacatgcactttcagatgaaacttgacttgtgcattctcagggttgatgagggatttccctgatcacaaagggggtgaaatctcctctctggccacgtgcagtagagctgtactcccagtgcagccacttggaaaacttggtggctaaggaggtccagtgctgggcttcagagggggagtttctaagggtttttattttttaatttttagaactgaaaaagtattgccagggcccagaagccacctcatgcccacttcttgtcactactccccaaggtgaaccactatcctgaattctaacactccattttgaactttctgtcaatggaatatgatctgtgcttttttgtgaaagaagctagacacaagaaaagcacatatcctataattcccatgagtcacacacatgcgtgtagttgtgtagttcattcacattctcttcgctgataattttccgttgtgtggctattgcttcctttatgcacccattctgatgctgatgggagtttgcaagtttttttttttttgtttgtttgtttgtttttttgagatggagtctcagtcttttgcccaggctggagtgcagtggcgcgatctcagctcactgcaacctctgcctctgaggtttgggtgattctcctgcctcagcctcctgagtagctgggaatacaggtgtgcaccaccacgcctggctaattttttgtatttttgttagagatggggtttcaccatgttggccaggctggtctcaaactcctgaccttaagtgatccgctggtcttggcctcccaaagtactgggattacaggcatgagccactgcgcgcagccagcttctgagtcttgtgaaggcctatcattattgtcctttcctcactcacagcgtgcttgagggagaaaaggccacagccatgcaggagaatcgctgtgtgtgggctctgaagtgctcgcctcagtgaatccatggcttattaacacctgctcattcagcttgagtttgggagtattgtcggtagacgaggcctgccttggtgtcctggagttgctccttactttaagcattgttctggggtggtgctcactcttgactttgatcctgggggaagatggttatggggtggtggtggcagaactctgtgtgcatgtgcatgtgtgtgtatgtacatgtggacagttacccaaagtggggtgactgaaggccaggtgagaggtgagagagagggaacaactgcattataagtggcttcagctgataatgttatatctcttctatttttccccctaagaaatgaacttctcttgcatctgaagacctacaacttgtactatgaaggccagaatttacagctccggcaccgggaggtaaggagtccccagggacggccctgattggctagtccagggcttgtcaccatgtgtcctgggtctgaaggtccctgaggtcccaagagaaccctgcctctcctgcttcttatttaggttgctagtgagagtccttggggttctttggaagaagactccaggcccagttttgttccaaaaaggatgaatgtttcagagatgtgttccagagacattcctgtagaaatgtggcagggctagcccagtctcatgggggagattctccagagggagctttcatgaaatgacctttccaggtggctcccaagcagacgttctctcgttgggcaattcgggaaccccacccagtcctctgtgtttaaacatttgggcccaagtcctatcactgcagtgacctgggcaaagcacataagctctggatgttagcagagtccccactgatagtgggcccgtccccacacttggtcatcctaggttgcttttgttactcatctgattcccatcctgaaactgagcttactcatcctgtatccatttctctaaagcctgttatcagatagatgatgagttataaaggagtctggtagggtactttatactcaagcgcctgtgactgataaaaaggtccctatgtgtaatgccctttgaaacacattttcaggttatcaagctgtggcgatttaaccatagaaacagataacagatggtggaatttcagctgctagggcaggttgcttggggacagtatgtgggatgtagtggcctattctgtgtccctcaaaccactccacttagacaaaatcctgttttgggttaaattttgacctacaattgtgtaaaggaatgatgcccaccttgaccaggggaaggccatgtaaattgcctatgtttacataaagccttcctccctgagacgcctaagcaccgtaaaattgtttcatttctctccttccctcttttattccttcctccctctttgaggatgattttggggcccaagttagttagttgctcaatgggctgatgttattttcacctatggggcttgtcctgaagatgtgttccatgacccagatctaacacttgaatagcccataaaacatggctccaaaaaggtttttctgagactagagggaggagaaccgattcttttaggaactgcccttcaagcttttactaatcagcagctgggccatgcaagattttagttcttaaatagctttcctgggttatgtcctatagaataaatgattaaaagtgcttcatgattaaaggatttcatagtcataagcgagtcccaattcttcgggatagaacatataaatgcctctagaatggttttacatttaatgtctaattagtcagcaacctttgagtataaattggggactcctgcaagatttattcacctgttggagagttgtcatttagcccgttagtttattacagaacctgggacattctgctgtttggaaatctgattagcacagcctctcccagctcatgatcacttgacacccttttaaagacagcagttcatctgctagaggagctagtgttctgtagaataaacttcggcaaatgttgctttaaatttccttcaaccaccaggttggattgctaaacagatgttgtagctaaagagacatcattttccgtagtaggggatgggacgtagctaactccagttcttgcttctgttaacaaggctaatctcacttattttaagaaatgtattccgctttctttaaaagtcattaggataaaaagaaaaacaatgctttttataatttatacctatgtatttgaatttcacagcaacttttgtgctgacctgtgaggtcagcttcaggatctggagtagttgacgtcagaaagtatctcagagctgcggtgtgaactgggcagctgcccctatcctgtgaatacagtctgggggcccccagccaggacatgtgaagaatgtgtcatttgtccctcagcatggtcttggcttctgtgggggcttttctaggctcactactctgattgctttgtgggcaggaagaagacgagttcattgtggaggggctcctgaacatctcctggggcctgcgccggcccattcgcctgcagatgcaggatgacaacgaacgcattcgaccccctccatcctcctcctcctggcactctggctgtaacctgggggctcaggggtgagtgaggagagacggggcagggagatgactgggatgcttgggtgttctatgtgttctcaagcagataaatgctgccttcttccagccagccctgaccctggctcctcctcctactacctctactgcccacctgccttagccttggaatgaggaacaagcagcagatgtggttgtgattgagcccccttcctgtcactgcaatcactgatgaggtcacaggaggggagctgctgagtcatacgaggggagctgctgagtcagagtcctcccttagggagaactcaggagtctctgagtggagctgctagtggctagtgaggcccagcctgtatatttctaacagggcgccccatgccccagcaccctccccactgggaccactcctcatagaatagccccactccaaagcatttatgacttgaaccttctgaccaaagctctctgaatcttgggggaacctagaagaggaaaaggaatgtcaggctctgtcagagtcagccaagcgagatcagccaggggtctgctccctgcagaccatacggggagccagggtgtggtgagatggtggtagtctaagttcccaccagaagggctgagaagacctagtccatccctccttatcctccatggctgaataagccgccaaatgcgccgccaaatgcctctagcaaggcatgccctctttattgtctttctgggacttgagttttaggatcaagtgactagcctgtctccatcctgaaacctgctgatgctgactgccttcggccccagcctgggtggagtgtgctcgcctctcagccaaaaccacagtgaccattttttctggtttaaatgaaaaccaagccctctctgttggccacattgaacattttgctaaactccacagccaaatctatgtttctctacaattgagagaaacctactatgtggccagccctggggctggtctggtttctttccaaggggatttaaggaggaaaattgttgcccaccccataggtgctaggatgtctggttaaggttctttggtttcatctaactttgcaggtttcatgctctgcttttcagcactatcaccatatttttgttttgttttgtttgagacaaggtctcactctgtttcccaggctggagtgcggtggcttaatcacagcttactgcagcctcaacctcctaggctcaagtgatcctcccaactcagactccccagcagctgggactataggtgcacaccgccccaccccgaccttttttttttctgttgcccaggctggagtgcagtgatgcgatctcggctcactgcaacctctgcctctcgggttcaagcgattcgtgcctcagcctcctgagtagctgggattacaggtgcccaccaccaaacccagccatttttgtattttttggtagagagggggtttcatcatgttggccaggctggtcttgaactcatgacctcaagatatccaccttccttgacctcccaaagttccgggaccacaggggtgagccaccatactggccctacctggataattttcatgttttttgtagaaatggggtctcactatgttgcacaggttggtctcaaactcctggcctcaggcaatcctcccaccttgacttcccaacgtgctgggattacaggtgtgagccaccatgcccagctgtacttgttacactgtactgtatttgttatactatactgtatttgttatactatactgtattattgctgtatttgactgccaatggccaagcccatttcacagactgaccctgacccccagactattctattccctaagtgagatgatttttaagatttcgtttgagcctgtggcctttggtttgggctgctaaagggtccttcggtccgcctgcttcttctcccttctctgcggcatcaagctggtcctggctgactctgcaaaatactttggtagaattttcaggaatggtaaatggtgtcatttagatgtcagctataatacagtgaatgcctagactgctgtcttaagaaggatcctgaggctgtgcgtggtggatcgtgcctataatcccagcacttcgggaggctgaggcgggtgatcacttgagctcaggaattcaagaccagcctgggcaacatggtgaaaccctgtctctacaaaaaaataaaataaaaaaaaaaaataaggatgctgagaccggttcctgcttcagcaagaatgaaggctttaaatcagggagtgggagtcgctgctctgggtgccaagtgttcaccattccccagaagctctgaccaggtccattctgtggttcagaagtatatgagttaaattacaataggaagttctttcagattttccattttaattgtccttccttaaaacgatcctccccagaacatgaggtttatctctactgggtcccagggagcccatgctcttctcaccatgggttgttcctaattggtcaaatatgattctcctttctagccaaatcctctgttgattttggatgtttttctgagctgctccctttgtcctttttggctttgagaagttatttgccagttatgatggcaaaccagggtctcagcttggactgcctgcttgtaaccctttcttcagcttggatgaggactccatccttgcaacgctgagaacactgtcagtgtcccttccaaagctgcccctgcccttgttgtggccaacttattactttccattccttttgaatgccagaagcaattatgagttatttcttcaacagcaatgagtctaaactggaatcttaccctgcaaaacgaatggccactattagagttttccaagtaagccatagaatccatacatgcttagaagcagtgcaggcagcacgtgggttttgttccttggtattatccatcctgggcttgatgaattggttgggtgtgttactgcagttgctgcaaaagaacatcttctccctccggaactccccctgccccacccactgcttgacctgggagctgggccagcctttcacgggatgctccgcgcagcccatctgcacccttcatcacctgatgtgtgccagtacccagcctggcactagcaaagtgctcccctttcaggagtggggtccagcgggtgtgggggcgtctctccacagggcttaaactagtctcccccctcccctttgtcttctccactcccagaaccactctgaagcccctgactgtgcccaaagttcagatctcagaggtggatgccccgccggagggtgaccagatgccaagctccacaggtacatgtgagtggaaggtacttccagctagggaccaactgtgtgaagaccgctgtgatagatgttgtaaactgttatttatttttgagaatataaaatgtatatggttcaagatacaaagggagagaattaagtcacccacctcatccacccacctagaagcatcccgagaacatccttcgtgggatagtccatgcaaatataagcaaaacacactgacatgtctttatgggtggatgtagtttctttccccctcccctcccctcccctcccctcccctcctctccccttcccttcccttcccatctccctctgtcactcaggaggatgcagtgcagtagtgcaatcttggctctgcttcctgggttcaagtgatcctcccacctctgcctcctgagtagctgggattaaaggcatgggccaccatgcccagctaatttttgtatttctagtgctgatgggtttttgccatgttggccaggctggtcttgaactcctggcttcaagtgatctgcccgcctcagcctcccaaaatgctgggattataggcatgagccaccgcgcctggttggatgtagtttcttttcttcccctagttatacaagtggtagcattgtgcagatcccagtttttatttatcagtttatctgggggaatgtttccatatacatttgtaaagaacttccttattctttacagctctgcattctttcactgtatggaaaaaggataatttatgtaatcactccctactggtagacatttaagtcattttcagcctctgctatgacaaacgagtttgcagtcggcggccttatacatgtgtcatgtcacacatttgtcagcgtgtaggattctttcaagtggactttctgggtttaaggccatatgcatttttaattttcatagatattgtcagtttgcaaaatcttttttatattacgtggattaaatatattttaataagagcagattaacctacttgtgattaatgtcagtattgtatgtttatacacatacaaggatagacatatgccatgggaaccccacatatttttagatacatgttctgttaaacattattttttctaattttttattgtggtaagatatacataacataacgtttaccatcttaaccatgttaagtggtacagttcagtggtattaaaagcactcataatgttgcgcaaccatcaccaccatccatctccagaactctttccatcttgtgaaactgaaactctgtacccattaaactcccaatagctccccacatccttctctctttagctcctggcaaccaccattctactctctgtctctgtaattttgtatgtacctagaatgtacttacagtgtacctcaattatatgtggtacacttatatgaggtacactctaagtatctcatataagtggaatcattcagtatttgctgttttgtaattggcttgttgcacttagcataatgtcatcaaggttcatccgtgggtagcatgtgtcagagtttgtctgcagtatcttgttagctcttatatcgtgcttatcctgtgccaggcactattctaagtgctttatgtatactaactcatttaaaccctcagcaaccctctgaggtgggtgttattattatccctattttatatataaaagcaccgaggcacagagaggttagtgatatatggcaatcatggagcagggatttgaacccagggagtccggctctgaagtctgttctctgaacttttccttgtataggttctctgtaaattctgcattatgtttttcccccagcagaaaatattatttgtataaaatatatatttgtggagacagtgggtgctgtcgcactggccacaaattggggaccatgtgccatgtcccaggtccagacagacagagttcatttccctctcctctctcagactccaggggcctgaagcccctgcaggaggacaccccacagctgatgcgcacacgcagtgatgttggggtgcgtcgccgtggcaatgtgaggacgcctagtgaccagcggcgaatcagacgccaccgcttctccatcaacggccatttctacaaccataaggtaaggtggacagggggacggggagggtggaagacctcttcctgggtagatgccacctcagggctacagccatatggtgggtggtgtggatgcctgggaagccaagtgtttgctgctgtttagtctttgggttgtgggtgggctgcaagccctgctggcttcctgagggctgagggaccccaggtcagaagcctcaaagtccccctgtgggttccccttaaggtggtgggtgaattcagtggggctgtacaaagcagtccctgctgtagccttgaagaccccataaacgcagctcatcagtctctcccaagaaaatccacgtgttaccctcttcctgcacactgtgcccccagctggtgtatggtctggcttttcccagagctgaagcagagctgcaggtctcagacctggggtgtcagtgcaccacccaccccaccccatcttgctgatccctcctttcctcctgctttgttcaaatcctacccccggaggcaatacatggtgggagagtggtcagagacagccttgtgctgaagtcccagaggaagggtctttttgagcgtggagcatgaactgaattatgcaaaccccgagggttgctttgtctacaaagcctgctgcttgccagtctgccgggggctcccagggagtacattttgagtatcgttgtcactgtgccctgtaccgcacctggattttagcactgggtccttgttcccactcccaccctgagctgggcccttctattgacagacatccgtgttcacaccagcctatggctctgtcaccaacgtccgcatcaacagcaccatgaccaccccacaggtcctgaagctgctgctcaacaaatttaaggcaagttccctttgctgagtggccacagatggggtcacagctgtgccttgggactcctagagtggttgtgcgaggagctatggaaattgtgtgttttgtgggatgctgagcagagggcttcggttctttagatcctcacgatccaggacaaagtccacagaatcagcatcagcatcacctgggtgcttgttagaaattcagattctcaggccccaccccagacccactaaatcagaaattgtgaggggtaggccagggacgccgtctaacaagcctgcaggggatttggatgcctaccgaagtttgagaaacatcagccctcaaatcctttatgggctactttacaaggaccctggggcctgctgactggttttgggctcagtgcgaagattgacttctgggacacagttgggaaacctactttgaaatatgatacttaaatagatgcgcaaattatagtgcaggagtgcttttaaagttctgttgctctgtgttttccacaatctcttggagaccagagatcttttggagaccaggtgttcttatttttaatggaagccagtgtagcctaacaacctaagaacacaggctctgggttcaaatctccactgagcacctgctagttggatgaattgggcaggttacttaacctgcccctgcctctgcttcgtcatcataaaatgaggataatgggacttcactatggtatcgtcgtgagcattagatgggttgaagcctttaacatttgtagaactatgcctggcacattgcaatagacgatagctgttatctatcctagtcgtgtgctacagaatgaccaatttggtcaatgatgcaccacatatacgacagtggtcccgtaagattataatccattttttatggtaccttttctgtgtttagatatgtttagatacacaaatgcttaccattgtgttacaagtgcttacggcattgagtacagtaacatgctgtacaggtttgtacactaggagcaataggctatataccatatggcctaggtgtgaagtaggctatgccatccaggtttctgtaagtacactctatgatgtttgcacaacaatgaaattgcctagtgacacatttctcagaatgcatcctcgtggttaagtgcatgactgtattattgataaagtcatctgccttctcgatcttctcatcacttctgagagttgtagataaatagctctcccctcaaaacagcctaaaattgacttagctttgcattgctaaagaagaggaaaagcctcgaagttgggatgtttaaatagaaactttcaacaagaatcttttgctcctgcttcagattgagaattcagcagaggagtttgccttgtacgtggtccatacgagtggtggtaagtctgaagaccacagtgtactttaaaacttctaattaactcaaaatagcaagttaaaaaaatacctctgcctcctttgcttgttgtttgagttttggaaacttccaaatgttgtttgccttcaaggctgatgggcttgctgtatgagtctactagggattgccttatatggccagtaaacaaattctaaacctaactgcctattaaaagaggaactagattttcttaagagacagataaacccaattcctccaaggagtttgaggcatggtggtattgttgaggggtgaggagtgggaggaagttgcttttcacaacacctatggaatagttcacttataaatcagtctcctgacgtatatggcggcatctcctaaggtgcctagtccctttggacccctgcattaaccactacttaatgtgagaaaggcctctcagggctgctcctgggtgtgtgtggttgcagagaaacagaagctgaaggccaccgattacccgctgattgcccgaatcctccagggcccatgtgagcagatctccaaagtgttcctaatggagaaggaccaggtggaggaagtcacctacgacgtgagttccctttgggtcaggcgatctgtcctcaggagggtggggatttggttggaccacctgtaactggggtatagaatgacttttttgaccaatgaccatgcccccttttacttcttcagcaccaggttctctcgaagccagcttttgcagagtaacaaacatctccaaatcatagtagctgacaacagcaaacatttgcttttttgcccatgattctgtggtctagtagcaatggctctactctaagtatgggttgagttcaagtctgcactgtgtgactcacccagaggcccaggcttctggggcagtagttactgcacatgggtgtggtcctcatggcagatggcggagcatgagaaaccaggccaaatcatgtaagcatatttgaagcctccactcagatttggtgtgtcatgtccacacacattccactggccaaagccagtcacatggacaagctcagcattaatagggtagagaaatgtacttatcccagggagaagagttgatagagcagggtggggattcttgtggggaaagggaagccattttttaactttttttttttttttgggatggagtctcgctctgttgcccaggctggagtgcagtggcacctccctggttcaagctattttcctgcctcagactcctgagtagctgggaccacaggtgtgcaccaccatgcctggctaatttttgtatttttagtagagacggggtttcaccatgttggccagctggtcttgaactcttgacctcaagtgatccgcccgcctcagcctcccaaagtgctgggattacaggcatgaaccacgatgcctggcaccgtttttaaactttaactcaccccatagccacccacagcctctccaaagcgagttcatatttggatgcttgtttgagccttgagacccaaatcgtcatctggaaccctgattccttccattctcttaggggagaacaaaggggtttattaaacataatgggttcagttctttctctgcatcactgtgtcaaaagaaagtacttttctgtgtttggcttcacctcatcacgaattgaatgcatgacatgaaaaatgagaagttatgagatggtgtcacgtaagcgaagcgatcatcgcagactccttcccaccctggtgaggaatgaggcttggctgctgcctttaaggaaatcctgggtttctgaaaaaaatagacttcccaaggctttgtgccttgtataaggacaaccctgaaaggaattggaataatgctgggaagggcattcacccagacttgcttctttctctctaggtggcccagtatataaagttcgagatgccggtacttaaaagcttcattcagaagctccaggaggaagaagatcgggaagtaaagaagctgatgcgcaagtaagtgtggcttctggggcactgggtgcacttctcctggggcctcaacagaggggcctctgctgggtcctcgcagggactgtgctgagctgctgcatgggcctgagtctcggctttctttggagggctgcccattgacaaacctggatttcaagtgaggacgtgacagttaagtgtgttcatctacttcttgtgtcagcttctcgttttgatgtgggacatcaaagtgtctcttgtcctccctcttatggaaagactctgaaaagaaggtgttggtttaaaatttctttggggtctagatgcagaaatagggaaggtgactgtacgctggtttcttaagtatacgatcaggctcccagcaggagacagatgctcactccgatgagggtctttgacgggtgtttgaagaagggactatttgcgaagacttgggcagagtctggggtaacctcaagggatagtgcagtccctggggctagtgttaccaccccttgcctgaaggggtgaaggcaaggagtgctaaccaagacccggaggttccagggatttcaggaaggctgtcttagccgtggatgtagcctgagctactggcctccaaaatcctctcctctcccccttcctccctttgtaacatttatcttctggaaattgcatttggattgaaaaataaagcggctttttgggaaggattttgtgatttctttgctatgtttagtcatagaagagactgcctttcatagatatggtggaattaatgattcatttttgccactggagaataaagccgctgctggatttgctgtatcgatgatcataactagtctgataacacactgaacacttactatgtcctaaagtttttgttgctgttgttgttgttttgttttgttttgacacagagtcttgctctgttgctcaggctggagtgcagagatgcgatctcggctcactgcaacttctacctcccagactcaagtgattctcccgtctcagcctccccagtagctgggattacaggcatgcgccaccatatctagctatttttttctttctttcttttttttttttttttttttgtatttttagtagagacggggttttgccatgttggccaggctggtcttgaactcctgacctcaagtgatccaccctcctcggcctctcagagtgctgggattgcaggcgtgagccaccatgcccagccaactatgtcctaaactttaaaaatagctttttctgtgcagcacaaatccctgaacataaggaatatgtccattgatccctgcacaacagtgcccactcctgcagctgcagtgccacggctcagggaagtcgtgggaaaacagaactccccccaagccacggacctccacgcctagtagctgctatggtctcttctgcaaaatgcaggttctgttataaggttgaaccatacgaagttgccatttttgtaggatccccaagagggtcaactgttagcaattttatatcatctagcctaggtgagggttcatgagctgctgtgcatatgaagtactatgcatagtgtcttggacatagtaagcaaacgcactgaattcgtagaatgcttattattgctgttgtttttttttacctttttttttttttttttttttggctagatgttctacccatagtaaaataatctaatttggatttggcctctttatttcctctcatcgtgttgtaggaatgaacataagcaacaaagtagctaaagaggggtcagtaatggaagcaaaggagcagggcacttgactgcactgttacctggtgtgaccttggtgttacccaggtggccgggaaggtcctgggcaggggtgtgttgctggctgctctccatctgagcctgtttcttgtctccaggtacaccgtgctccggctaatgattcgacagaggctggaggagatagccgagaccccagcaacaatctgagccatgagaacgaggggatctgggcaccccaggaaccgccattgcccataagacccccaggaagctaggcactttctttccatggaaacatttagacacaaacctccccagctccggccaagccatcatttgctacctggagctggatgtagaagtcagcagacagctccctatccctggacccctgccctccttttttctgctcacaaggacttttgattttagttataaggagggcccaaaatgtgtgtgtgtacatgtgtgtgcacacatggtacgtgtccatgtgcctacctgatactttcacatgtaattaaattccaggcaaccagcacaagagccgtgagcttggcacatgtgctgctcgtgagcaggaaaatcagaggagccactgatctgagtggtatttaggttgaaggaaagatttctcctctcaagtgccagggagcagccacacgtctgtctgtgtttagagagggaagagggttctccaggttcaccatttgggttgtttatatgttggtagaaattctccctgtatgcctagaaggatcagtgaatgtaagagccttggaaattaacaaaataacagccacataaccttgcggcaagtctgatggaaagaaaaagataaaccatccgtggggtagatgcaataagcccacgtatttttacactggaaacgttgattgttttaaatgacaaagacatatgtgatgttctatgtggaaacctgtgaagagtggattctgcctccatctctgcctccatggctacctttaggagacagagaagatcctgtgtgtttctctgtacccagctgacagcctgtctctatggcgcttccttgagtggaaggaaatgtctcaagaaacaaagatctcgctggtgcgtacacagtgctgaccagctagtgtggccagggcctggtggcctggtggccaggaagtttcaggttgaagggaaatgtcgaggctacctgcagatatgacaggtgccttgaacgcagcccatcttcatgtcatcaaaggtcttcctgcacttgaagctggggcgatgtttgcagtcaagaccattctttccaacctctgggttcttgcaagttgccctcaccttgtgtgtggagatgcattccaagaatgaagcctcatcttgctactgagtgtggggttcagggaagctctttaggccacctggtgaaggtgcatggggaggatggagcttctcctcagctcctctgagcagccacctatgtgatctttaaatccaaccccaatgggagaaaagggcaagaacagtctgtgccctgggactcctatcaggaagcttgacaggcagctgggcatcagtgcagctgatatcgtttgaggagggagacagatgcttggacctgggtgcctggctatggagattgaccaagcaagatcaggagctcctgatagcaggcgtctttgagcctagctggggtagaggcactgcccatctcttctccaccttctctccacagaatgtttgcagagctgggcagttgaggaaaggacagcccctggttggtgcctccaaaggaaggtggacttttttggtggagacgtttctgccctgggcaccctcctgcccccgattcatacctatggcttcttgagaaggctcacagctgtggtcttaacgtagactgcagaaagatggcatgcggcccctggcatttcgccaagggttttatagcaagtctccttcctccatagggacagcagcaccagccctgtggggcatggagtggaagcccagaagggcttctgcaagctgcacagaactggggtaagaagacaaagagtagccaccgggagaggcttcctttgttacagctgggaaagaacagttctgtgaatgcaaacacctcctgagttttgcaattgagaaaatgatttggagaacttctcttctggtaatttttattttgaatgttcagggccttagttggccccagtaattctccttggaggacttgggagaagaatttccacaaagcaaactactaaccactagctcttattggacagcgatttctggcttataagagttctctttgatttgcactagcactacgatagtgttagatggggaaatactgcaacatgtccagttggccagatcactttccaagggagcgatactaaggcagactgagctttttaaagatgggaggtcaggaggtggaagcgagaggagatcccatctcacacaacacacttccacgtaatgcagaccacacttttccattttgtcctgccctcttgagaggtcatttctcacgtcctaagaacctgatcagaaattttggaagggttctttgaaatagcagcagttgaaacagagacactttgccacagtgtggagcagattttctcactggtatcacatggtcttgcagttttgaactcttcgaccgatttgtgggagtttatgtaattgcgtgcaatgaacctgaaattgtgtaaaggacaaaagaccagtttatagggttgggttttttttccaacttgtgaaaagcagtttagctgcatctgtctccccaccacccccaccccgggaggggcttatgttacaaggtgatcaagtgaaggaaaaacctgagcctatctggctgggatggtggaattaagcacaaggtcacattctctgtgatcacatgagagggaaggtgatgacttaaatggcagggggtggggattatcttggggagaggctgaaaagcacaaaagatagtcttccctgtacgtattggtgaagaacgtgcacaaggctggatggacttcaacttggagttgagttgaggcaagaggatttctggatattagtcacccatctgcaagaaaaatgctgaggcctcgggtcaagattttgatctgagacatgctgatgcttcaaggagaaatattttcacaatcctctcttccctcaccagaagagaacagtactctctcctagaaacctctaggtaaacacattttatcctaatatcggtagcatataatgccccccccaaaatatctgttttccatgcaaaaaagtctcaacaagaagtctgtggagttgagtggttacttcaaagtgtcaggagagtgaagaaattggccacagaagagcaagaagctctcttaagaaaagggaattctctttaaagaaaccaccaccaacaacaaaacaaccaaaaaccatgttttatgtcaaagctctgtagcacagagaatgtggtgtcacagatacatcgccgagagaggtttctttctttcttttttttttttttgagacagagtctggttctgtttcccaggctggagtgcagtggtgggatctcagctcactgcaacatccgcctctggggttcaagtgattctcctgtctcagcctcccaagtagctggaattacagggacccgccaccacgcccggctaatttttttgtgtggttttagtagaggtggggtttcaccatcttggccaggctggtcttgaactcctgacctcgtgatccacccgcctaggcctcccaaagtgttgggattacaggcgtgagccactgtgcccagccaaaagagaaatttctacatgaacaaggcaatttcagtgtcttacagcggccaaaccatgacgtgaagaatgagataggagacaggagatcaccataagcgtccctgatatagcagcacacattttcacgtttccacttaaatcgttttgcacaaagtcttgcttcgctcagatgagatgagatatgatttcctagagatgtaaaaataagaatgaatgtggcgcccccttcttccagatgtaatagaaagctctgccctatcacaaggggggtgttgaagcgccccttgtgttttaactgtatttaactgagcacaagatgcacaagctgtggtgggaaaccctcagtttacctttggagtcttccctgcagatcgcagacctgtttccaggctgatgtttctggtgtgtaattgctagcgtttctgaagggttttcccaattgttttagccttgtgaagtattcttaattataacttgcctttcagcgatggtacatgacttgattcaacgtttggttctgaacttacacactgatgcgtttactcatctaacataatctgacagggcctcagcaagggagccatacatttttgtaacattttgatatgttttaatgcatctgacttagatcttactgaaataaagcacttttcaaagagatgtgccccgtggatgggtctgtgtgtgactgctggctgcgggagctctgtgttgtgagagggtggttgtaaggtgggtgacaggaacaggaaggagcacccaccagataagttaattttcttccccaagtttatggtttgaacatgtttgggcctggctgttacgtcccaaataggaagtaaaatgagaaggttgtcttaggagctgccagttgagggctctggagagccaggagttgtggaggaaagagcttggaacttctattcagtgaggctggatttccactctcactccaccccttcctcttggaccctgggaccaactcaatgatcctttctctaggacttggttttctcacctgtaaaatggctaagcccccctgcaggggttgggcacctgggcttgcttctgttggaagcatccccccatggctccccaagtgtgagattttcagactagggcccaagttccaccctatggtacggggaaggtatgatatctaattttatatgtcaacttggctaggccatacagcccagatatttggtcaaacactagatgttactatgaatttgtttttttttttttaagttgagattaacatttaaatcagtggactttgagcagtctgccctccataatgtgggtgggcctcacccaatcagttgaaggccttaagaacgaagactgagatcccagagaagaaggaattctgcctcaagactgcctttggacttgaactacaggatcaattatgtgaaccaattccttaagctctgtctccccacacccacacctctctctctctctctacacacacacacacacacacacacacacacacacacacacgcacaatctttggagaaccctgactaatacacagaaataatttcatttgttcataaagtttaatatgagatttgacggttgtcttcctaagaaacctggccatggagcagaaatagtgaccattataatttggcctctagaagaaggtaacaaccaagaccagatttttaatgatgcttctgtaaacaatgcatatataagtatgaaagagagagagagatggggaaggagggagagagagacagaaagaaagtgtggataaatcacagttcccttggagtgttgtttcgatttcccatatttagagtttttaattcaaagagagcttttcagttgccgcttttaagttgggtgaaacagatgagcagttaacccttccaaggtagtgagacttttgtacagtgcatcatgtagatgtaggtgatatacactgaagataaatggttcatctggagtccaaccacgaccccccaaaatgcagtaagccttgtaggagttacagtgcctaaaataaccaaaaaattctaatagccttctgccaaaggtgctggcagttcttggcttgttttatagaaacagattttatgaagtaatttggtattatctattttaggtaatgaggctatgactgaatggagtttgctgtgagtacaagacttcactgtcaagttttgaagacatttgaataggttgctgaaatgtttaaatgcaagaaaacactgctgaaaactgaacttgagtaaaattaacattgctatttttagtttaaaaccatgcaaaattttctgcggatcatatgggggcagaaagaagaaaagaagaaataatgcaaaaaagaaattgtgacttacagtttaagtatatgttatataagtaagttaactttatataagtgataaattataagtatatgctttataagtgtataagttaactttagaagttttaaaatggtaggtaggcccactggcagagaccataagtcctggattgcttgggacacttccactttattctgtggttatatgtaattattaacagcatccccttttactctcaaaatgatccagtatggatgataaatatgatcaccctatgagttggccaaagagcagcttatcataattttgatgagaagtttttaagcagcagccataagttggaatttaagtgttaagtttaaactttaggaaaaactgaaatctaaacatgtgttttgacataatgcagaatataatatggatttttgtgtatcagtgttttattaaccccgatttaattgttcttgcattagagcaagatacatttttctaattggagttttaagcttggacttactaattcataagccataaacatgaatattattattttttaatttaaaaagtatttatttttcagttttattgtggcataactggcaaataaaaatgacatatattcaaggtgtacaacctgatgattgttgtacatacacatttcgcatatacattgtgaaacgattaccacatcacattaacacgtccatcatcacacagttgccattgtgtgtgtgtgtgtgtgtgtgtgtgtgtgtgtgtgatgtcaggacacttcagatctactgtttttttcttcatccagcccaaaatgtcaaagatctactttcttagtgaattacaagtaaacaatacagtactattaactatagtcacagcactgtatattagatccctagaacttaccttgttactgaacatttgttctctgatttttaggatatgacacaaaaagcacaggcaacaaaagcaaaaacaggccaggtgtgatggctcatgcctgtaatcctagcattttgaaagggtaaggtgggtggattgctcgagcacaggagtttgagaccatcctgggcaacacggcaaaaccccatctctacaaaatataccccccaaaattagctgggcatggtggcatgcacctgtagtcccggttactcgggaggctgaggtaggaggatcgcttgagcccagaaggctgcggttgcggtgggccaaaatcacatgcactccagtctgggtgacagagagatacactatctcaaagaaaaaaaaaggcaaaaataaacaagtgggactacatcaaactaaaaagcttctgcacagcaaaggaaacagtgaaatgaaaagacaacctgtagaatggaagaaaatatttgcaaaccatgtatctgataaggggttaacgttcaaaatacataaggaatttccacaactcaataattcatgactttgaatgtcccctgctagtcactaagcccctctaagctgcccttgatgccacctaccctcacctgcagagccatctatggggtcaacagcaccgagagtggggtatcttacaacatccttccctgggacaacccaggggttctgagaaggtagttggtgccaaacactgggacagatggaacgtgacagcatgggtatgtcttgctgatggaaagtaattatgtctcagagatgtctagggtataattttgggaacaaactacttagaactcccacacattgtggatattgaatgtctgggactacaaagagccttgattccaaaatgatcccaaggaaagatcttaattgatacagacgtgctgggaagggaagagcatggtccctttaaatgatacagaagtggggaagtgaagtgctgggtagaggagggcgtggtccctagctagggctctacccccacggacctaggtgaggacaggcatttttgctttgctgtccaaatgttgcatttcccaagaccaccctggcctctcatgctcccatcctatgcctataaaaacccgagaccctagcaaggcagggacagaagcggctgaaagtcgagaggagcacgtcagcggaggaacacttgggggctggacgtggggaggagcacatcggcgggcactggcacgctggcaggccatgaactggcagaagggcatggagtttggctggggcagttggaggagagcccgtggggtcgagtggcctgactccaggtgaaaatcatctcccttctggcaccccccccccatctgctgaaagctacttccactcaataaagccttgcactcattctccaagctcacccgtgatgcgatttttccggtacacaaggcaagaacaccgggatacagaaagccctctgtccttgcgacaaggtagagggtctaattgagctgcttaacacaagcggcttatggacggcgaaactaaaagagcaccctgtaacacatgcccgctggggcttaggagctgcaaacattcaccctctggacactggtgtggggtcggagccccacagcctgcccgtctgtatggtccctcagaggtttgagccgcagggcactgaagaagcgagccacagtccctatctcacgccctgcgagagggaaaagggaaccgttcccgtttcgtaatgtagtgttcaacttcaatcgttaaagttccttagccaaatattaactataacacaagttgtcacaaaaatcactaagcaaaaaagcgaactatgacatctatgacccactaaaagaaaccaacaaataaaagttgaattcaagttggtcataataatctagagataaattattagaaatataaaatgaattttgcaaggttgctaaaacaaggaagatacataaaaatgtatttctatgtatttctaggtgtataatctaataaaagattaaaaaataaaattaaaaaatgggaagatatacctcatttacggattgaaaatttaacagatctcccccaaattatctaaacattcaagtaatcccaataaaaagccaagtacatttttttccttgctttcctccttctttgtgataatggtataggtaaaataaaaaccgtaagcatgaatattattctgctactggaagtgtaattatcaagtttatgtagaaggctgggcgtggtggctcacacctgtaatcctagcactttgggaggccgagtcgggcagatcacctgaggtcaggagtttgagaccagcctggccgacttggcgaaaccctgtctctaccaaaaatacaaaaattagccaggcgtggtggtgggcgcctgtaatcccagctactcaagaggctgaagcgggagaatcacttgaactgggaggtggaggctgcagtgagccaagattgtgccactgcactccagcctgggcgacagagtgagactcagaatgaaattacataatagtttatgtagaaacatggaaaatattgttatgtaaagtaaataaaatagtatgttcaatatgattgcaggcctacatgtaaaggcttatgaaaaaagttatgttggggtggtgctattagattttcttactgcttctattacactggctttaaaattaaaatttcctgcttagtaactccaaaaatattgagaatccaaaaacgtataaacacatacaaaacaaaacaaaacaacaacaacaaaaaaacaatggccagaagattaaagccagtcaggcctttgtgtccctggtagggtcagtttttctaagcactagacttcagaattcctagaagaataagaggcccattatgcaatggaaatgcagtcccatataccaaaaatcatatatatatgtaatgtaaatacacacatatgtaatacacaggcaaaatggaaggatggcgtcaatagttccaaggcctttgaggaaaccagtcaccatgccatgccatctcgagtacgcgggagcctgaggttagagacctcatgtgaggaattgggaaattccctgtgtttagagtcagtcaccctggacaccaaacacattttcaatctgtactctcaattctcctttcagaaactggacatgcaaaagttttcaaaaggagagaaaaatacacaccataaatcctggaaacctgaagttagccagaatgtgctgttagacagttctactttcagtttcttatattctgaagttctcttgattaggaattgggtaccagatgcagtgcctgattcacaaaccaagccctttgcttggtgtcttctggataaatgtgtgccttgtcccgcctgggcacatgggacactcctgctcccccagcccaccccgcccaccccatgcgcctgaggcctgagccaggagctcaggagctgctctgcctttcgttcccatagaggccaggacactggcagtgagcatgatttctgggctgactcagatgactatcaaataaactgaatttaaaaatagttcactcaggtgcctactggtaccttctcaggatacacacactaagttgacaataaacaaccctaaaataacccaaatgactctaaggttcttaaaatgcccttagaattcccccaccctaaaaaacctcaaggatcctgaagatccctgtaaacgtcatgctagtggggttgacctctaagaagcatcagaatcacccagggttcctgtgaaaacgcagactgctgggccccaaccccagagttcctgattcagcagatggagtagggcagagaatctgcatctctaatataaagttctcaggtgatgctgatgtttctggtgcactaactgttctaaatgagcctaaggggaacactgcaatcacctggggagtttttttagaacactgatgtctatattccataccaagagattgtggttcaattcttctgggctgtggcattggcagcagaatttttaatattgcctctttcttactaactgatatggtttggctgtgtccccccccaaatctcatcttgaatcctaacgtgttatgagagtgacctggtgtggaggggcgggtaattgaatcatgggggcaagtctttcccaagctattctcatgatactgaatgtctcatgaaatctgatggttttaaaaagaggagctcccctgcacaagctctctttgcctgctgccatccatgtaagacttggcttgctccaccttgccttccaccatgattgtgaggcttccccagctacatggaactgtaagtccaattaaacctctttcttttgtaaattgtccagtctcggttatgtcttcatcagcagcgtgaaaatggactaatacacaaacctcctctccgactcctgtatgcactgaatttgaggaccactttaccaaccttaaaagatcctaaatgaatctaaacaatccttaacaatgaaacacaatcccctgtaaaacatttaaaggtgatagacaattaaaatgacaacaataaaatgacactaagattcctaaacgctattaatcaaccctagatgatcccagaggaccctaaaagaagctaaataacttttagtgaccataaactctagaaaaaaatttaaatgctgtaataattgaaaaaggtcctaaataaccttaatgaagtcaagatataataaaaaggtctaaatgacagcaaatgctacatgaccagccacattcctaccaactgtaaacctaaaaactttaaaaccaaatccttaacaacaataaccctaaatcatcccaaatgaatttcaaaaatcataaataatagtaaaagatcctaaatagccaaaaatattctaaatgatctttggtggctcctaacatccctagaggttcctaaaccttgaatgagccaactttaaaatcaaagaacccaaatgatattcagtgacctaaatgactgtaaaccttttttttaaaaaaaatcccaagtccttatctagcctacctggacctgctactgaaccaaccaggggttcagtctatgtcctactgctcgcctcccagaaaaccaatcactgagacaatgagccttgccaaggaagaaggctttcatcaggtgctgcagctaagaagacggaagatcagtctcaaatccatctccctgagcaactaaaattaggagtttatatagcaggaaataaatgtaaccatgtgtgggaaaacaggaattagcaaggggtaagcaagaagagttgattaacgggaagcaggtggttgcttagacaatcatgatgggtaagggggttttgcctctcattgtctagatacaatgatctggtgagtgtcagatccttgatgctatctagaaggcctgatagctggtttcctgagaaaggaactcagataagacaagtgtcattttctcaggttttaagactgggaggatcaatttctctgtttattcaaagaaaccataaacatcagctctatgggacaactgggtcagtttcagacctacatggtcttcctcaggcctcctcttgggatcagctacactggccttgctgctcttcaagcatgtccagacctgtcctgcttctgggacttgcacttgccacttggtctttttgggatactcttcacccaagctcatcacatgcttgcctcctttttgattcaggtctcagctcaactcttccttcctagcaaggccttccccgaacacccaaatcagctgctctcctgccagctatcctctgcttccacactcttctaagtgctttttttcagtctgaatgtattcgttgacttatgtatctcctccactagaacctaagctctgtgaaggcatcccaaccacctagagcagcacctgattcttggtagacactgtgaaaggaaaataaacctcaggacccccaactcactaaggcaaagggaaaagtcaagttaggaaatgggtcatgcaaacctgcttcccattttgttcagaaaaagatagctgcaaagataaaaagagctacatacttccctcacaatgtgcccacaaggaaattcctcgtgggtcccaaggtctttaccttaaaagagttctattgaatttcaccctgaccttcacacggataggacaaaggacagaagtaaaagtcatctctctgtccacctgactgcttcctctgccctaagtttattttaccttatgtaaaaatgctgattcactgagcatcagacgaatgcataagtgactattcctctacccttttcttgcatgtataatgtgtattcagtgaacgctgatagaagaagactcaaaagaatgcaactgcttgcctttctcattgcccacccttttgtaaagttccttcctttttcccgcaatagttgcttttttcccctttaaatattgaggtctccagatgccctttggaaaaagcaaaggaccacagatttttcctgagcttctgtgttcttttcctggttgtgtccttaaccttgacaaataaacctcttaaaatgattgagacccatctcggtcattttctttgatttacaacaccttgataatatttgtgtagtgaacgaataaatatccaaatgtaccataaacatgaagacctcaaacaccaagtgtgccaatgctaacagcctctaagtcctgacccaaactcactaacaagtgtaatccttcttaaaatgaacttacatgatcccatgctatcgaaatcacctcaaatggtcctaaatcctttgtgatcctaaactacccaaagtggtataagacttcagacgctcttagagattctgaagaggtataaattactcaaaacaactttaaatgctaaataatcttccatgactataaatggtgccaagtgacataaaccacccctaaaaagctctaagcaatcaaaatagaacctaaaccttaaaaatctctgtaagactttcaagacatttgaaccctaaacaatcctaactctaaatgcataaaatatcctgaatgaataatttcaggatattctttagagtctaagcacactaaagaatccaatcatttaaatgaccctatggtaatgtatctaacaaccttagagacctaatacctagaagtggcctcagatgcctgtaaactaccacagaacttgaatatgcaagttttgtgattctggagaggatcttgttagaacattgactcagatttagcagacctagggtgcggtttgagacactgccttcctaccaactcccaggggatgtggatgctgctgatccacaggccacacttggaatagcaaagctagaagctatataaacccaaaggatcctaagtcaattaaaactaccctaaattctaaaacaccctcagagatcccagacaatcctaaatcctaaacaactctaaacatgctaaagtt
